United States Patent 8,362,325 (NUCLEOTIDE SEQUENCES AND CORRESPONDING POLYPEPTIDES CONFERRING MODULATED PLANT CHARACTERISTICS) - sequence listing, part 10

SEQ ID NO: 20159 - protein, 1016 aa, Sorghum bicolor
  misc_feature: Ceres ANNOT ID no. 8631380
  misc_feature: Up-regulated in root tissues in response to salicylic acid treatment
  misc_feature (787)..(994): SWISSPROT Homolog: EC 3.6.3.25 Sulfate-transporting ATPase
  misc_feature (461)..(674): Pfam ID: ABC2_membrane Pfam Description: ABC-2 type transporter
  misc_feature (136)..(359): Pfam ID: ABC_tran Pfam Description: ABC transporter
  misc_feature (797)..(987): Pfam ID: ABC_tran Pfam Description: ABC transporter
  misc_feature (679)..(753): Pfam ID: PDR_assoc Pfam Description: Plant PDR ABC transporter associated
MEKLPTYDRMRQGILRQALAAGDQQQSGGVEVVDIQKLAGGDGGRELLERLFQDDSERFLRRLRDRIDMVGIELPTIEVRYEQLNVEADVIAAGRALPTLWNAATNLFEGLIGRFGSSNKRNITILKNVNGILKPSRMTLLLGPPSSGKSTLMRALAGKLDKNLKVSGSITYCGHPISEFYPERTSAYVGQYDLHNAEMTVRETLDFSRRCLGIGARYEMIAELARRERDAGIKPDPEIDAFMKATAVQGQETNIITDLTLKVLGLDICADVIIGDEMIRGISGGQKKRVTTGEMLTGPARALFMDEISTGLDSSSTFQIVKFMRQLVHVMNETVMISLLQPPPETYNLFDDIILLSEGYIVYHGPRENILEFFESAGFRCPDRKGVADFLQEVTSKKDQQQYWYLDQEQYHYVSVPDFAQRFKSFHACQQMQKELQIPFEKSKTHPAALTTRKYGLSSWESLKAVMSREQLLMKRNSFIYIFKVTQLIILALMSMTVFLRTKMPHGQIADGTKFFGALTFGLITIMFNGFAELQLTIKKLPVFYKHRDFLFFPAWTLGVANIILKVPVSLVESAVWVALTYYVMGFAPAAGRFFRQFIAFFATHQMAMALFRFLGAILKTMVVANTFGMFVLLIIFIFGGFVIRRNDIKPWWIWGYWASPMMYSQNAISINEFLASRWAIPNNDTTIDAPTVGKAILKSKGLFTGEWGFWLSIGALIGFIILFNMLYIWALTYLSRTNGATNTLAESRVTLPFQPLSLCFNHVNYYVDMPAEMKEQGFTESRLQLLSDISGAFRPGVLTALVGVSGAGKTTLMDVLAGRKTSGAIEGDITLSGFPKKQETFARISGYCEQTDIHSPNVTVFESITYSAWLRLSSDIDDGTKKMFVEEVMALVELDVLRDALVGLPGVSGLSTEQRKRLTIAVELVANPSIIFMDEPTSGLDARAAAIVMRTVRNTVNTGRTVVCTIHQPSIDIFESFDELLLLKRGGQVIYAGELGRHSHKLVEYFEVRPLFLCV

SEQ ID NO: 20160 - DNA, 2070 bp, Sorghum bicolor
  misc_feature: Ceres ANNOT ID no. 8631440
  misc_feature: Down-regulated in shoot tissues in response to salicylic acid treatment
  misc_feature: Encodes the peptide sequence at SEQ ID NO 20161
atggggagaggggccgggccttcctcctggctcgccgccgtggccactgccgcaacaccaagcttccgcgccgcccacgccctcctcctcacctccggccacctctcctcccgcgcctccgccaactccctcctccgcgccgccccatccccctccgcctgcgcgctcatcctacgcctccttctcctccaccgcttccgacccgaccacatctccctctccttctccctccactcctgcgcccgcgccgtcaccaccacccgcaacccgctcaccgccctcttccactcgctcgccctcaggctcggccacgcccgcgacgtctacgtcgccaacgccgccatctcttcctacttcgccgcctccgacgtcgcctctgccgaccgcctcttcgccgagctctccgctgacgacgtcgccgacgtcgtcacctggaccaccatggtcaccggccatgccaacgccaccaatctccagcgggcgaggcacttcttcgacgccatgcccgaccgcaacgtcgtttcctggaacgccatgctgggcgcctacgccagcgccggaatgctgtcccaggcgcgggacctgttcgacgcgatgcctcaaaggaacgccgccacgtggagctctatgctcactgggctcgtcctgtcgggacgctgcggggaggcgctcagggtgttccatgacatggtccgaagcggtgccgtgcccaatgagcccgcactggttagtgtggtctccgcgtgcgcgcagctgcggtctcttgagtacggcgcgtgggtgcacggatacgccgagcaggagctgcagggggcgatgagtgtcatcctcgcctccgccatcatcgacatgtacgggaaatgtgggggtatccacagtgccgtcagggtattcgccgcgatgcccgtgagaaacgtctactcctggaacgcaatgatcgctgggctcgcgatgaatggtggcgagagacaggccctgtcgctcttatggaagatgcagatggctggtgttcgaccgaatgacataactttcatcgggttgctcagcgcttgctcccactctggacttgtgaatgagggccgccggttgtttgacagtatgatcgaggactttgggatacagccagtccaacatcattacggtcttatggttgatttgattggccgctctggtcgtgttaaggaggccctatttttcgtcaagagcatgcctgtggaacctcaccctggcttatggggcgcactagctagcgcctgcaagatgcatggtgaggttgagcttggtgaggaggttgccaagaagctcattgagctggagcctcggcatggcagccgatacatcctcctgtcaaacttgtatggctctgcaaatcgatgggatgacatggcctttgtgcgcaagatcctcaaaaggcgcaaggtgcccaagggcactggcaatgcagtggttggaatgacattgacatccacactcagtaattgcacatacagggagtggaagtgcaaagaactagcaagaagtgcagactggtgcttgaatactgaccaaagagactttgtgctcaggagcagtgagctcgccacgctcgccgccatcttccacttcagtggcaccaaaccaagctaccttggcgttcagaagagtcatccatcccttgctctgtgccctgcaaccaataactgtgtttcgacatcagaggaaataagtgatttgaatcactatgctcccccgtggaactacaatcccaaggatggccagaggggtaaacccataaccaaagaggaggccatgaaagaactaattgaagtcgtggcgaagacaaagccagacagcttcactcctcgcattgtagataaaacagatgattacatccgagttgaatacgagagccctatatttgggtttgtagatgatgtggagttctggttccctcctggcaacaaaccactcgttcagtatcgttcggcgtctcgatcaggatttatcgacttcaatgccaataagaagagagtaaaggagctgagattggcattggaaaagaagggctgggcttcagaaagcaacttttga

SEQ ID NO: 20161 - protein, 689 aa, Sorghum bicolor
  misc_feature: Ceres ANNOT ID no. 8631440
  misc_feature: Down-regulated in shoot tissues in response to salicylic acid treatment
  misc_feature (205)..(239): Pfam ID: PPR Pfam Description: PPR repeat
  misc_feature (307)..(341): Pfam ID: PPR Pfam Description: PPR repeat
MGRGAGPSSWLAAVATAATPSFRAAHALLLTSGHLSSRASANSLLRAAPSPSACALILRLLLLHRFRPDHISLSFSLHSCARAVTTTRNPLTALFHSLALRLGHARDVYVANAAISSYFAASDVASADRLFAELSADDVADVVTWTTMVTGHANATNLQRARHFFDAMPDRNVVSWNAMLGAYASAGMLSQARDLFDAMPQRNAATWSSMLTGLVLSGRCGEALRVFHDMVRSGAVPNEPALVSVVSACAQLRSLEYGAWVHGYAEQELQGAMSVILASAIIDMYGKCGGIHSAVRVFAAMPVRNVYSWNAMIAGLAMNGGERQALSLLWKMQMAGVRPNDITFIGLLSACSHSGLVNEGRRLFDSMIEDFGIQPVQHHYGLMVDLIGRSGRVKEALFFVKSMPVEPHPGLWGALASACKMHGEVELGEEVAKKLIELEPRHGSRYILLSNLYGSANRWDDMAFVRKILKRRKVPKGTGNAVVGMTLTSTLSNCTYREWKCKELARSADWCLNTDQRDFVLRSSELATLAAIFHFSGTKPSYLGVQKSHPSLALCPATNNCVSTSEEISDLNHYAPPWNYNPKDGQRGKPITKEEAMKELIEVVAKTKPDSFTPRIVDKTDDYIRVEYESPIFGFVDDVEFWFPPGNKPLVQYRSASRSGFIDFNANKKRVKELRLALEKKGWASESNF

SEQ ID NO: 20162 - DNA, 750 bp, Sorghum bicolor
  misc_feature: Ceres ANNOT ID no. 8631554
  misc_feature: Down-regulated in root tissues in response to methyl jasmonate treatment
  misc_feature: Down-regulated in shoot tissues in response to aminocyclopropane carboxylic treatment
  misc_feature: Down-regulated in shoot tissues in response to methyl jasmonate treatment
  misc_feature: Down-regulated in shoot tissues in response to salicylic acid treatment
  misc_feature: Encodes the peptide sequence at SEQ ID NO 20163
atggcgcaggcggtggaggagtggtaccggcagatgcccatcatcacgcgctcctatctcaccgccgccgtcgtcaccaccgtcggctgcaccctcgacatcatttcgccgtaccacctgtacctcaacccgaagctcgtcgtgcagcactacgagatctggcgcctcgtcaccaacttcctctacttccgcaagatggatttggattttctgttccacatgttttttcttgctcgatactgcaaacttctggaggagaactcatttagaggaagaactgccgactttttctacatgctcttgtttggtgctactgtcctaactggcattgttctgatcggagggatgataccttacatttctgagacatttgccagaattctgttcttgagcaattcattaacgtttatgatggtttatgtctggagcaagcacaaccctttcatccatatgagctttctgggtctgttcacctttacggctgcttacttaccatgggtccttttgggcttctctatcctcgttgggagcagcacatgggtggatctcttgggtatgattgctggacatgtgtactacttcctggaagatgtatacccacggatgactggccggcgccccctgaagacaccgtccttcatcaaggcgctatttgctgatgacaatgttgtggtggcacagccacccaatgctgggattggtgccggtgcaaggtttggtgctgtgggtctagatccccaggcccaatga

SEQ ID NO: 20163 - protein, 249 aa, Sorghum bicolor
  misc_feature: Ceres ANNOT ID no. 8631554
  misc_feature: Down-regulated in root tissues in response to methyl jasmonate treatment
  misc_feature: Down-regulated in shoot tissues in response to aminocyclopropane carboxylic treatment
  misc_feature: Down-regulated in shoot tissues in response to methyl jasmonate treatment
  misc_feature: Down-regulated in shoot tissues in response to salicylic acid treatment
  misc_feature (12)..(212): Pfam ID: DER1 Pfam Description: Der1-like family
MAQAVEEWYRQMPIITRSYLTAAVVTTVGCTLDIISPYHLYLNPKLVVQHYEIWRLVTNFLYFRKMDLDFLFHMFFLARYCKLLEENSFRGRTADFFYMLLFGATVLTGIVLIGGMIPYISETFARILFLSNSLTFMMVYVWSKHNPFIHMSFLGLFTFTAAYLPWVLLGFSILVGSSTWVDLLGMIAGHVYYFLEDVYPRMTGRRPLKTPSFIKALFADDNVVVAQPPNAGIGAGARFGAVGLDPQAQ

SEQ ID NO: 20164 - DNA, 1479 bp, Sorghum bicolor
  misc_feature: Ceres ANNOT ID no. 8631611
  misc_feature: Up-regulated in shoot tissues in response to methyl jasmonate treatment
  misc_feature: Up-regulated in root tissues in response to methyl jasmonate treatment
  misc_feature: Down-regulated in root tissues in response to methyl jasmonate treatment
  misc_feature: Down-regulated in root tissues in response to aminocyclopropane carboxylic treatment
  misc_feature: Down-regulated in shoot tissues in response to salicylic acid treatment
  misc_feature: Down-regulated in shoot tissues in response to aminocyclopropane carboxylic treatment
  misc_feature: Encodes the peptide sequence at SEQ ID NO 20165
atgggcagcaacgcgccgcctccgccgacgcctcacgtggtgctggtcccgttcccggggcagggccacgtcgcgccgctgatgcagctggcgcgcctcctccacgcccggggcgcgcgcgtcaccttcgtctacacccagtacaactaccgccgcctcctgcgcgccaagggcgaggccgccgtcaggccccccgccacctcctccgcgaggttccgcatcgaggtcatcgacgacggcctctccctctccgtgccgcagaacgacgtcggggggctcgtcgactccctgcgcaaaaactgcctccacccgttccgcgccctgctgcgccgcctggggcaggaggtggaggggcaagacgcgccgcccgtcacctgcgtcgtcggcgacgtcgtcatgaccttcgccgccgcagctgccagggaggccggcatccccgaggtgcagttcttcacggcctcagcatgcggactcttgggctacttgcactacggcgagctcgtcgaacgaggcctcgtccctttcagagacgccagcctcctcgccgacgacgattacctggacacgccgctggagtgggtgcccgggatgagccacatgcggctcagggacatgccgacgttctgccgcaccacggaccccgacgacgtcatggtgtccgccacgctccagcagatggagagcgccgccggctccaaggccctcatcctcaacaccctgtacgagctcgagaaggacgtggtggacgcgctcgccgccttcttcccgccgatctacaccgtggggccgctcgccgaggtcatcgcgtcctccgactccgcctccgccggcctcgccgccatggacatcagcatctggcaggaggacacgcggtgcctgtcgtggctcgacgggaagccggccggctccgtggtgtacgtcaacttcggcagcatggccgtcatgacggccgcgcaggcgcgggagttcgcgctgggcctggcaagctgcggctccccgttcctgtgggtgaagcgccccgacgtggtggaaggcgaggaggtgctgctgccggaggccctgctggacgaggtggctcgcggcaggggcctcgtggtgccatggtgcccgcaggcagcagtgctcaagcacgccgccgtgggactgttcgtctcgcactgcggatggaactccctgctggaggccacggcggccggccagccggtgctcgcctggccctgccacggggaacagaccaccaactgcaggcagctgtgcgaggtctggggcaacggcgcgcagctgcccagggaagtggagagcggcgcggtggcccgtctggtgagggagatgatggtcggggacctgggcaaggagaagcgggcgaaggcggcggagtggaaggcggcggcggaggccgcggccaggaaaggcggcgcgtcgtggcgtaatgttgaacgcgtggtgaacgacctgctgctggtcgggggcaagcagtga

SEQ ID NO: 20165 - protein, 492 aa, Sorghum bicolor
  misc_feature: Ceres ANNOT ID no. 8631611
  misc_feature: Up-regulated in shoot tissues in response to methyl jasmonate treatment
  misc_feature: Up-regulated in root tissues in response to methyl jasmonate treatment
  misc_feature: Down-regulated in root tissues in response to methyl jasmonate treatment
  misc_feature: Down-regulated in root tissues in response to aminocyclopropane carboxylic treatment
  misc_feature: Down-regulated in shoot tissues in response to salicylic acid treatment
  misc_feature: Down-regulated in shoot tissues in response to aminocyclopropane carboxylic treatment
  misc_feature (74)..(447): SWISSPROT Homolog: EC 2.4.1.121 Indole-3-acetate beta-glucosyltransferase
  misc_feature (12)..(489): Pfam ID: UDPGT Pfam Description: UDP-glucoronosyl and UDP-glucosyl transferase
MGSNAPPPPTPHVVLVPFPGQGHVAPLMQLARLLHARGARVTFVYTQYNYRRLLRAKGEAAVRPPATSSARFRIEVIDDGLSLSVPQNDVGGLVDSLRKNCLHPFRALLRRLGQEVEGQDAPPVTCVVGDVVMTFAAAAAREAGIPEVQFFTASACGLLGYLHYGELVERGLVPFRDASLLADDDYLDTPLEWVPGMSHMRLRDMPTFCRTTDPDDVMVSATLQQMESAAGSKALILNTLYELEKDVVDALAAFFPPIYTVGPLAEVIASSDSASAGLAAMDISIWQEDTRCLSWLDGKPAGSVVYVNFGSMAVMTAAQAREFALGLASCGSPFLWVKRPDVVEGEEVLLPEALLDEVARGRGLVVPWCPQAAVLKHAAVGLFVSHCGWNSLLEATAAGQPVLAWPCHGEQTTNCRQLCEVWGNGAQLPREVESGAVARLVREMMVGDLGKEKRAKAAEWKAAAEAAARKGGASWRNVERVVNDLLLVGGKQ

SEQ ID NO: 20166 - DNA, 639 bp, Sorghum bicolor
  misc_feature: Ceres ANNOT ID no. 8631612
  misc_feature: Up-regulated in shoot tissues in response to methyl jasmonate treatment
  misc_feature: Up-regulated in root tissues in response to methyl jasmonate treatment
  misc_feature: Down-regulated in shoot tissues in response to salicylic acid treatment
  misc_feature: Encodes the peptide sequence at SEQ ID NO 20167
atgaagctgtacggtgcgacggtgtcgtggaacgtgacccggtgcgtggtggcgctggaggaggccggcgccgagtaccagatcgtacctatcgatttcgccaccgccgagcacaagagccccgaacacctcgcccgcaacccgttcggtcaagttccagctttccaagatggcgatctccacctatgggaatcgcgtgcgatttgcaagtacgttgcccgcaagaacaaggcagcagagctgctgagggaaggcaacctccaggagtcagccatggtggacgtgtggctggaggtggagtccaaccagtacaccgccgccctgaaccctatcctgtacgagtgcctcgtcagccctatgttcggcggcaccaccgaccagaaagtggtggaggagaacctggagaagctgaagaaggtgctggaggtgtacgaggcgcggctcgccaagcacaagtacctcgccggagacttcctcagcctcgccgacctcaaccacgtctccgtcacgctttgcctgctcgcgacgccccatgcttctgtgctcaacgcgtaccctcacgtcaaggcatggtgggatggcctcatggccaggccgtctgtccagaaggtcgccgcgctcatgaagccgtctgcttga

SEQ ID NO: 20167 - protein, 212 aa, Sorghum bicolor
  misc_feature: Ceres ANNOT ID no. 8631612
  misc_feature: Up-regulated in shoot tissues in response to methyl jasmonate treatment
  misc_feature: Up-regulated in root tissues in response to methyl jasmonate treatment
  misc_feature: Down-regulated in shoot tissues in response to salicylic acid treatment
  misc_feature (1)..(212): SWISSPROT Homolog: EC 2.5.1.18 Glutathione transferase
  misc_feature (1)..(74): Pfam ID: GST_N Pfam Description: Glutathione S-transferase, N-terminal domain
  misc_feature (104)..(199): Pfam ID: GST_C Pfam Description: Glutathione S-transferase, C-terminal domain
MKLYGATVSWNVTRCVVALEEAGAEYQIVPIDFATAEHKSPEHLARNPFGQVPAFQDGDLHLWESRAICKYVARKNKAAELLREGNLQESAMVDVWLEVESNQYTAALNPILYECLVSPMFGGTTDQKVVEENLEKLKKVLEVYEARLAKHKYLAGDFLSLADLNHVSVTLCLLATPHASVLNAYPHVKAWWDGLMARPSVQKVAALMKPSA

SEQ ID NO: 20168 - DNA, 1668 bp, Sorghum bicolor
  misc_feature: Ceres ANNOT ID no. 8631603
  misc_feature: Up-regulated in root tissues in response to methyl jasmonate treatment
  misc_feature: Up-regulated in shoot tissues in response to methyl jasmonate treatment
  misc_feature: Down-regulated in shoot tissues in response to salicylic acid treatment
  misc_feature: Encodes the peptide sequence at SEQ ID NO 20169
atggaggtagaggccgcggccgccacggtgctggccgcgcccttgctgtcctcctccgcgatcctcaaactgctgctattcgtagtgacgctctcgtacctggcccgagccctgaggcggccacgcaaaagcaccaccaagtgcagcagcacaacgtgcgcctcgcccccggccggcgttggcaacccgccgctcccaccgggtcccgtgccgtggcccgtcgtcggcaacctgccggagatgctgctgaacaagccggcattccgctggatccaccagatgatgcgcgagatgggcacggacatcgcctgcgtcaagcttggcggcgtccacgtcgtgtccatcacctgcccggagatcgcgcgggaggtgctccggaagcaggacgccaacttcatatcccgcccgctcaccttcgcctccgagacgttcagcggcgggtaccggaacgccgtgctctcgccctacggcgaccagtggaagaagatgcgccgcgtcctcacctccgagatcatctgcccgtcccgccacgcctggctccacgacaagcgcaccgacgaggccgacaacctcacccgctacgtctacaacctcgccaccaaagccgccaccggcgacgtcgccgtcgacgtcaggcacgtcgctcgtcactattgcggcaacgttatccgccgcctcatgttcaacaggcgctacttcggcgagccccaggctgacggcggtccggggccgatggaggtgctgcatatggacgccgtgttcacctccctcggcctcctctacgccttctgcgtctccgactacctcccctggctgcggggcctcgacctcgacggccacgagaagatcgtcaaggaggctaacgtggcggtgaacaggctccacgacacggtcatcgacgaccggtggaggcagtggaagagcggcgagcggcaggagatggaggacttcctggatgtgctcatcactctcaaggacgcccagggcaacccgctgctgaccatcgaggaggtcaaagcgcagtcacaggacatcacgttcgcggcggtggacaacccgtcgaacgccgtggagtgggcgctggcagagatggtgaacaacccggaggtgatggcgaaggcgatggaggagctggaccgcgtcgtcggacgggagaggctagtgcaggagtcggacattccgaagctcaactacgtgaaggcctgcatccgggaggctttccgtctgcacccggtggcgcccttcaacgtgccccacgtcgcgctcgccgacaccaccatcgccggctaccgcgttcccaagggcagccacgtgatcctgagccgcacggggctgggccgcaacccgcgcgtgtgggacgagcccctgcgcttctacccggaccgacacctcgccaccgccgcgtccgacgtcgcgctcaccgagaacgacctgcggttcatctccttcagcaccggccgccgcggctgcatcgccgcgtcgctcggcaccgccatgagcgtcatgctcttcggaaggctcctgcaggggttcacctggagcaagcccgccggggtggaggccgtggacctcagcgagtccaagagcgacaccttcatggccaccccgctggtgctgcacgctgagcccaggctgccggcgcacctctacccgtccatctccatctga

SEQ ID NO: 20169 - protein, 555 aa, Sorghum bicolor
  misc_feature: Ceres ANNOT ID no. 8631603
  misc_feature: Up-regulated in root tissues in response to methyl jasmonate treatment
  misc_feature: Up-regulated in shoot tissues in response to methyl jasmonate treatment
  misc_feature: Down-regulated in shoot tissues in response to salicylic acid treatment
  misc_feature (80)..(555): SWISSPROT Homolog: EC 1.14.13.41 Tyrosine N-monooxygenase
  misc_feature (66)..(541): Pfam ID: p450 Pfam Description: Cytochrome P450
MEVEAAAATVLAAPLLSSSAILKLLLFVVTLSYLARALRRPRKSTTKCSSTTCASPPAGVGNPPLPPGPVPWPVVGNLPEMLLNKPAFRWIHQMMREMGTDIACVKLGGVHVVSITCPEIAREVLRKQDANFISRPLTFASETFSGGYRNAVLSPYGDQWKKMRRVLTSEIICPSRHAWLHDKRTDEADNLTRYVYNLATKAATGDVAVDVRHVARHYCGNVIRRLMFNRRYFGEPQADGGPGPMEVLHMDAVFTSLGLLYAFCVSDYLPWLRGLDLDGHEKIVKEANVAVNRLHDTVIDDRWRQWKSGERQEMEDFLDVLITLKDAQGNPLLTIEEVKAQSQDITFAAVDNPSNAVEWALAEMVNNPEVMAKAMEELDRVVGRERLVQESDIPKLNYVKACIREAFRLHPVAPFNVPHVALADTTIAGYRVPKGSHVILSRTGLGRNPRVWDEPLRFYPDRHLATAASDVALTENDLRFISFSTGRRGCIAASLGTAMSVMLFGRLLQGFTWSKPAGVEAVDLSESKSDTFMATPLVLHAEPRLPAHLYPSISI

SEQ ID NO: 20170 - DNA, 1743 bp, Sorghum bicolor
  misc_feature: Ceres ANNOT ID no. 8631634
  misc_feature: Down-regulated in shoot tissues in response to methyl jasmonate treatment
  misc_feature: Down-regulated in root tissues in response to methyl jasmonate treatment
  misc_feature: Down-regulated in shoot tissues in response to salicylic acid treatment
  misc_feature: Encodes the peptide sequence at SEQ ID NO 20171
atgtgccggtgtgccctgttggatccgcatagcaattcctgtgacgactgcaagcgcgatctcggcgaccccccacctcgccgactggcttccccctccacctcaccgccgggcagcagagacccctccgggctgggatcgggttcctccttccccggtaaggatccctgccctgcctccctcggttcgtgtcgttggattgctcctcgtcctgctctgctctgccctgtcgtgtttgtttgtttcctcgccgcgaggactctgattaatcctggcaatttcgtcctggagctatccttctgcaggctcttcagaagatatactgtcttgcaacttggttttcttaacaaaaaaactatccttctgcaggctcttcagaaacttattcacccaaacattgtgaagctgaaggatgtgacaatggaaaatcatgagccattcttcatctttgaaaacatggtgtgcaaaccaagacctgtccatgatgcttcccatacaaaaacaaacgaacctagatctaatccaagttccagctggtcggacctcccaaaggatcttgtcctcagcatcctgcaacgccttcaactcccagaagctattgcttttgcatcagtatgcacatcatggctttcggctgccacagctgctggcgtcccacgctcttgtacaccaatgatcatgtcttggcgggacattctcgagagtagagaatcgcgaggggccaagggcagctcttctgtaaactgcaagttcctccatctcttggatgtccataaggcttatgatgtgagatttccccaaggtttatgcttcatggcatgctgtggatcctcccatggctggctgattctggtgaacgaactcgccaatctcgtgctctacaaccccttcacctcggaaatgatccctctcccaccaatcactgatttcacatgcgttgaggcagtctgtggtagcaaaggcaacattgaagcatacaattttgagaatcatcgagtccaggatgcaaagtacttggcaacatggttctaccagaaagcggtgttgtcttgcagtccatccaagagtgctaactatgtcgtcatgatcatccaccgggataacaactggctttcttctgttagggctggagatagcaattggcaagtggctgcaactttagtcgctcagaaggcggaccggtatgcggactgtgcgtaccacaatgggatgttctacaccgtgacatttgaaggaatagtggagaaatgggatgttgatggaccgaatggaccagcaaaggaggtgattgtagccaagaggagcagtagacgcattctctccaggcatctggtgtctacaccatggggtgacctgctggaagtgcgagcatttgttgcaaactccaggaggatgtatagagatggtgtcgcattccgaattttcaaggttcatcttgatggatatgagaaggtatcaccagtaccaaagatagacttaatggagcatgcaatcttaatcggcttgaatcactcggcatgtttgtccaccaagaatttcccctggctgaggccttgttgcatctacttctcagtaccttggatgacgcccatatgtcatctgcttcgtcgatgtccagaatggggaggcgtgaggacctacgacataaaacaaagaacatttgatcatgttttccgtctctgccctcatacaaatcgcctcaaccttgctccttctgaggtttggatcacaccgaatttataa

SEQ ID NO: 20171 - protein, 580 aa, Sorghum bicolor
  misc_feature: Ceres ANNOT ID no. 8631634
  misc_feature: Down-regulated in shoot tissues in response to methyl jasmonate treatment
  misc_feature: Down-regulated in root tissues in response to methyl jasmonate treatment
  misc_feature: Down-regulated in shoot tissues in response to salicylic acid treatment
  misc_feature (177)..(224): Pfam ID: F-box Pfam Description: F-box domain
MCRCALLDPHSNSCDDCKRDLGDPPPRRLASPSTSPPGSRDPSGLGSGSSFPGKDPCPASLGSCRWIAPRPALLCPVVFVCFLAARTLINPGNFVLELSFCRLFRRYTVLQLGFLNKKTILLQALQKLIHPNIVKLKDVTMENHEPFFIFENMVCKPRPVHDASHTKTNEPRSNPSSSWSDLPKDLVLSILQRLQLPEAIAFASVCTSWLSAATAAGVPRSCTPMIMSWRDILESRESRGAKGSSSVNCKFLHLLDVHKAYDVRFPQGLCFMACCGSSHGWLILVNELANLVLYNPFTSEMIPLPPITDFTCVEAVCGSKGNIEAYNFENHRVQDAKYLATWFYQKAVLSCSPSKSANYVVMIIHRDNNWLSSVRAGDSNWQVAATLVAQKADRYADCAYHNGMFYTVTFEGIVEKWDVDGPNGPAKEVIVAKRSSRRILSRHLVSTPWGDLLEVRAFVANSRRMYRDGVAFRIFKVHLDGYEKVSPVPKIDLMEHAILIGLNHSACLSTKNFPWLRPCCIYFSVPWMTPICHLLRRCPEWGGVRTYDIKQRTFDHVFRLCPHTNRLNLAPSEVWITPNL

SEQ ID NO: 20172 - DNA, 1602 bp, Sorghum bicolor
  misc_feature: Ceres ANNOT ID no. 8631626
  misc_feature: Down-regulated in shoot tissues in response to salicylic acid treatment
  misc_feature: Encodes the peptide sequence at SEQ ID NO 20173
atgcgtcagggctcgctgccgctgctgctgcttgcggcggcggcggcagtagcggctgccgcggtctccgccgagccggcgtcgacgctgcctgggccgtcgcggccggtgacggtggcggttggggacaggggccacgcggtggacctgccggacacggacccgcgggtgcagcgccgcgtcacgggctgggcgcccgagcaggtcgccgtcgcgctctccgccgcgcccacctccgcttgggtctcctggatcactggggacttccagatgggcggcgccgtcaagccgctggaccccagcgcggtgggcagcgtcgtgcgctacggcctcgccgccgactccctcgtccacgaggccaccggggagtcgctcgtgtacagccagctctatcccttcgagggcctgcagaactacacctccggcatcatccaccatgtccgcctccaaggcctggagcctgagaccaggtacttctaccagtgcggcgacccgtccatcccggacgccatgagcgcagtgcacgcgttccggacgatgccggcggtcggtcccaagagctatccggagaggatcgccgtggtcggggacctcgggctcacgtacaacaccacctcgacgcccgacatggtgctcctcctcggcgacgtctgctacgccaacctgtacctgaccaacggcaccggaaccgactgctattcctgctcattcgccaactccacgcccatccacgagacctaccagccgcgctgggactactggggaaggtacatggagcccgtgacgtcgagcattccgatgatggtggtggagggcaaccatgagatcgaggagcagattcacaacaagacattcgcgtcctacagctccaggttcgcgttcccgtcggaggagagcggatcgttctccccgttctactactcgttcgacgccggcggcatccacttcgtcatgcttgcgtcttatgtcgactacaacagatcaggtgcgcagtaccgatggctggaggaggacttggtgaaggtggacaggtcggtgacgccgtggctgatcgccggctggcacgcgccctggtacaccacgtaccaagctcactacagggaagccgagtgcatgagggtggagatggaggagctcctctacgcctacgccgtcgacgtcgtcttcaccggccatgtgcacgcgtacgagcggtcgaaccgggtgttcaactacacgctggacgcgtgcggccccgtgtacatctcggtgggcgacggcggcaaccgcgagaagatggcgacggcgcacgcggacgacccgggccactgcccggacccggcgtcgacgccggaccccttcatggggggacgcctctgcgcggccaacttcacgaccggacccgccgcggggcgcttctgctgggaccagcagccggactacagcgcgtacagggagagcagcttcgggcacggcgtcctggaggtgaagaacgacacgcacgcgctctggcagtggcaccgcaaccaggacctcaacgccgacgtcgccgccgacgaggtgtacatcgtcagggagccctacaagtgcctcgccaagtcaaccagattattggcctattga

SEQ ID NO: 20173 - protein, 533 aa, Sorghum bicolor
  misc_feature: Ceres ANNOT ID no. 8631626
  misc_feature: Down-regulated in shoot tissues in response to salicylic acid treatment
  misc_feature (138)..(422): SWISSPROT Homolog: EC 3.1.3.2 Acid phosphatase
  misc_feature (190)..(396): Pfam ID: Metallophos Pfam Description: Calcineurin-like phosphoesterase
MRQGSLPLLLLAAAAAVAAAAVSAEPASTLPGPSRPVTVAVGDRGHAVDLPDTDPRVQRRVTGWAPEQVAVALSAAPTSAWVSWITGDFQMGGAVKPLDPSAVGSVVRYGLAADSLVHEATGESLVYSQLYPFEGLQNYTSGIIHHVRLQGLEPETRYFYQCGDPSIPDAMSAVHAFRTMPAVGPKSYPERIAVVGDLGLTYNTTSTPDMVLLLGDVCYANLYLTNGTGTDCYSCSFANSTPIHETYQPRWDYWGRYMEPVTSSIPMMVVEGNHEIEEQIHNKTFASYSSRFAFPSEESGSFSPFYYSFDAGGIHFVMLASYVDYNRSGAQYRWLEEDLVKVDRSVTPWLIAGWHAPWYTTYQAHYREAECMRVEMEELLYAYAVDVVFTGHVHAYERSNRVFNYTLDACGPVYISVGDGGNREKMATAHADDPGHCPDPASTPDPFMGGRLCAANFTTGPAAGRFCWDQQPDYSAYRESSFGHGVLEVKNDTHALWQWHRNQDLNADVAADEVYIVREPYKCLAKSTRLLAY

SEQ ID NO: 20174 - DNA, 1788 bp, Sorghum bicolor
  misc_feature: Ceres ANNOT ID no. 8631658
  misc_feature: Up-regulated in root tissues in response to salicylic acid treatment
  misc_feature: Up-regulated in shoot tissues in response to salicylic acid treatment
  misc_feature: Encodes the peptide sequence at SEQ ID NO 20175
atgctggagtccggcgtcgcggccaacgacttcgcgtgcaacgcggcgctggcggcgtgcgcggccgcgggcgccggcgcgctcagcctcggcgagcaggtgcactcgctcgccgtgcgggcgggcttcgccgccgacgcctggatcgggagttgcctcatcgagctctactcgaggtgcggctccatgtgggcggctgaggaggtgtttcgcaggatggaggcgccggatgtcgtggggtacacttcgcttgtctcggcgctctgcaggaacggcgacctcgcacgggctgtggaggtgctctgtcagatgatgaggcaggggttgcagccgaacgagcacacgatgacgagcatgctggcggagtgccctcgaatgattggcgagcagatacatggatatatgctcaaggtaatgggttcacagagcgtctatgcatcgactgcactgattgacttctattcgaggtacggtgactttgacatggcggagaccgtgtttgaaaatcttgactccaagaacgtggtgtcgtggtgctccatgatgcagctgtgcattagggatggaaggttggaagatgcactgcgagtgttcagcgagatgatttcggaggccgttgagccaaatgagtttgcattttcaattgctctcggggcttgtgggtctgtttgtctggggcgtcaaattcactgctcagccatcaagtgcaacttaatgactgacatccgagtatcaaatgctttgctctctatgtatggtaggagtggttttgtttcagaagtcgaggctgtgcttggcaagattgaaaatcctgatcttgttagctggacagctgccatttctgcgaacttccagaatggtttcagtgagaaggccgtagcattgcttcttcagatgcattcggaaggttttacaccgaatgactatgccttctctagtggtctgagttcttgtgcagacctggcattgctggatcaaggaaggcagcttcattgcctggcactgaaactggggtgtgacttcaaagtttgtactgggaatgcactaatcaacatgtactccaagtgtggtcaaattggatctgcaaggcttgcatttgatgtcatgaatcttcatgatgtcatgtcttggaactcactgatccatggtctcgcacagcatggagctgcaaacttggtactggaggcattcagtgagatgtgttcaagtggttggcagccagacgattcgacatttatagcagtcttggtagggtgcaatcatgcaggtctggtgaaggaaggggagacattcttcagactaatgactgatcggtatggtctcacaccgaccccttctcactatgcttgcatgatcgacatgctgggtcggaatggtagattcgatgaggcgctacacatgatcaagaatatgccattcgagcctgatgttttgatttggaagacactattagcatcttgcaagctgcacaagaatcttgacattggaaaactcgcaacagacaagctgatggagctttcagaaagagactccgcgagctacgtgctgatgtcaaacctctatgcgatgcatgaagaatggcaggatgcggagagggtgcgtcggaggatggatgaaattggggtgaagaaggatgccggttggagctggatcgaggtcaagaacgaggtcagcacctttgttgcaagagacacgtctcattcagactccgcatccatctatcagatgcttgcagagctcgttgttgtgatgcaagatacagagttagatgttcatatgcagatttag

SEQ ID NO: 20175 - protein, 595 aa, Sorghum bicolor
  misc_feature: Ceres ANNOT ID no. 8631658
  misc_feature: Up-regulated in root tissues in response to salicylic acid treatment
  misc_feature: Up-regulated in shoot tissues in response to salicylic acid treatment
  misc_feature (79)..(113): Pfam ID: PPR Pfam Description: PPR repeat
  misc_feature (176)..(210): Pfam ID: PPR Pfam Description: PPR repeat
  misc_feature (274)..(308): Pfam ID: PPR Pfam Description: PPR repeat
  misc_feature (375)..(409): Pfam ID: PPR Pfam Description: PPR repeat
MLESGVAANDFACNAALAACAAAGAGALSLGEQVHSLAVRAGFAADAWIGSCLIELYSRCGSMWAAEEVFRRMEAPDVVGYTSLVSALCRNGDLARAVEVLCQMMRQGLQPNEHTMTSMLAECPRMIGEQIHGYMLKVMGSQSVYASTALIDFYSRYGDFDMAETVFENLDSKNVVSWCSMMQLCIRDGRLEDALRVFSEMISEAVEPNEFAFSIALGACGSVCLGRQIHCSAIKCNLMTDIRVSNALLSMYGRSGFVSEVEAVLGKIENPDLVSWTAAISANFQNGFSEKAVALLLQMHSEGFTPNDYAFSSGLSSCADLALLDQGRQLHCLALKLGCDFKVCTGNALINMYSKCGQIGSARLAFDVMNLHDVMSWNSLIHGLAQHGAANLVLEAFSEMCSSGWQPDDSTFIAVLVGCNHAGLVKEGETFFRLMTDRYGLTPTPSHYACMIDMLGRNGRFDEALHMIKNMPFEPDVLIWKTLLASCKLHKNLDIGKLATDKLMELSERDSASYVLMSNLYAMHEEWQDAERVRRRMDEIGVKKDAGWSWIEVKNEVSTFVARDTSHSDSASIYQMLAELVVVMQDTELDVHMQI

SEQ ID NO: 20176 - DNA, 795 bp, Sorghum bicolor
  misc_feature: Ceres ANNOT ID no. 8631700
  misc_feature: Down-regulated in root tissues in response to methyl jasmonate treatment
  misc_feature: Down-regulated in shoot tissues in response to aminocyclopropane carboxylic treatment
  misc_feature: Down-regulated in shoot tissues in response to methyl jasmonate treatment
  misc_feature: Down-regulated in shoot tissues in response to salicylic acid treatment
  misc_feature: Encodes the peptide sequence at SEQ ID NO 20177
atggctaggggattgaagaagcatctcaagaggctcaatgcgcccaagcattggatgctggacaagcttggcggagcttttgcccccaagccatcttctggtcctcataagtccagagagtgcctgcctctgatcctcatcatcaggaacaggctcaagtatgctctgacataccgtgaggtcatttctatcctgatgcaacgccatgtacttgtggatggcaaggtcaggactgacaagacctaccctgctgggttcatggatgtcatttccatccccaagaccaacgagaactacaggctgctgtatgacaccaagggccgcttccgtcttcacccaatcagggatgaggatgctaagttcaagctctgcaaggttaggtctgttcagtttggccagaagggcatcccgtacctgaacacctatgatggccgcaccatccgctaccctgacccgctcatcaaggccaatgacaccatcaagattgatttggagaccaacaagattgtggacttcatcaagtttgatgttggcaatgttgtcatggtgactggtggtaggaacactgggcgtgttggtgttatcaagaacagggagaagcataagggcagctttgagaccatccacgtcgaggactctctgggccaccagtttgccacccgtatgggtaatgtgttcactattggcaagggcaacaagccgtgggtgagcctgcccaagggcaagggtatcaagctaagcatcatcgaggaacaaaggaagcgggatgccgctgcccaggctgctgccgcataa

SEQ ID NO: 20177 - protein, 264 aa, Sorghum bicolor
  misc_feature: Ceres ANNOT ID no. 8631700
  misc_feature: Down-regulated in root tissues in response to methyl jasmonate treatment
  misc_feature: Down-regulated in shoot tissues in response to aminocyclopropane carboxylic treatment
  misc_feature: Down-regulated in shoot tissues in response to methyl jasmonate treatment
  misc_feature: Down-regulated in shoot tissues in response to salicylic acid treatment
  misc_feature (94)..(170): Pfam ID: Ribosomal_S4e Pfam Description: Ribosomal family S4e
  misc_feature (3)..(40): Pfam ID: RS4NT Pfam Description: RS4NT (NUC023) domain
  misc_feature (177)..(211): Pfam ID: KOW Pfam Description: KOW motif
  misc_feature (42)..(90): Pfam ID: S4 Pfam Description: S4 domain
MARGLKKHLKRLNAPKHWMLDKLGGAFAPKPSSGPHKSRECLPLILIIRNRLKYALTYREVISILMQRHVLVDGKVRTDKTYPAGFMDVISIPKTNENYRLLYDTKGRFRLHPIRDEDAKFKLCKVRSVQFGQKGIPYLNTYDGRTIRYPDPLIKANDTIKIDLETNKIVDFIKFDVGNVVMVTGGRNTGRVGVIKNREKHKGSFETIHVEDSLGHQFATRMGNVFTIGKGNKPWVSLPKGKGIKLSIIEEQRKRDAAAQAAAA

SEQ ID NO: 20178 - DNA, 795 bp, Sorghum bicolor; identical to SEQ ID NO: 20176
  misc_feature: Ceres ANNOT ID no. 8631696
  misc_feature: Down-regulated in root tissues in response to methyl jasmonate treatment
  misc_feature: Down-regulated in shoot tissues in response to aminocyclopropane carboxylic treatment
  misc_feature: Down-regulated in shoot tissues in response to methyl jasmonate treatment
  misc_feature: Down-regulated in shoot tissues in response to salicylic acid treatment
  misc_feature: Encodes the peptide sequence at SEQ ID NO 20179

SEQ ID NO: 20179 - protein, 264 aa, Sorghum bicolor; identical to SEQ ID NO: 20177
  misc_feature: Ceres ANNOT ID no. 8631696
  misc_feature: Down-regulated in root tissues in response to methyl jasmonate treatment
  misc_feature: Down-regulated in shoot tissues in response to aminocyclopropane carboxylic treatment
  misc_feature: Down-regulated in shoot tissues in response to methyl jasmonate treatment
  misc_feature: Down-regulated in shoot tissues in response to salicylic acid treatment
  misc_feature (94)..(170): Pfam ID: Ribosomal_S4e Pfam Description: Ribosomal family S4e
  misc_feature (3)..(40): Pfam ID: RS4NT Pfam Description: RS4NT (NUC023) domain
  misc_feature (177)..(211): Pfam ID: KOW Pfam Description: KOW motif
  misc_feature (42)..(90): Pfam ID: S4 Pfam Description: S4 domain

SEQ ID NO: 20180 - DNA, 2196 bp, Sorghum bicolor
  misc_feature: Ceres ANNOT ID no. 8631717
  misc_feature: Down-regulated in shoot tissues in response to salicylic acid treatment
  misc_feature: Encodes the peptide sequence at SEQ ID NO 20181
atggggacttcggtgcaggtgacgcctctcagtggggcgtacggggagggtcccctgtgctacctgctcgctgtcgacggcttccgcttcctcctcgactgcggatggacggacctctgcgatacctcgcaacttcaacccctcgccaaggttgcaccaactgtagatgctgttcttctgtcacatcctgacatgatgcatctaggagctttgccttatgctatgaaacatcttgggctctctgcaccagtttatgcaacagaacccgtgtttagacttggccttttgaccatgtacgaccatttcctatctcgatggcaagtttcagactttgacttgtttactttggatgatgttgatgctgcattccaaaatgttgtgagattgaaatactcacaaaattaccttctgaatgataaaggtgaagggattgttattgctccacatgtggctgggcatcttttggggggtacagtgtggaagattacaaaagatggggaggatgttgtgtatgctgttgacttcaaccatcggaaagagaggcatttgaatggcaccgttcttggatctttcgtgcggccagctgttcttataaccgatgcttacaatgctttgaacaatcaaggctatagaaaaaagcaagatcaagatttcattgattcattaattaaagttctagcaactggtggaagtgtgctacttcctgttgatacggctggtagagtgttggaacttcttttgttattggatacgtactgggatgaacggcgattgcagtatcctatctactttctgacaaatgtgtcgacaagtactgttgactatgtcaagagttttcttgaatggatgcgtgatcagatagcaaaatcttttgaaagcaatagagccaatgccttcttgttgaaaaaggtaatgctgataattaacaaagaagagcttgagaaattgggagatgctccaaaggtggttctagcatccatggcaagtttggaggttggcttttctcatgacatatttgttgagatggcaaatgaagcaagaaatctagtgctctttactgagaagggacagtttgggacactggctcgaatgctccaagtggacccaccccctaaagctgtaaaggtcactatgagcaagcgcattcctttggtgggtgatgaactaaaggcttatgaagaagaacaggaacggataaaaaaagaaaaagcgctaaaggctagccttgtcaaagaagaggagctgaaggcttctcttggatcaaatgccaaggcttctgacccaatggtcattgatgcaagctcatctcgaaaatctgcgaatgctggttcacattttggtgggaacactgatattctcattgatggatttgtacctccttcaaccagtgttgctccaatgtttcccttttttgaaaacactgctgaatgggatgactttggtgaggtcatcaaccctgatgattatatgatgaaacaagaagaaatggataatactctgatgcttggtcctggagatggtttagatggtaagattgatgatggctcagcacgcctgcttctcgattcaacaccctcaaaagtcatttccaatgagatgactgttcaagtgaaatgctcattggtttatatggactttgaaggtcgctctgatgggcgttctgtaaaatcagttattgctcatgtggctccactgaaacttgttctggtgcatggatcagcggaagcaactgaacatttgaaaatgcattgcacaaagaatttagaccttcatgttcatgctcctcagattgaggaaacaattgatgtaacatcggatttatgtgcttataaggtccaactttcagagaagttaatgagtaacatcatttctaagaagttgggtgagcatgaaattgcttgggtggatgcagaagttggaaaagaagatgagaagcttattttgctccccccatcatcaacaccgccaccccacaagccagttcttgtgggtgatttaaaattgtccgattttaaacagtttttggaaaataaaggctggcaggttgaatttgccggaggtgctttgcggtgtggcgaatacatcatggtgcgcaagattggagattctagccaaaagatcgtcattgagggcccactctgcgaggactattacaagatcagggagcttctgtactcgcagttctacttgctgtga

SEQ ID NO: 20181 - protein, 731 aa, Sorghum bicolor
  misc_feature: Ceres ANNOT ID no. 8631717
  misc_feature: Down-regulated in shoot tissues in response to salicylic acid treatment
  misc_feature (533)..(575): Pfam ID: RMMBL Pfam Description: RNA-metabolising metallo-beta-lactamase
  misc_feature (17)..(205): Pfam ID: Lactamase_B Pfam Description: Metallo-beta-lactamase superfamily
MGTSVQVTPLSGAYGEGPLCYLLAVDGFRFLLDCGWTDLCDTSQLQPLAKVAPTVDAVLLSHPDMMHLGALPYAMKHLGLSAPVYATEPVFRLGLLTMYDHFLSRWQVSDFDLFTLDDVDAAFQNVVRLKYSQNYLLNDKGEGIVIAPHVAGHLLGGTVWKITKDGEDVVYAVDFNHRKERHLNGTVLGSFVRPAVLITDAYNALNNQGYRKKQDQDFIDSLIKVLATGGSVLLPVDTAGRVLELLLLLDTYWDERRLQYPIYFLTNVSTSTVDYVKSFLEWMRDQIAKSFESNRANAFLLKKVMLIINKEELEKLGDAPKVVLASMASLEVGFSHDIFVEMANEARNLVLFTEKGQFGTLARMLQVDPPPKAVKVTMSKRIPLVGDELKAYEEEQERIKKEKALKASLVKEEELKASLGSNAKASDPMVIDASSSRKSANAGSHFGGNTDILIDGFVPPSTSVAPMFPFFENTAEWDDFGEVINPDDYMMKQEEMDNTLMLGPGDGLDGKIDDGSARLLLDSTPSKVISNEMTVQVKCSLVYMDFEGRSDGRSVKSVIAHVAPLKLVLVHGSAEATEHLKMHCTKNLDLHVHAPQIEETIDVTSDLCAYKVQLSEKLMSNIISKKLGEHEIAWVDAEVGKEDEKLILLPPSSTPPPHKPVLVGDLKLSDFKQFLENKGWQVEFAGGALRCGEYIMVRKIGDSSQKIVIEGPLCEDYYKIRELLYSQFYLL

SEQ ID NO: 20182 - DNA, 1464 bp, Sorghum bicolor
  misc_feature: Ceres ANNOT ID no. 8631762
  misc_feature: Up-regulated in shoot tissues in response to methyl jasmonate treatment
  misc_feature: Up-regulated in root tissues in response to methyl jasmonate treatment
  misc_feature: Encodes the peptide sequence at SEQ ID NO 20183
atgaggggcctgcaggaggagttccggggcggcgtgcaggtgcagccgccggcgtcgtcgcacggcggcggcggcggcggcagcgacggtcgcgcgctgtcgtggtggtcgggcgaccccgaggcgaagcgccggcggagggtggccgggtacaagtcgtacgccgtggaggcaagggtcaaggcgtccatccgcaagggcttccgatggatcaaggaccgctgcaccggcctcgcactacctaggtacgctcgtggaactgactgtgaaaatgaagaaaaaactgaaaaaagaagaagagaaaataacaagaagaaattgagccaactcattgggctattcgtcaacacaagaaagcgggaaaaccagctgttgggccgtgggccgtcgtcctgttgctgcggaaggtttccgactgatcggacgcgaaagatcgcaacgttcaggcaggcctctcaaggcaacctcgtcggtgttcgatccgccgtcgccgccgcgctacgccagttgcccaggtcttcttcggtgccttctccggcgacaagcaaccgccagattatcttttttggccaacagaagtctgactgttacagaaccacagataatgctatttcagcagcacttctatcacaatatggttgtgttactgtagatattaccatggcagcgatgaatagtgatttgggaggcttaggtggcaggcctgcaaacccacaagcaaatccttttggaactgccttgcatggtgctggatcaggattgatccgtactggactagaagcatacggggggaggattatagattcaagttctgaatttatgcagagcaatataacacaatatttatccaaccctcagtactactttcaagtcaacagccagtatgtgaggaacaaactgaaggtcatcttgttccctttcttgcacaggggtcactggacaagaataactgaaccggtaggaggaaggctatcctacaaacctccagtccaggatatcaatgcaccagacttgtacatccccttgatggcatttggcacctacattatagttgctgggtatgctttgggtgttcttggaaggtttacccctgaggcgctgaccctacagttctctaaagggatacttggctggtttctgcaagtcatgctcatcaaaggtctgctgtactccctgggcagcagtgaggctccattgctggacgtagtggcatacgctggatatggtttcgccggcacttcccttgcgatgctagcccgcatcttctggagctacctgtactacttcatcatgccatggttctgcatctgcacgggagtcttccttgtgaagaccatgaagagggttcttctgggcgggccaaggagctacgagaggcaccccagccggaaccactacttcctgctcttcttggcggctgtgcagttccctatgctgttctggctcagcaacatcagcggctga

SEQ ID NO: 20183 - protein, 487 aa, Sorghum bicolor
  misc_feature: Ceres ANNOT ID no. 8631762
  misc_feature: Up-regulated in shoot tissues in response to methyl jasmonate treatment
  misc_feature: Up-regulated in root tissues in response to methyl jasmonate treatment
  misc_feature (254)..(483): Pfam ID: YIF1 Pfam Description: YIF1
MRGLQEEFRGGVQVQPPASSHGGGGGGSDGRALSWWSGDPEAKRRRRVAGYKSYAVEARVKASIRKGFRWIKDRCTGLALPRYARGTDCENEEKTEKRRRENNKKKLSQLIGLFVNTRKRENQLLGRGPSSCCCGRFPTDRTRKIATFRQASQGNLVGVRSAVAAALRQLPRSSSVPSPATSNRQIIFFGQQKSDCYRTTDNAISAALLSQYGCVTVDITMAAMNSDLGGLGGRPANPQANPFGTALHGAGSGLIRTGLEAYGGRIIDSSSEFMQSNITQYLSNPQYYFQVNSQYVRNKLKVILFPFLHRGHWTRITEPVGGRLSYKPPVQDINAPDLYIPLMAFGTYIIVAGYALGVLGRFTPEALTLQFSKGILGWFLQVMLIKGLLYSLGSSEAPLLDVVAYAGYGFAGTSLAMLARIFWSYLYYFIMPWFCICTGVFLVKTMKRVLLGGPRSYERHPSRNHYFLLFLAAVQFPMLFWLSNISG

SEQ ID NO: 20184 - DNA, 1836 bp, Sorghum bicolor
  misc_feature: Ceres ANNOT ID no. 8631926
  misc_feature: Down-regulated in shoot tissues in response to salicylic acid treatment
  misc_feature: Encodes the peptide sequence at SEQ ID NO 20185
atggcgccggtcgatccccactcctacaccgacggcgcgcacccggtggtgtcgcgcgccgcgctcgccttctacctcgacttcgccgcctccaccatacacgcctccgcgctgctcaccctctccgcgccgcactctggggatctcctcctcgacacccgtgccctcaccgtccactccgcctccaccgatgccgacacgccggagcccatccccttctccctcgccgcggcgcccgacccggtcctcggcacggcgctcaccctcaccctgccccccgacaccacctccttccggctcaccttctccacctcccccgccgcctccgcgctgcagtggctggccccgccgcagaccgcctccgggcagcccttcgtcttctcgcagtgccagtccatccacgcccgctccatcttcccctgccacgacacccccgccgcgcgcatcaccttctcgctcctcctcaacgtgcccgagcagctctccgccgtcgcctccgcgcgccacgtcgcgcgacgggacccgctgccctccgaccaccgcggggcctgcgacgacgagctgtggtgcgcgcccggccgcatcgttgaggagttccagatggagcagtccgtgccgccctacctcttcgcgttcgccgccggcgggattgggtccagggacctcggcccgaggacgcgggtgtacgcggagggaggggacaaggtgctggacgaggcggctagggagttcgcgggggtggaggagatggtcaaggttggggagggcctctttgggccgtatgaatgggagaggttcgatctgctcgtgctgccaccgagcttcccctatggaggcatggagaaccccaggatggtgttcctcacccccacggtcatcaaaggggatgctgcaggggctcaggtcgtggcgcatgagctcgcacatagctggactggcaatctgattactaacaagaccaatgaagatttctggctaaatgagggattcacaacatatgctgagaggaggattgttgaggttgtgcaaggggaggagcgggcagccttaaacatggggattggatggagggggttgaacaggatgatggagaggtttaaggataacatggagttcaccaagttgaagccgaatatggcagggattgaccctgatgatgtgtactctgaagtgccctatgagaaaggtttccagtttctttggagaatcgagcgtgagattggcaggcctgcttttgatgaattcttaaagaagtacattgcaaccttcaagttccaatcaatagatacagagacatttcttgaattcctcaaaaccaatgtacctgggatagaaaaccaaattgaccttaacctgtgggttgaggggaccggtatccctcctgatgccatggaaccagattcagctacttacaaaaagatctgctccttagctgcagaattcaaatctggaaaacttccaagtgaagatgaggtggcaaactggagtgggcaagaatgggaactttacttagaaaatctaccaacagatgttgaagcctcacaggtcactgctcttgacgagcggtacaagctatctgaaagccgtgactacgaggtcaaagtcgcattcctccagctggcgatccccaccgggtgcaagtgctacttcaacgaggttgagaaatgcttgaagcaggtgggaaggatgaagtacctccgcccgctctacagctcactggccaagtgctccagcgaggagaagatgctggcccagaggatcttctccgaggctcaagagttctaccacccaatagctcgcagtgtcgcggagtccattttgtcgaagcatagctaa

SEQ ID NO: 20185 - protein, 611 aa, Sorghum bicolor
  misc_feature: Ceres ANNOT ID no. 8631926
  misc_feature: Down-regulated in shoot tissues in response to salicylic acid treatment
  misc_feature (26)..(598): SWISSPROT Homolog: EC 3.3.2.6 Leukotriene-A(4) hydrolase
  misc_feature (469)..(607): Pfam ID: Leuk-A4-hydro_C Pfam Description: Leukotriene A4 hydrolase, C-terminal
  misc_feature (16)..(396): Pfam ID: Peptidase_M1 Pfam Description: Peptidase family M1
MAPVDPHSYTDGAHPVVSRAALAFYLDFAASTIHASALLTLSAPHSGDLLLDTRALTVHSASTDADTPEPIPFSLAAAPDPVLGTALTLTLPPDTTSFRLTFSTSPAASALQWLAPPQTASGQPFVFSQCQSIHARSIFPCHDTPAARITFSLLLNVPEQLSAVASARHVARRDPLPSDHRGACDDELWCAPGRIVEEFQMEQSVPPYLFAFAAGGIGSRDLGPRTRVYAEGGDKVLDEAAREFAGVEEMVKVGEGLFGPYEWERFDLLVLPPSFPYGGMENPRMVFLTPTVIKGDAAGAQVVAHELAHSWTGNLITNKTNEDFWLNEGFTTYAERRIVEVVQGEERAALNMGIGWRGLNRMMERFKDNMEFTKLKPNMAGIDPDDVYSEVPYEKGFQFLWRIEREIGRPAFDEFLKKYIATFKFQSIDTETFLEFLKTNVPGIENQIDLNLWVEGTGIPPDAMEPDSATYKKICSLAAEFKSGKLPSEDEVANWSGQEWELYLENLPTDVEASQVTALDERYKLSESRDYEVKVAFLQLAIPTGCKCYFNEVEKCLKQVGRMKYLRPLYSSLAKCSSEEKMLAQRIFSEAQEFYHPIARSVAESILSKHS

SEQ ID NO: 20186 - DNA, 1182 bp, Sorghum bicolor
  misc_feature: Ceres ANNOT ID no. 8631951
  misc_feature: Down-regulated in shoot tissues in response to salicylic acid treatment
  misc_feature: Encodes the peptide sequence at SEQ ID NO 20187
atgaaggtcctcgccgtgctggcgctcgtcgccgccgccgcgccgttcctccgcgccgccggccagggcgaggaaggggccgggccgctgccgttcgcggtgggcgcggcgccggcgggctgcgacgtcgcacagggcgagtgggtgcgcgacgacgacgcccgcccgttgtaccaggagtgggagtgcccctacatccagccgcagctgacgtgccaggcgcacggccgccccgacaaggcgtaccagagctggcgctggcagccgcgcggctgctccctgcccagcttcaacgcgacgctgatgctggagatgctgcgtgggaagcggatgctgttcgtgggcgactcgctgaaccgggggcagtacgtgtccctgctgtgcctcctgcaccgtgccatccccgacggcgccaagtcgttcgagacggtggactcgctgagcatcttcagggcgaaggactacgacgccaccatcgagttctactgggcgcccatgctggctgagtccaactccgacgacgccgtggtgcactccgccgacgaccgcctcatccgcggcgcgcccatggacaggcactccagcttctggaagggcgccgacgtcctcgtcttcaactcatacctctggtgggtcgccggggacaagatccagatcctgaggggcgccgacaatgacccgagcaaggacatcgtggagatgaaatcggaggaggcctacaggctggtgctgtaccaggtggtccggtggctggagcgcaacgtggacgccaagaagtcgcgggtgttcttcgtcaccgcgtcgccaacgcacacagagggcaaggcgtggggcgacaagaaggagggcgccaattgctacggccagacgtcgccgatcagcgacggcgcctcctcgtacagggacagcacgagccgggagatgcagcgggtgacggaggaggtgctggccacgtcgcgggtgcccgtcgggctcgtcaacatcacgcggctgtccgagtaccgccgggacgcgcacacgcagacctacaagaagcagtgggcggagccgacggcggagcagcgcgccgaccccaggagctacgccgactgcacgcactggtgtcttcccggcgtgccggatacgtggaacgagctgctgtactggaagctcttcttccctagcaacgatcagttcctctga

SEQ ID NO: 20187 - protein, 393 aa, Sorghum bicolor
  misc_feature: Ceres ANNOT ID no. 8631951
  misc_feature: Down-regulated in shoot tissues in response to salicylic acid treatment
MKVLAVLALVAAAAPFLRAAGQGEEGAGPLPFAVGAAPAGCDVAQGEWVRDDDARPLYQEWECPYIQPQLTCQAHGRPDKAYQSWRWQPRGCSLPSFNATLMLEMLRGKRMLFVGDSLNRGQYVSLLCLLHRAIPDGAKSFETVDSLSIFRAKDYDATIEFYWAPMLAESNSDDAVVHSADDRLIRGAPMDRHSSFWKGADVLVFNSYLWWVAGDKIQILRGADNDPSKDIVEMKSEEAYRLVLYQVVRWLERNVDAKKSRVFFVTASPTHTEGKAWGDKKEGANCYGQTSPISDGASSYRDSTSREMQRVTEEVLATSRVPVGLVNITRLSEYRRDAHTQTYKKQWAEPTAEQRADPRSYADCTHWCLPGVPDTWNELLYWKLFFPSNDQFL

SEQ ID NO: 20188 - DNA, 6219 bp, Sorghum bicolor
  misc_feature: Ceres ANNOT ID no. 8631958
  misc_feature: Up-regulated in root tissues in response to aminocyclopropane carboxylic treatment
  misc_feature: Encodes the peptide sequence at SEQ ID NO 20189
atgatacggtaccagatacggaacgagtatgggctggcggatccggagatgtacgcgggccccggggaaggggaggaggatgacccggaggcgctcctcgagggcgtcgccatggccggactcgtcggcatgctccgccagctcggggatctcgcggagtttgcagctgaaatttttcatgaccttcatgaagaggttatggctactgcttccagaggacatggtttaatgctccggttgcagcaattagaggcagaatttccagcagttgaaaaggctatcatatctcagactgagcactcaaattaccctcacgatgatggaactgagtggcatgctaatcttcaacttaatcagaatgtgatcacacaaggagatatgcctcgtttcattatggattcatatgaagaatgccgtggcccaccacaattgttcacgttggataagtttgatgttgctggtgctggagcctccttaaaacgatattcagacccctctttcttcaagacagaacatacctccaacatgatagaaacagatgttttaattgaaaagaaacctcgtagaattaagaagaaggccatgcgatggaggaaaggggcaactcttgaatcattactcactgcaaactctgagcctcacatcacccccaaggatcgaacttctagaaaagttccacctagaacaacaaagttgaaatccaggcaaccactgactcctgatcataaaactactagcagaatctggcaggagcatctgcaagaagtaatttcatcgcagcaaaaaatcatctccagatattcggcgaggcattaccatgtgaaatttagatctactgactcaagtgaaactgcatctccttttggagaaatggacaattttggtgcccttcaatcttctgataaattggatctgacaaaagttgttccagtaaacgaatctgatgacgtggagactaaatctgaacccactgatggaccagcttacttggagcttggggataatcgaattctggggaaacaacatgaaccttttcaacaaaatggcatggtccatggctcagaaaaggtgcaggattgtccaaacttggatgttggagaaagtaataacagatcacatttgacatatgaagagaaacccctattggctggggttcctgctgatcagaaagatattgatggccgcagggctgatgacattgtgagtgatcaagacaacttcatcgatgcttgtaatgacatggacttggaagatgaagaagatcctgaaatggaaactgaatgtgatcccagtgccagcgttgaactggttgaattgaaccgtcacaacaaggaaggtgaaaatgcattgtatgcagaacctccagaagtagttcctgcaatagactcctcaacagagttggacgattcaagcagtggtggagaaccaacctgcatggacttgccacttgcaagtgattctgctcccacagtgtcagccactaatggtccaaactctggttcacaatctggcagacaattgaatggtgttgactggcccaaagatgaagagccttctaatgatgtggatctaatggatgtgagctcatcatctagtgtagtttctgaaaatggcgatgcacaaaacaatgaggaagcttttcactctttgagtgacgatcatgctgctgctatccataattcggataaacagtcacccgatacatctagctacttggatgatatggctatcggctgcaacaattacaccgataaagcacgtcatccagtggagcatgtccaggatgttgtactggatgatatttctatggtattgagcaaacctaatgatgtttcagaagacgaagataaaatcagttctgggagtgctgatgatttgtctctccaccctaccaaaccaaaccaagaggaaatgcaggagttgaagaaagaatttgatgaaggcagatctctagaatcaggaagttcacctagcaaacttgcatcgctgcccgataaggatcatgttatgtggatgaatgatgtagaagtcgacaatgttacagttcctaaagaaaccccatcaggtttggatcctgatggcatccacgagcgtcaagatggaatttcaccaaaacattcaagcatccacaataatgtactgtatgaatcatatgatgatgagattgctgaagacatgcactctttactagatgatggcctatcaactactttcagtaagcatgttgcagagaaccatcaaattgttgtgcttgaacaaaggacttgtccaactagcctcaacacatgcaaggatgattctatgcaagcatgtgccgtggccagggatttcactgatgctcagaagcttccaggagtcatttcaggtgtatcagcttctcaagaggagacagaatctcatgtaggagagacacttgcacccacgtcctgtgcatttagcgatgatactgaagcactagagattggtgtccctctagcccctagtacttcctttctacctaacaccagtagttcctttgtagaccaacatgaatcgactgaaatggaagaaattccagaggttgaagaatcaactactagtggatttgcaaatgatgtggtacctcccaaagagttcattgattctaacatacatcctgaaaaggcagaggttctggctacaaattcaacggaagaagccactaggctggatttgcaactacagtctccttcgagggaagatttggaaacaatggaacctattcacagaaatcttggggcagtagatgactcaagagaagatatctctaagaagagtatgttgcagacagacaataatcctcctcttattgcagggactacaagtgaaaaatgtagtggcagggatgatggtacacaatttctagtagaatcttattatcaagaggaattactagaagaggccggtcataatgctgaagatctctctctatgcgatttgaacaaggatggtgcagtaaccctgcaaagtaacacagttgggaaacaaccagtggatgctgatcaagatttggcgtgggggatgcacgctcaagattctagtagtacaaacccgttcctggatcctgcttacttgatgagccatactcaaatttatccatcttccagtatgaactgccaaccatatttccctgaagaagaggatttcctttcagaacttctaatacaacatgacaatatgggtgtaactgctgatgccctttgggaacctgcaactccacctgatgaagcaccattaccatcagaaattatgactgaagatgatttcagatccttctgccatgaatatcatgagatagatttttcatctgtcactgactgttcccacagtcaaccagcctcagattctaacaaaactccaaatgcttttctggtcagagagtcagatcttccatgttataactcagccttgccagtgaagttagacaaggaagcctgtgttcattctaagttctgttctgagtgtgttgaatgttcatgtgctgtggatgcacaaggtactacatcaatgactgtttctggtaaagaagatctcaaggacaagggcgagaaaacaggagtagattcccatttaaaatctcctgagttttccaatgataacagaagtcctgaattaaatatgctctctgttccagtggttatacagcaggaactgcatggcttgtctggagttgattctcgtagtagctcccctttgctgcataaggagaagactagtgaagaatgcttctttcctttaagaaacgacgttgaagtgaaacaagagttggaaatctgtgctgaccttgttccacattcttctattaatgaaaaagtagatggactggatgttactgtaccagtggaaccagtggtccatgcctgtgccttggatgaatatgacaaccaagattttccacgccgttcaactggtgagaagaatgaggcccttcctttgggcaaacctgttctagcgcaggggccagaagtttgtgcctttggtggatttgaatttgatcctctgatcattccatcacattcagttgatgagactaaggacaatcttgaagtcagaatgaacatgatcctccaatcattccatcattctttgagaacttcttttcaagcagaacagaagtcagaatgttgtacgtcaggtgaacatgattctcaaatagttccatttcctttgcatgatgagaagatcgacgaactggatggtcctcttttgagcaatgctgatgaactggatcggggatcaaaagtttgtgttccacatggacatgatgctcaaatcactccatgttcaactgatgaggatatacatgaattagatcaccctcctttgagcagttccgctttagtggatcttgaatcagaagaccatgtctcggatgaccgtgattccaaagtcgctccatgtttggttaaagataagattgatgaatctgtagatgctcaaccaaaccttcttcctggggagctagagcaggaaactcatgcaccccctaaattagactttcaagttgctccacaatcagtgaaggaatctgattgctcaactgaatttgattcccagactgcaccatgttcttcaaatataccagtactagctgacacaacagtgttgacttgtatttctgccatgcctagcagtgacagtgaggaaacgaatcagttgtctcctggtccgccacccactgtacaatttcaaaatgattcctacaaagatcctcaagcaccaccccctctccctcctctccagtggaggcttgggaagcctcgtctaggacttctgagtagaaaaggctgtatgactgagcctgcgagcgtaatagatcctgttttgcaggtatcaagccgagagatggatatcaggctaggtttgcttgatccaacagatagatctatagaaccagtaccctctcaagaaatcaaagaagataaatgtgagagttcttcgatagatcataatgatcaaaatgtagattttggaagattatcggcaagggttgacgtaactgatgttgcaaggactgaacacagaccatccttagaggcttcagaggacattaagcaagaggggcatatttcttcatcagcaacaggagttgacgaacacctggatgctggggtcacatcaacaacagcagatgagaaacatctggatgattctggaatgacagatggaacagctttatactcaccagaacctctgtttccattacctgcatatgaactgcaggaccctaaaccagatactagagaaaatagtgagtatccctgccaaacacatggagctgcatctggagatgataagtcaatggatgcttttggcaacatggaaagcaccccagcaggacatgtttctgaaaataggtgttaccagcaacatcagcatggtgaatcatcctcaaagacttcagaccatgaagagcatattacaaatgcatcagaggacggtgttaagcatcagtctggtacaagtgaggcaccttcagacacagcaaagcattctgcaccaggcaccctgttgaaagggaatggccaagagagtcaaattttacaagaacataatgtggggagctccgaggacgatcaaccaggaggtccattgtgcagcttagaatcaatggcatctcaagattatccacatgatgaatacaatttagagagggaaaacagaaaccaggctagcaacccaggccctttactggaacggcctggtgataaaagtgagttggtcactggccttgatgaaggttgctatgtgcatgctgagcagccacctgtgatgggatggactgttggacctcagatgcttcatcctaaatatggtgttttagtagaagagagccaatttgagtcaaatattgccgacaatcatttaaccaggaagcctatttccataaaaaacattccaaggaatccactcgttgacgctgttgctgctcacgacagaagctcgatgagaaaggtttcagagcttgcaccatcaactgacaagctgaagcctaatgagagaaacatgttgctagaacagataagaagcaagaccttcagcttgaaaccggttgctcctgctaagccaacagccatgagatcacctgctagaaccagtactagaaacttgaaggttgccgctatcatagaaaaggcaaatgccatccgacaggcagtgggaagtgacgatgaagacgcagatagttggagtgatacataa

SEQ ID NO: 20189 - protein, 2072 aa, Sorghum bicolor
  misc_feature: Ceres ANNOT ID no. 8631958
  misc_feature: Up-regulated in root tissues in response to aminocyclopropane carboxylic treatment
  misc_feature (1477)..(1840): SWISSPROT Homolog: EC 3.2.1.11 Dextranase
MIRYQIRNEYGLADPEMYAGPGEGEEDDPEALLEGVAMAGLVGMLRQLGDLAEFAAEIFHDLHEEVMATASRGHGLMLRLQQLEAEFPAVEKAIISQTEHSNYPHDDGTEWHANLQLNQNVITQGDMPRFIMDSYEECRGPPQLFTLDKFDVAGAGASLKRYSDPSFFKTEHTSNMIETDVLIEKKPRRIKKKAMRWRKGATLESLLTANSEPHITPKDRTSRKVPPRTTKLKSRQPLTPDHKTTSRIWQEHLQEVISSQQKIISRYSARHYHVKFRSTDSSETASPFGEMDNFGALQSSDKLDLTKVVPVNESDDVETKSEPTDGPAYLELGDNRILGKQHEPFQQNGMVHGSEKVQDCPNLDVGESNNRSHLTYEEKPLLAGVPADQKDIDGRRADDIVSDQDNFIDACNDMDLEDEEDPEMETECDPSASVELVELNRHNKEGENALYAEPPEVVPAIDSSTELDDSSSGGEPTCMDLPLASDSAPTVSATNGPNSGSQSGRQLNGVDWPKDEEPSNDVDLMDVSSSSSVVSENGDAQNNEEAFHSLSDDHAAAIHNSDKQSPDTSSYLDDMAIGCNNYTDKARHPVEHVQDVVLDDISMVLSKPNDVSEDEDKISSGSADDLSLHPTKPNQEEMQELKKEFDEGRSLESGSSPSKLASLPDKDHVMWMNDVEVDNVTVPKETPSGLDPDGIHERQDGISPKHSSIHNNVLYESYDDEIAEDMHSLLDDGLSTTFSKHVAENHQIVVLEQRTCPTSLNTCKDDSMQACAVARDFTDAQKLPGVISGVSASQEETESHVGETLAPTSCAFSDDTEALEIGVPLAPSTSFLPNTSSSFVDQHESTEMEEIPEVEESTTSGFANDVVPPKEFIDSNIHPEKAEVLATNSTEEATRLDLQLQSPSREDLETMEPIHRNLGAVDDSREDISKKSMLQTDNNPPLIAGTTSEKCSGRDDGTQFLVESYYQEELLEEAGHNAEDLSLCDLNKDGAVTLQSNTVGKQPVDADQDLAWGMHAQDSSSTNPFLDPAYLMSHTQIYPSSSMNCQPYFPEEEDFLSELLIQHDNMGVTADALWEPATPPDEAPLPSEIMTEDDFRSFCHEYHEIDFSSVTDCSHSQPASDSNKTPNAFLVRESDLPCYNSALPVKLDKEACVHSKFCSECVECSCAVDAQGTTSMTVSGKEDLKDKGEKTGVDSHLKSPEFSNDNRSPELNMLSVPVVIQQELHGLSGVDSRSSSPLLHKEKTSEECFFPLRNDVEVKQELEICADLVPHSSINEKVDGLDVTVPVEPVVHACALDEYDNQDFPRRSTGEKNEALPLGKPVLAQGPEVCAFGGFEFDPLIIPSHSVDETKDNLEVRMNMILQSFHHSLRTSFQAEQKSECCTSGEHDSQIVPFPLHDEKIDELDGPLLSNADELDRGSKVCVPHGHDAQITPCSTDEDIHELDHPPLSSSALVDLESEDHVSDDRDSKVAPCLVKDKIDESVDAQPNLLPGELEQETHAPPKLDFQVAPQSVKESDCSTEFDSQTAPCSSNIPVLADTTVLTCISAMPSSDSEETNQLSPGPPPTVQFQNDSYKDPQAPPPLPPLQWRLGKPRLGLLSRKGCMTEPASVIDPVLQVSSREMDIRLGLLDPTDRSIEPVPSQEIKEDKCESSSIDHNDQNVDFGRLSARVDVTDVARTEHRPSLEASEDIKQEGHISSSATGVDEHLDAGVTSTTADEKHLDDSGMTDGTALYSPEPLFPLPAYELQDPKPDTRENSEYPCQTHGAASGDDKSMDAFGNMESTPAGHVSENRCYQQHQHGESSSKTSDHEEHITNASEDGVKHQSGTSEAPSDTAKHSAPGTLLKGNGQESQILQEHNVGSSEDDQPGGPLCSLESMASQDYPHDEYNLERENRNQASNPGPLLERPGDKSELVTGLDEGCYVHAEQPPVMGWTVGPQMLHPKYGVLVEESQFESNIADNHLTRKPISIKNIPRNPLVDAVAAHDRSSMRKVSELAPSTDKLKPNERNMLLEQIRSKTFSLKPVAPAKPTAMRSPARTSTRNLKVAAIIEKANAIRQAVGSDDEDADSWSDT

SEQ ID NO: 20190 - DNA, 2241 bp, Sorghum bicolor
  misc_feature: Ceres ANNOT ID no. 8632001
  misc_feature: Down-regulated in shoot tissues in response to aminocyclopropane carboxylic treatment
  misc_feature: Down-regulated in shoot tissues in response to salicylic acid treatment
  misc_feature: Encodes the peptide sequence at SEQ ID NO 20191
atggcgacggccaccgcgctctccacctcactcccgcacctcccgccccgccgtgccgcctcatttccctccgccgccgccgtttccctccccgtctcctcccgcgccgcccggctgcgggaatcccgcctcgcggccgcggcacccgcggcctccgaggtcctcgagtccaccaacggcgccatccccaccgcggccaagggcggcgcggggcgtgggtacgggagggagtacttccccctggctgccgtcgtcgggcaggatgctatcaaaaccgctctgctgcttggggcgattgatcgtgagattggaggcattgccatctcagggaagcgtgggacggcaaagacggtgatggctcgtggcttgcatgctatgcttccacctattgaagtggttgttggctccattgcaaatgctgatcctagctccccagacgaatgggaggatggtttagctgatcaaatacagtatgactctgatggtaatgtcaaaactgagattgtgaaaacaccttttgtgcagattccacttggtgtgacagaggataggctcattggatcagttgatgttgaagcatctgtgagatcagggactactgtatttcaacctggtcttcttgctgaagcacatagaggtgttctttatgttgatgagataaatctattggatgatggcataagcaatctacttttgaatgtcttgacggagggagttaacattgtggaaagagagggcattagctttcgccatccctgcaaaccacttctaattgctacttacaacccagaggaaggatctgtgcgtgaacacttgcttgatcgtattgcaattaatttaagtgctgaccttccaatgagttttgatgaccgtgttgcagcagtggatattgcaacacggtttcaggagtctagcaaagaagttttcaaaatggtggaagaagaaactgaaactgcaaaaactcagataattttggcaagagagtatctgaaggatgttaacattagcacagagcagctcaaatatcttgtcatggaagctatacgaggtggctgtcaggggcatcgtgctgagttgtatgctgctcgagttgcaaaatgccttgctgctatggaaggacgtgaaaaagtagagctagtcattctacctcgctcgatcctatctgataacccacaggatcagcagcaagagcaaccacccccacccccgccgccaccacctccagaaaatcaagattcctcagaagaccaagacgaggaagacgatgaccaagaggatgatgatgaagaaaatgaacaacaagaccagcagatacctgaggagttcatctttgatgctgaaggtggtttagtagatgataaactccttttctttgctcagcaagcacaaagacgacgtggaaaagctgggcgagcaaagaatgtcatcttctcagaagataggggccgttacataaagcctatgcttccaaagggtccagtaaggaggttagctgttgatgccacgcttagagcagctgcaccataccaaaaactgcgcagagagaaagaacgtgacaaggcaagaaaggtttttgttgaaaagactgacatgagagccaaaagaatggctcgaaaagcaggtgctctagtcatatttgttgtggacgctagtggtagcatggctctgaatcgtatgcagaacgcgaaaggtgcggcattgaagttgcttgcagaaagctacaccagcagagatcaggtttcaattattccttttcgtggagattatgctgaggttttacttccaccatcaagatctatagcaatggcccggaaacgtcttgagaagctaccatgtggtggtggttctcctttagctcatggcctcagtacagctgtcagagtgggtttgaatgctgaaaagagtggcgatgtcgggcgtatcatgattgttgcaatcaccgatggaagagctaatgtatcactgaagagatccactgatccagaagctgctgctgcttcagatgcaccaagaccttcgtctcaagaactaaaggatgagatacttgaggtggctggcaaaatatacaaggcaggaatgtcccttcttgtcatcgacactgagaacaagtttgtatccacgggatttgccaaggaaattgcaagggttgcccaagggaaatattattatctgcccaatgcttcagatgctgtgatttctgctgccaccaagaccgctctgactgacttgaagagctcgtga

SEQ ID NO: 20191 - protein, 746 aa, Sorghum bicolor
  misc_feature: Ceres ANNOT ID no. 8632001
  misc_feature: Down-regulated in shoot tissues in response to aminocyclopropane carboxylic treatment
  misc_feature: Down-regulated in shoot tissues in response to salicylic acid treatment
  misc_feature (77)..(387): SWISSPROT Homolog: EC 6.6.1.1 Magnesium chelatase
  misc_feature (81)..(291): Pfam ID: Mg_chelatase Pfam Description: Magnesium chelatase, subunit ChlI
MATATALSTSLPHLPPRRAASFPSAAAVSLPVSSRAARLRESRLAAAAPAASEVLESTNGAIPTAAKGGAGRGYGREYFPLAAVVGQDAIKTALLLGAIDREIGGIAISGKRGTAKTVMARGLHAMLPPIEVVVGSIANADPSSPDEWEDGLADQIQYDSDGNVKTEIVKTPFVQIPLGVTEDRLIGSVDVEASVRSGTTVFQPGLLAEAHRGVLYVDEINLLDDGISNLLLNVLTEGVNIVEREGISFRHPCKPLLIATYNPEEGSVREHLLDRIAINLSADLPMSFDDRVAAVDIATRFQESSKEVFKMVEEETETAKTQIILAREYLKDVNISTEQLKYLVMEAIRGGCQGHRAELYAARVAKCLAAMEGREKVELVILPRSILSDNPQDQQQEQPPPPPPPPPPENQDSSEDQDEEDDDQEDDDEENEQQDQQIPEEFIFDAEGGLVDDKLLFFAQQAQRRRGKAGRAKNVIFSEDRGRYIKPMLPKGPVRRLAVDATLRAAAPYQKLRREKERDKARKVFVEKTDMRAKRMARKAGALVIFVVDASGSMALNRMQNAKGAALKLLAESYTSRDQVSIIPFRGDYAEVLLPPSRSIAMARKRLEKLPCGGGSPLAHGLSTAVRVGLNAEKSGDVGRIMIVAITDGRANVSLKRSTDPEAAAASDAPRPSSQELKDEILEVAGKIYKAGMSLLVIDTENKFVSTGFAKEIARVAQGKYYYLPNASDAVISAATKTALTDLKSS

SEQ ID NO: 20192 - DNA, 7488 bp, Sorghum bicolor
  misc_feature: Ceres ANNOT ID no. 8632114
  misc_feature: Down-regulated in shoot tissues in response to aminocyclopropane carboxylic treatment
  misc_feature: Down-regulated in root tissues in response to aminocyclopropane carboxylic treatment
  misc_feature: Down-regulated in shoot tissues in response to salicylic acid treatment
  misc_feature: Encodes the peptide sequence at SEQ ID NO 20193
atgccgttccccgaccctgccgcggcggcgctgcacgggatgaacccctacggcttcgcccctaaccccttcttcaatagcttcctcttccagaaccccgctgccctagctgcctaccaactccagcagcagcaggcgcaggcgcaggctcaacacttcgcctcccatgcctaccaacaagctcctaccggtaacgccaaccaccggccgaccaaacccgccgccgctgacaaaccagcgccgccgggctcccagccgcagccgcagccgcagccgccgccgccagtgggcaaccagcacgccgtgctcgaccgggcgcaagaggcggcgaggaaggctcgggaggagctcgtgaagggcggggagggcgtcacggcgtggaaggtggcgcaggcggtgctggtggcgctcaaggctgactcatgggactccctcggcgtccagccccaggatgtgcctctcctgcgggacctcttcctaatcgagggcaaggtgaatgcattcatacattgctatgttgcagcaagaaaaattgtaacggtttatgatctggaggttgagatatgcaagaatgagggggttgtgcaatttgaagagctgggtttgggacctttccttcagcacccactagttgcacattattttttagtgccagatgatttgtctgtggtgcctaagctttctagtgaggaggttatcaatgtcctgctgaaatttgtggacaaatctaagaaaaaaatcacaattgtagatttcttgaatcatcttgcagagaaaaaatcagtctctgggaaggaaaaacttggtgtgcgggccaagcaaacagaaacgtctgctgcaaagcttctaggaaatatgagtggatctggtaatagtagtcgggagaaggatttgttgaaaaatgcaagtttccgtactcacaagaaggctttggacaagaggttcatttctttaactaatcgtataaagcagttaccaggcatcaataagcatatccattttgattcaaccgatgatgaaactaatggtgatacgagttctgaggatggtaaatctgatgacaatgagaataagaatgaatattctgttcttgacaaaaaggatggtgataagcgtgttaatagctgcccatatccgtcaaaaactgaagaactggaaaggcttggtttgaaatctgaaattaataaaaggccatccttagagaatagcaagccaaaagagagcagaaaaaaggggaaagtaagtgaaaaaagaaaatttgaagaaatcaggagtcctagctgttcgtgcaagcagcctaagaagcagcaaaagttgcaaaagcatgaagcatcaccgaattgtttcctaagtattggtaagctggagaattttgtaacaacatggaaggaaacatgtcgtgagcatccagttcaacaggttctggaaatgttagcaaattactatggaagaacaccaacagagaagaagggaataataaatttctgctcacagtacccaggcattggccttctcaatgttgctgttaaatcaatgggatgtggtctgctggatagcatttatgatgtgatacagcttgctagtgagaataatgtatcatcaagccctcttccgaacaccaccaccgaggttatggaaatcgagcctccaagtgttgctattgacgatgtcatcaggaggataacggaatatattgaatctaacagtaaagtctcaggtgatgtgactatgcaagtgagggcacttaatgattgtgaaacatgggtaactactcaattttcagcaaatcaattcagtgctcttggccatgggacattccttgagtttttggacaaacattgtcatcagttccgaactgctttgagtagtttcttgaaggagggtacttgtaacccttcatctctggaagtttctgtactgcagcagcaaattgaatttttactctatcaagctgagagtaattggctggaagatggtgggttttcagaggatagtttcgttatgcttcttaaaaggcaatttccaacaataagctttaatatcgtgcaagataaatctggtgaaggagttcctggctttatcgaggggcagaagaaagacatacaaacaaatagtttaaaattttccatctctttgttggagaaacggtggtctggaactttgccaaatggtaggtttattagagtagattcatcagccacagttgatcagtttctggaagctattatccaacgctcaccatttcaagtggcagtgaaactgctttcactgctatacgtttacaatggttctacgagcaccccaatgtcattgctaaaatgttatgcacagcgagcaataaagctcatagtagataacaacaatgatttgatgaatgctaaatctgaaaacaaaatatttatgcctgacgagtctgaaagcttgccaaactttgataacactgttcatttgatcgcaaaatttgtacttgattgtcttggccatctacctctggaattccgtagtcttgcagcagacatactattggcaggatttcgggttgttactaagaactggcatgcagttatgttgcatgaagccactgaaaacgggcagctttgcatgcttcatgatattggcttgtcacttggagttgtagaatgggttgaagattgccgtaggttgtgtttaactgaagaagttcatgtgcagacagaaatgcattcttctgccaagcttgcatctgagggagccacacatgaaaattctaacgggcatatttctagtgatgttaatatgatgggtgagagaagacaattgtttcctggcataaatgatcgggttggtatggataatgaagacaataataataagatgttaaatcctgctggaactgaggcagatattgcagaactacatactagcagatcttccatgatggaagaaacaaatcttgaggaagcatctcttgttattgagactatacgtcgtgaagagtttggtctggatcaggcactaagtgacactgagaatagcttgttaaagaagcagcatgctcgacttggcagagcattgcattgcctttcacaagaactatattcccaggattctcatctacttcttgagctggtacagaatgctgacgacaatacatatcctaaggatgttgaaccaacattagcattcgttctccaagagaatggtattgctgttctaaacaatgagaggggcttctctgctgagaacattagagcactctgtgatattggtaactcgacaaagaaaggatcaaaccagggttatattggaaataaaggcattggatttaaatcagttttccgggtaactgatgctccggagatccattcaaatggtttccatgtgaaatttgatatcacagatggccagattggttttgtgttgccaactgcagttccaccttacagtaccacttcttttagcagaatgttagccgttgaagatgacaaggatgcccatccgttgtggaacacttgcattttacttcccttcagatcaaaatttagggagggcactggtatgtgctccattgtgtctttgttttcagatctgcacccatctctactgctgttccttcatcgactaaaatgtatcaagtttaagaatttgtttgatgacacacttctgattatgagaagggaggttcttggtgatggcattgtgagaatctcgcatgggattgagacaatgagttggttggtggtcagtaagaggttacaaggtaccattgtgcggcatgatgtgtgcaccacagagatagctgtggcatttactttgcagcagactgagaaaggagattatgaaccttacttgaagcagcaacctgtgtttgcttttcttcctctaaggaattacggtcttaaattcattattcaaggagattttgttttaccatcttccagagaggaagtggatgcggatagtgcatggaatcagtggttgttgtctgaattcccttctttgtttgtctgtgcccaagaatccttttgtgctcttccctgttttgagaggtgccctggaaaagctgtcacagccttcttgagttttattcctctagcaggagaggttcatggattcttcagccagcttcctcacttgatcctttccaagttgcgtgtgacctgctgcatgtttttggatggctctactgtgcaatgggtctatccatgcaatacgcttaggggttgggatgaacaaactaaaatgctattgtccgaaggcttacttcatgaacatcttggtcttggttacctctcaaaagatattattatatctgataatttatcaagggccctaggtattcatgactatggaccaaacattttgctagataccatctcatctatttgccgaattgatggttgtattgagtcactgggcctggaatggctgtgtgcttggtttgttaacctttatctgacgttgctgtctcattctcgaaatgtttcctcagcaagaagccttgaagatgctcttttggataaagttaggaaaataccatgcatcccactttcagatggttcatttagctctgtttcagatggtcctatatggttgccatatgatgttgtcagttccattcctgaatgcagaagtagcattgagaattttcctgttctatatggtaatcttcgaactgtaagtccaaatcttctctctgcatgctgcaaaaataaatacctcatggaggaagtcagaatagatgatctggcagacatgctccaaaagattggggtgcgaaagttgtctgggcatgacattattaaaaaccacatcatggtgtccttgcgtaacggtttagatgctaatgtgactgatagaatgattagagagtatgtagtgaaagttgaaaaaagtttatcccaagttgattctcttctggcaggaggcctttctctagctgatgtatctgcaaaaccctgtaccgtgtatgactgggagtcaccagaattatctagaattttatcaatattttcttcaaaaagatgcagggaaaattgtgtatatcttctggaggttcttgatagattctgggatgattattatagtccaaaatctatgatcctcacagatgctacacattgtggtgaaaacagagcagttgaatcatcgtttatgaagtgcattcaaagcttcaaatggatagcatcaagaatggatgaggatcttcattatccaacagatttattctatgattctgaaaatgtccgctctctttttggtagtgtggctccatatgctgtaccgcaggtatctagcagttcacttaagaaggccattggattcaaaacagaggtatcctactgtgatgcattgatggtcctgaagtattggataacgtcaaaggttccctttagggcaagcatgagccagatgtgcaaattctatacctttttgtcagaaggtgtggcggactcaaagattgacattaaacgggagttcatgtcatctccctctatatttacaccactacagcgtcctcgggcaagtgaggttattcctggaagttttttggcgccagaagacctctattggcatgacccaacaggatgctttgaaataacagaggatttcattgcaacgagaaacagaagcatgttcccaagaagaatgctatctgcagcctatccaaacctttgtgaattatttactctgacatgtggtgtaccaaaggctccaacaacatcaaattatgttgagatgctgctacggctgtcaaccatagcattgccttcacaggcagcaaaccatgtcttttgtgtatttgtgagatgggctaagtatctgcagtctgaaagtgacaagatgaatgatatattgtacttgaaagaatctcttcagaaattagaaacaacaatattgcccacctcagccgataaatgggtctctctacatccttcttttggccttgtttgctgggtagatgatgatgagttgaagcaacagtttattaactctagtaatgtttacttcatacaatttggtgacctttcttctgaggataagcaaatgctgtatggaagagttgctgctttgatgaaaagcttaggcatccaagcactttcgaaggttgtgtatcgtgaagcaatattttatggtacatcagagaacagagaaaaggtttccttgatttgttggcttttgccatacatgcaacggtacatctataaaatgcatagagatacttatatcaacttccagaaaaacgacatcatgaagattaccaatctgcaagtagtagttgttgacaagttatttcacaagtatgtactaaggggacttgagagttcttctaagaaaagattcaaatgtcattgccttttgcagggagatacgctatacgcaacacaagatgctgattcacattcagtatttttggagctttctagaattttctttgatggatcccctgatctgcattttgcaaattttctacacatgatcaaaaccatggcagaatctggcacccatgctgagcaaatagagtcttttatcgttaataatcagaatgttcctgagttacctaaacatgaagctgtctggtccttctcttccttgtctgcagtcgaccaaggttcagccaaccaaggtggtgctgatacccagggggttgatttccaacctgtccgtgaattcagtgctccaaatcatcagaaggcaccaggaatggtttcaagttggcctcttaaccattggagaacagcacccgtcttcagaacacctctcataaaccagcatgcaagcatgcaagaggcaaaggtcaatgatgctggactttcatcaaacttaaacatgcctggtatgtatggacacaccgaagatagtttgctttctgttgatcttgaaggggattggattatagaagagaagccaaggaccgaaactacattgcttggagatatttcaacggaaatctttgatgagcctcagatggcgatgtctgctgaacctttcaatgcacctgcttatttgaacttggaggaggctggaagttcaagcccaacggtccatgttgagctaacaaatttcgatgagaaactggctaatcttgcagaagacaggaatcagcggccatcagatgcaagccagttaagaacagggaggcttggtgaagcactggtcgagaaatattttgccaaacagctaggttccaacaatgttaggtgggtgaacgacaaaattgaaaccggactgccttatgatattgttataacacacccagagggtttcacagagtatgtggaggttaaaacaactgtatcttcaagaaaagattggtttgacgtctcaccaagagaatggcagtttgccttggagaaaggggatttatttagcattgctcgtgtcatgttaggtacaaagaaagcaagtatagaaatgttaaaaaacccacacaagctttataagcagaaagcattgcggcttggtctcctgatatccagacacacaatctcgtcagcagcaacatag

SEQ ID NO: 20193 - protein, 2495 aa, Sorghum bicolor
  misc_feature: Ceres ANNOT ID no. 8632114
  misc_feature: Down-regulated in shoot tissues in response to aminocyclopropane carboxylic treatment
  misc_feature: Down-regulated in root tissues in response to aminocyclopropane carboxylic treatment
  misc_feature: Down-regulated in shoot tissues in response to salicylic acid treatment
MPFPDPAAAALHGMNPYGFAPNPFFNSFLFQNPAALAAYQLQQQQAQAQAQHFASHAYQQAPTGNANHRPTKPAAADKPAPPGSQPQPQPQPPPPVGNQHAVLDRAQEAARKAREELVKGGEGVTAWKVAQAVLVALKADSWDSLGVQPQDVPLLRDLFLIEGKVNAFIHCYVAARKIVTVYDLEVEICKNEGVVQFEELGLGPFLQHPLVAHYFLVPDDLSVVPKLSSEEVINVLLKFVDKSKKKITIVDFLNHLAEKKSVSGKEKLGVRAKQTETSAAKLLGNMSGSGNSSREKDLLKNASFRTHKKALDKRFISLTNRIKQLPGINKHIHFDSTDDETNGDTSSEDGKSDDNENKNEYSVLDKKDGDKRVNSCPYPSKTEELERLGLKSEINKRPSLENSKPKESRKKGKVSEKRKFEEIRSPSCSCKQPKKQQKLQKHEASPNCFLSIGKLENFVTTWKETCREHPVQQVLEMLANYYGRTPTEKKGIINFCSQYPGIGLLNVAVKSMGCGLLDSIYDVIQLASENNVSSSPLPNTTTEVMEIEPPSVAIDDVIRRITEYIESNSKVSGDVTMQVRALNDCETWVTTQFSANQFSALGHGTFLEFLDKHCHQFRTALSSFLKEGTCNPSSLEVSVLQQQIEFLLYQAESNWLEDGGFSEDSFVMLLKRQFPTISFNIVQDKSGEGVPGFIEGQKKDIQTNSLKFSISLLEKRWSGTLPNGRFIRVDSSATVDQFLEAIIQRSPFQVAVKLLSLLYVYNGSTSTPMSLLKCYAQRAIKLIVDNNNDLMNAKSENKIFMPDESESLPNFDNTVHLIAKFVLDCLGHLPLEFRSLAADILLAGFRVVTKNWHAVMLHEATENGQLCMLHDIGLSLGVVEWVEDCRRLCLTEEVHVQTEMHSSAKLASEGATHENSNGHISSDVNMMGERRQLFPGINDRVGMDNEDNNNKMLNPAGTEADIAELHTSRSSMMEETNLEEASLVIETIRREEFGLDQALSDTENSLLKKQHARLGRALHCLSQELYSQDSHLLLELVQNADDNTYPKDVEPTLAFVLQENGIAVLNNERGFSAENIRALCDIGNSTKKGSNQGYIGNKGIGFKSVFRVTDAPEIHSNGFHVKFDITDGQIGFVLPTAVPPYSTTSFSRMLAVEDDKDAHPLWNTCILLPFRSKFREGTGMCSIVSLFSDLHPSLLLFLHRLKCIKFKNLFDDTLLIMRREVLGDGIVRISHGIETMSWLVVSKRLQGTIVRHDVCTTEIAVAFTLQQTEKGDYEPYLKQQPVFAFLPLRNYGLKFIIQGDFVLPSSREEVDADSAWNQWLLSEFPSLFVCAQESFCALPCFERCPGKAVTAFLSFIPLAGEVHGFFSQLPHLILSKLRVTCCMFLDGSTVQWVYPCNTLRGWDEQTKMLLSEGLLHEHLGLGYLSKDIIISDNLSRALGIHDYGPNILLDTISSICRIDGCIESLGLEWLCAWFVNLYLTLLSHSRNVSSARSLEDALLDKVRKIPCIPLSDGSFSSVSDGPIWLPYDVVSSIPECRSSIENFPVLYGNLRTVSPNLLSACCKNKYLMEEVRIDDLADMLQKIGVRKLSGHDIIKNHIMVSLRNGLDANVTDRMIREYVVKVEKSLSQVDSLLAGGLSLADVSAKPCTVYDWESPELSRILSIFSSKRCRENCVYLLEVLDRFWDDYYSPKSMILTDATHCGENRAVESSFMKCIQSFKWIASRMDEDLHYPTDLFYDSENVRSLFGSVAPYAVPQVSSSSLKKAIGFKTEVSYCDALMVLKYWITSKVPFRASMSQMCKFYTFLSEGVADSKIDIKREFMSSPSIFTPLQRPRASEVIPGSFLAPEDLYWHDPTGCFEITEDFIATRNRSMFPRRMLSAAYPNLCELFTLTCGVPKAPTTSNYVEMLLRLSTIALPSQAANHVFCVFVRWAKYLQSESDKMNDILYLKESLQKLETTILPTSADKWVSLHPSFGLVCWVDDDELKQQFINSSNVYFIQFGDLSSEDKQMLYGRVAALMKSLGIQALSKVVYREAIFYGTSENREKVSLICWLLPYMQRYIYKMHRDTYINFQKNDIMKITNLQVVVVDKLFHKYVLRGLESSSKKRFKCHCLLQGDTLYATQDADSHSVFLELSRIFFDGSPDLHFANFLHMIKTMAESGTHAEQIESFIVNNQNVPELPKHEAVWSFSSLSAVDQGSANQGGADTQGVDFQPVREFSAPNHQKAPGMVSSWPLNHWRTAPVFRTPLINQHASMQEAKVNDAGLSSNLNMPGMYGHTEDSLLSVDLEGDWIIEEKPRTETTLLGDISTEIFDEPQMAMSAEPFNAPAYLNLEEAGSSSPTVHVELTNFDEKLANLAEDRNQRPSDASQLRTGRLGEALVEKYFAKQLGSNNVRWVNDKIETGLPYDIVITHPEGFTEYVEVKTTVSSRKDWFDVSPREWQFALEKGDLFSIARVMLGTKKASIEMLKNPHKLYKQKALRLGLLISRHTISSAAT

SEQ ID NO: 20194 - DNA, 885 bp, Sorghum bicolor
  misc_feature: Ceres ANNOT ID no. 8632115
  misc_feature: Down-regulated in shoot tissues in response to salicylic acid treatment
  misc_feature: Encodes the peptide sequence at SEQ ID NO 20195
atgcgggccctcgcgcgcgccgcgtcgctgctccgccgcgccgcggggtccgcgcccactacggtggcgctgcaccacaaccacctgccgcgtggcgtgggcccgtgcctcgcgaagaatccaggtttctttttcaatgggtattctactcttttggctccaccaagtgaagtgctgattccaccagaacttctttctagcaggactgtgtggacaccagatcgggagcttgggcagtacgaagacctggtagctagggtcactaactttcataatgaggacaagggtttcatggttttggatggtgatgtttttgatgttccaattaggaaggatattgttcaccgggtagtaaggtggcagcttgctaaaagacagcaggggacacactcaactaaaactatcagtgaagtgagtggcactggaagaaagccttacaagcaaaaaggaactggaagagcacggcacggcacactgcgtggtccccagttccgcggtggtgcaaccatgcatgggcctaaaccacgaagccatgcaatcaagctgcagaagaaagtacggcgtctggggcttaagattgccttgtctgctcgaactgcagaggggaagctcttggtctttgaggacttggaagtccctagccacaagacaaaaaacattgtgcaatacattagacagatggatgataccaagaaggttctgttggtggatggaggtgacattgataagaagctaaagctggctactcaaaaccttcactatgttaatgtacttccttccattgggctcaatgtctacagtatcctccagcatgacacccttgtaatgactcgggccgctatcaacagaatcgttgagcggatgcatactcccatcaaccggtag

SEQ ID NO: 20195 - protein, 294 aa, Sorghum bicolor
  misc_feature: Ceres ANNOT ID no. 8632115
  misc_feature: Down-regulated in shoot tissues in response to salicylic acid treatment
  misc_feature (97)..(287): Pfam ID: Ribosomal_L4 Pfam Description: Ribosomal protein L4/L1 family
MRALARAASLLRRAAGSAPTTVALHHNHLPRGVGPCLAKNPGFFFNGYSTLLAPPSEVLIPPELLSSRTVWTPDRELGQYEDLVARVTNFHNEDKGFMVLDGDVFDVPIRKDIVHRVVRWQLAKRQQGTHSTKTISEVSGTGRKPYKQKGTGRARHGTLRGPQFRGGATMHGPKPRSHAIKLQKKVRRLGLKIALSARTAEGKLLVFEDLEVPSHKTKNIVQYIRQMDDTKKVLLVDGGDIDKKLKLATQNLHYVNVLPSIGLNVYSILQHDTLVMTRAAINRIVERMHTPINR

SEQ ID NO: 20196 - DNA, 1695 bp, Sorghum bicolor
  misc_feature: Ceres ANNOT ID no. 8632262
  misc_feature: Up-regulated in root tissues in response to salicylic acid treatment
  misc_feature: Encodes the peptide sequence at SEQ ID NO 20197
atggccttcgtcgcgcccgctgccacgctctccctggtggatcccaagagcgaaggcggcaagggcccaaagacgaatgacaaggcgtcgggagggcggaatggtgtgtccaagggtgaggtggtgtctctgaaccctctagcgtcctccacagagccatgggcgcagcaggattacaaggatgctgccatgtactatggtgcctaccctggagcttactactgtggaggttggggtgattattccatctacgtgagccaggatggaggggatgcactttcccctggtgtttatggggacatgtactgctatcctcattatggtattgccgatggtcagatttatggatcacagcattgccagtatccatccacatactaccagccaaagactactgccagcaaaccagtatacaaggctaaaactggcaaatcatctcctttgatacaagaagatgtttctactgtgactactgctgatcagcagcctgtgttgttggattcctccaaaaccactctgaaaagcattgatggtgtaaaaggtctgaagaaggaaactttgcctctgaaaccaaatggctgttttggtaattaccagaatcaaggtagcaaaacagcttacccagggtctggtggccgtacctcttcagaaaagtatctgaaattctcaggtgggagtcctacatcgacggtctctaataataagggcttgcatgggcagaactcttcgatggggctaccatctgctgggttcacgagttcagtgtactctggtagtggaatgtacaacacaaacacttatgcacctagcttttggtatggttctcatgtctatggtcctgggttgtatggtgggtggaatgcgttttcgaatgggaagtacaggccaagaggaaaaacctacggatcttatggttttggcaatgaaaacttggatagtttggatgagttgaagcgtggaccgagaagtagtctgtttaaaaaacaacagggttctggagcagctgttgattccaaaggacaggagcctcccaacagtgatggctctaatgctgttaagcaggaacagtacaaccttgctgatttttgtgaaacctactcagatgccaaattttttattattaaatcatacagtgaggataatgttcacaagagcattaagtacaatgtttgggcaagcacccctagtggaaataaaaagctggatgctgcttatcaagaggctaaggaaaaatcaagcagttgtcctgtgttcctgttgttttctgttaacaccagcggacagtttgttggtctggctgagatggtgggtcaggttgattttaacaagacagttgaatattggcagcaggacaagtgggctggttgctttcctgtcaagtggcacattgtgaaggacattcctaacagctcattgaagcacatcattcttgagtataatgaaaacaaaccagttacaaacagcagagatacgcaggaggttaagcttgaccaaggccttcaggttttaaagattttcaaggatcatgccagcaagacatccatcttggatgactttagcttttatgatgaccgtgaaaagataatgcaggagaagaaatcaaagcatcagcatccagttgaggtcatgaatagaaagttggcagccaccaacattgctgaaaatcaagctactgatgggaagcagagtgtgtag

SEQ ID NO: 20197 - protein, 564 aa, Sorghum bicolor
  misc_feature: Ceres ANNOT ID no. 8632262
  misc_feature: Up-regulated in root tissues in response to salicylic acid treatment
  misc_feature (419)..(509): Pfam ID: YTH Pfam Description: YT521-B-like family
MAFVAPAATLSLVDPKSEGGKGPKTNDKASGGRNGVSKGEVVSLNPLASSTEPWAQQDYKDAAMYYGAYPGAYYCGGWGDYSIYVSQDGGDALSPGVYGDMYCYPHYGIADGQIYGSQHCQYPSTYYQPKTTASKPVYKAKTGKSSPLIQEDVSTVTTADQQPVLLDSSKTTLKSIDGVKGLKKETLPLKPNGCFGNYQNQGSKTAYPGSGGRTSSEKYLKFSGGSPTSTVSNNKGLHGQNSSMGLPSAGFTSSVYSGSGMYNTNTYAPSFWYGSHVYGPGLYGGWNAFSNGKYRPRGKTYGSYGFGNENLDSLDELKRGPRSSLFKKQQGSGAAVDSKGQEPPNSDGSNAVKQEQYNLADFCETYSDAKFFIIKSYSEDNVHKSIKYNVWASTPSGNKKLDAAYQEAKEKSSSCPVFLLFSVNTSGQFVGLAEMVGQVDFNKTVEYWQQDKWAGCFPVKWHIVKDIPNSSLKHIILEYNENKPVTNSRDTQEVKLDQGLQVLKIFKDHASKTSILDDFSFYDDREKIMQEKKSKHQHPVEVMNRKLAATNIAENQATDGKQSV

SEQ ID NO: 20198 - DNA, 1257 bp, Sorghum bicolor
  misc_feature: Ceres ANNOT ID no. 8632335
  misc_feature: Up-regulated in shoot tissues in response to methyl jasmonate treatment
  misc_feature: Up-regulated in root tissues in response to salicylic acid treatment
  misc_feature: Up-regulated in shoot tissues in response to salicylic acid treatment
  misc_feature: Encodes the peptide sequence at SEQ ID NO 20199
atgtttgggcgcgcgccgaagaagagcgacaacacccggtactacgagatcctcggcgtctccaaggacgcctcccaggatgacctcaagaaggcctaccgcaaggccgccatcaagaaccaccccgataagggcggggatcccgagaagttcaaggagctagctcaggcttatgaggtcctcagtgatcctgaaaagcgagagatttatgatcagtatggtgaggatgccctcaaggagggaatgggaggcggtggagggatgcacgatccctttgacatattccagtcattctttggcggtgggagcccttttggaggtggtggcagcagtaggggcagaaggcagcgaaggggagaggatgtggttcatcctctgaaggtttctctggaggatttgtacaatggcacatcaaagaagctctctctgtcccgcaatgttctctgctccaagtgcaatggtaagggctcaaagtctggagcttcgtcgaggtgtgctggttgccaaggttctggctttaaggtccaaatcaggcagttgggacctggaatgattcagcaaatgcagcatccttgcaacgagtgcaagggttctggagagaccatcaacgacaaggacagatgcccacaatgcaagggtgataaagttgtgcaggagaagaaggttcttgaagtggtagtagagaaaggtatgcagaatgggcagaagatcacattccctggtgaagctgacgaagcgcctgacactgtcactggagatatcatctttgttctccagcagaaggagcatcccaagttcaagaggaagggcgatgacctcttctacgagcacaccctgaccttgactgaatctctgtgtggcttccagtttgttttgacacacctggataacaggcagctgctaatcaaatcaaaccctggcgaagttgtgaagcctgattctttcaaggcgatcaacgatgaaggcatgcccatgtaccagaggcccttcatgaagggcaagctgtacatccacttctcggtggatttcccggactcgttgagcctggagcagtgcaaggcgctggaggctgtgctcccacccaagccggtgtcgcagtacactgacatggagctggacgagtgcgaggagacgatgccgtatgacgtgaacatcgaggaggagatgcggaggcggcagcagcagcaccaggaggcatacgacgaggacgaggatatgccgggcggtgcgcagagggtgcagtgcgcccagcagtag

SEQ ID NO: 20199 - protein, 418 aa, Sorghum bicolor
  misc_feature: Ceres ANNOT ID no. 8632335
  misc_feature: Up-regulated in shoot tissues in response to methyl jasmonate treatment
  misc_feature: Up-regulated in root tissues in response to salicylic acid treatment
  misc_feature: Up-regulated in shoot tissues in response to salicylic acid treatment
  misc_feature (136)..(222): Pfam ID: DnaJ_CXXCXGXG Pfam Description: DnaJ central domain (4 repeats)
  misc_feature (13)..(71): Pfam ID: DnaJ Pfam Description: DnaJ domain
  misc_feature (235)..(359): Pfam ID: DnaJ_C Pfam Description: DnaJ C terminal region
MFGRAPKKSDNTRYYEILGVSKDASQDDLKKAYRKAAIKNHPDKGGDPEKFKELAQAYEVLSDPEKREIYDQYGEDALKEGMGGGGGMHDPFDIFQSFFGGGSPFGGGGSSRGRRQRRGEDVVHPLKVSLEDLYNGTSKKLSLSRNVLCSKCNGKGSKSGASSRCAGCQGSGFKVQIRQLGPGMIQQMQHPCNECKGSGETINDKDRCPQCKGDKVVQEKKVLEVVVEKGMQNGQKITFPGEADEAPDTVTGDIIFVLQQKEHPKFKRKGDDLFYEHTLTLTESLCGFQFVLTHLDNRQLLIKSNPGEVVKPDSFKAINDEGMPMYQRPFMKGKLYIHFSVDFPDSLSLEQCKALEAVLPPKPVSQYTDMELDECEETMPYDVNIEEEMRRRQQQHQEAYDEDEDMPGGAQRVQCAQQ

SEQ ID NO: 20200 - DNA, 3708 bp, Sorghum bicolor
  misc_feature: Ceres ANNOT ID no. 8632341
  misc_feature: Down-regulated in root tissues in response to methyl jasmonate treatment
  misc_feature: Encodes the peptide sequence at SEQ ID NO 20201
atggatccgctccggagctacctggggcggctccttctcgaagaaatcacaccggtggtgatggtgctgtccacacctctcgctgaggccacctgccgtaagaacggcctcagcttcgtcgacatgctctccccgttctcgctcttcaaaaaaatcgacgtgcccgtgcggacggcgagcgaggtgccgtacaggctgcaaatgtttaagattcggatggtttacgcgtccgacgtccggaaggaggactgcgaggtggcagacgagaggattaagccggtagtttctgaggccaatgagaaggctcttccggatttgctttcagacccgcctcaagttgaagatgtacttggaaagcctgaggccgagctgtgcccattgtggattaagaagttcaatagagagctaatgcggacactctcattttcggagcatgaaacatttgaccatcccgtggcatgtcttctagttgtgtcatcaatggacaaagaaccagtcaataaatttgttgatctcttcaacacaaatcagttgccatctcttttgaatgaaggcataatggatccacagattttgaagcattaccttgtacttcatgaccagcaagaggggccacaagacatgtattctgaaatgaggagtacccttggtctgaatgactgtaaattattatgcataaattcatctacagaagcaggtggtagtaatgctgagaattcatggctaccttataaagctcttggtttgaacaatcatgacggatcctgtttccttagtgtggatgatctgaatgagataaaggacttcatgcaagattttgtttctaaccatatcatcccctacatggagcaaaagatccgtgtcctcaatcagcaggtagcgcaaacaagaaagggtttcagaaatcagatcaagaacttgtggtggagaaagagagatgatgtcccagaagcttcaaatggaccaatgtatacattcacctccatagaatcacagatcagagtactaggtgatttcgccttcatgttacgagactacgagctcgccttgtcaaactacagattactcgccactgattataagcttgataaggcttggaagcgatttgctggtgtacaggagatgagtggactttgctatttcattttggatcagtcaaggaaggatgcggagtattgcatggaaaatgccttcagtacatatttgagaattggatcttctggccagagaaatgctactagatgtggcctttggtgggctgaaatgcttaaaacaagaggacagtatagggaagcatcaaacgtgtatttccgtgtttctaatgaggaaccttcgttgcattctgctgtactgcttgagcaagccgcttgttgctatctattatccaatccacccatgcttcggaaatacggatttcacctaatcttagctgggaatagctactacatgtctgatcagaaacaacatgctgttcgggtgtacagaaatgctttgtttgtttacaaacaaaacccttggagttacatcaacaatcatgtgcattttaacgttggaaggtggtatggagttctcgggatacttgatgtagccatcaagcacttactggaggtcattgcttgtagccatcagtcgctgactacacaaaacatgttcctcactgattttttccattatgttcagagcatggggaagaaatttgatgtgtacaagcttcagcttcctgttttcaacatgtcatctctcaaagttatatatgaagatcatcgcacttatgcatcagatgcagatgttagcgttagtgaaagcacatggcaggagctggaggaagaattgatcccatcatcatcaattgtcagaactaattggctggatactcagccaatgagaaaatacaaggattcctgtatttgtgtggctggagatgtaagtgggctggacttgggtggtggggaagataaggttaacacagagccatctatttcaatgtttgagactgatggagataagtttacattgtcaaagcttgacatcgtattaggaggaggtgaaagtaaaagagtgcaacttgatgttactccaaaagttgaaggtattctgaagttggttgggataaggtggacactttcagagtcagtagtaggctatcaatactttgaatttgatgcacagaaaaaaatcaagaaagggaaaagaggcccacgtcgttctttgaataacagcctggttgtaatcaagggtttaccaaaacttacaggatctattgatcgcatgccaacaaaagcgtttgctggtgatttaaagctgcttacactaaatctgagaaaccattcagaatatgctgtgaagggcataaaaatgaaacttagcagcccaagatttttaattcctggtgattcattggacattggccttgagttcccagactgcttaaaaaggcatatgcaatcagaaagcagtgtcgtatcatccaaaactatgaaggaaaatttcaagagtttgctctttgcatttcctcaggatattgaaattcaagcaggggcagcactctcttggcctatttggtttcatgctgcaactcctggaaatatttctctttatatttctctgtattacgaaatggggagttccagtgatattaaataccgtacactacgcatgcatttcaaccttgaggttttgccatcacttaatgtatccttttctataagcacgtcctcatcaagattgcgagagtatatcgttcgcatggatgtcatgaacaagactccatcagagtcatttgtgcttcatcagttatcatgtgttggtggtaaatgggcagtttcagcgttgccgtcatgcagttcaatcaactctgttggaacagtatcagaaaatcaggctgtgtcgtacttcttcaaaattaaggattgtgaggcggattcttgtaaagaggcagaaagtggttcctgcacaagcgatatggctttgtgtccagggagcagcactgatctgtttgacattgctcgatctcctttagctgattttcactatcaagaaagatacaggcaagggaaggtagcacagggaccatgcagccttcttgattttgttctaatctcaaaggcagttggtaactcttccaagcctactccagactttgaactactttctcatcacacttgtcattgcagttctctaagccagaaccctatatggtggcttatggaaggaccacggacaattagtcatgatttctcaaagtcttactgtgaggttaacctccaattggtcattcacaattcagaagctcataagattttggtgagagtggttacttttgatgtaatgccagagaaaagccaaactgtccatcctcatgactcaaacagtgctcagggtggatggtatgatgtatcactggaaaatgacgtaaaggccatctctagttccaagagtacacatcaagagaagcaatcttcgaagagcatttcaccatatgtttggtgttcattgagttgtgctcaaactgagctccaacctgacagttgtgctagagttcctctaaaagtgtgcatattcgcaccaggtacatacaatttttccaattatgagctgcaatggaaagtgcatccatctgagggaccacatgtggatgaaaatgagaaattgttatctggtggtggtctagggcatcctttctatgttactgtccttcaaagtgtctaa

SEQ ID NO: 20201 - protein, 1235 aa, Sorghum bicolor
  misc_feature: Ceres ANNOT ID no. 8632341
  misc_feature: Down-regulated in root tissues in response to methyl jasmonate treatment
MDPLRSYLGRLLLEEITPVVMVLSTPLAEATCRKNGLSFVDMLSPFSLFKKIDVPVRTASEVPYRLQMFKIRMVYASDVRKEDCEVADERIKPVVSEANEKALPDLLSDPPQVEDVLGKPEAELCPLWIKKFNRELMRTLSFSEHETFDHPVACLLVVSSMDKEPVNKFVDLFNTNQLPSLLNEGIMDPQILKHYLVLHDQQEGPQDMYSEMRSTLGLNDCKLLCINSSTEAGGSNAENSWLPYKALGLNNHDGSCFLSVDDLNEIKDFMQDFVSNHIIPYMEQKIRVLNQQVAQTRKGFRNQIKNLWWRKRDDVPEASNGPMYTFTSIESQIRVLGDFAFMLRDYELALSNYRLLATDYKLDKAWKRFAGVQEMSGLCYFILDQSRKDAEYCMENAFSTYLRIGSSGQRNATRCGLWWAEMLKTRGQYREASNVYFRVSNEEPSLHSAVLLEQAACCYLLSNPPMLRKYGFHLILAGNSYYMSDQKQHAVRVYRNALFVYKQNPWSYINNHVHFNVGRWYGVLGILDVAIKHLLEVIACSHQSLTTQNMFLTDFFHYVQSMGKKFDVYKLQLPVFNMSSLKVIYEDHRTYASDADVSVSESTWQELEEELIPSSSIVRTNWLDTQPMRKYKDSCICVAGDVSGLDLGGGEDKVNTEPSISMFETDGDKFTLSKLDIVLGGGESKRVQLDVTPKVEGILKLVGIRWTLSESVVGYQYFEFDAQKKIKKGKRGPRRSLNNSLVVIKGLPKLTGSIDRMPTKAFAGDLKLLTLNLRNHSEYAVKGIKMKLSSPRFLIPGDSLDIGLEFPDCLKRHMQSESSVVSSKTMKENFKSLLFAFPQDIEIQAGAALSWPIWFHAATPGNISLYISLYYEMGSSSDIKYRTLRMHFNLEVLPSLNVSFSISTSSSRLREYIVRMDVMNKTPSESFVLHQLSCVGGKWAVSALPSCSSINSVGTVSENQAVSYFFKIKDCEADSCKEAESGSCTSDMALCPGSSTDLFDIARSPLADFHYQERYRQGKVAQGPCSLLDFVLISKAVGNSSKPTPDFELLSHHTCHCSSLSQNPIWWLMEGPRTISHDFSKSYCEVNLQLVIHNSEAHKILVRVVTFDVMPEKSQTVHPHDSNSAQGGWYDVSLENDVKAISSSKSTHQEKQSSKSISPYVWCSLSCAQTELQPDSCARVPLKVCIFAPGTYNFSNYELQWKVHPSEGPHVDENEKLLSGGGLGHPFYVTVLQSV

SEQ ID NO: 20202 - DNA, 690 bp, Sorghum bicolor
  misc_feature: Ceres ANNOT ID no. 8632423
  misc_feature: Down-regulated in shoot tissues in response to methyl jasmonate treatment
  misc_feature: Encodes the peptide sequence at SEQ ID NO 20203
atggccgccctcgccgcctcctccacggccgccttcgccgcgaagccgcgcctccctcgcgcgcgcctctccgtggcctgctccgccaccggcgacggcaacgccaacagcgtgtcgctcgcgtcctccgtgaagacgttctcggcggcgctggcgctgtcgtcggtgcttctctcctcggccgccacctccccaccgcccgcggccgccgacatcgcggggctgaccccgtgcaaggagtccaaggcgttcgcgaagcgggagaagaactcgatcaagaagctcacggcgtcgctgaagaagtacgcgcccgacagcgcccccgcgctcgccatcaacgccaccatcgagaagacgaagaagcggttcgagaactacggcaagttcgggctgctctgcggcgccgacggcctgccgcacctcatcgtcagcggcgaccagcggcactggggcgagttcatcacccccggcctgctcttcctctacatcgccgggtggatcgggtgggtcggcaggagctacctcatcgccatcagcggcgagaagaagcccgccatgagggagatcatcatcgacgtcgagctcgccacccgcctcctccccagggggttcatctggcccgtcgcggcgtaccgcgagctcatcaacggagacctcgtcgtcgacgacaaggacatcggctactactaa

SEQ ID NO: 20203 - protein, 229 aa, Sorghum bicolor
  misc_feature: Ceres ANNOT ID no. 8632423
  misc_feature: Down-regulated in shoot tissues in response to methyl jasmonate treatment
  misc_feature (46)..(224): Pfam ID: PSI_PsaF Pfam Description: Photosystem I reaction centre subunit III
MAALAASSTAAFAAKPRLPRARLSVACSATGDGNANSVSLASSVKTFSAALALSSVLLSSAATSPPPAAADIAGLTPCKESKAFAKREKNSIKKLTASLKKYAPDSAPALAINATIEKTKKRFENYGKFGLLCGADGLPHLIVSGDQRHWGEFITPGLLFLYIAGWIGWVGRSYLIAISGEKKPAMREIIIDVELATRLLPRGFIWPVAAYRELINGDLVVDDKDIGYY

SEQ ID NO: 20204 - DNA, 2880 bp, Sorghum bicolor
  misc_feature: Ceres ANNOT ID no. 8632431
  misc_feature: Up-regulated in root tissues in response to salicylic acid treatment
  misc_feature: Encodes the peptide sequence at SEQ ID NO 20205
atgattacggagaagccaagctggattcgccacgagggcctgcagatcttctccatcgacatccagcccggcggcctccgcttcgccactggcggcggcgaccagaaggttcgaatatggagcatgaaatctgtggataagaataatgccaacaatgattccagccaagggttgctagctacaatgcgtgatcattttggatcagtaaattgtgtgagatgggcaaggcatggtcgctatctggcttctggatcagatgatcaggttatcctaattcatgaacgaaaagctggttctggaacatctgagtttggtagtggggaacctccagatgtagagaattggaaggttgttatgaccttaagagggcatactgcagacgtggtagatcttaattggtcccccgatgattcaacattggctagtggcagcttggataatactgttcacatatggaacatgaccaatggtatgtgcactgccgtcttgagagggcattccagcttggtcaaaggtgttacctgggatcctattggctctttcattgcaagccaatcagatgataagtctgttataatatggcgtacaagcgactggagtcttgctcacaagacagaaggccattgggaaaaatctcttggttcaacattttttaggcgacttgcatggtcaccttgtggccacttcattactacgactcacggcttccagaaacctaggcattcagcccctgtgcttgaaagaggcgagtggtctgctacctttgactttctagggcataacgcacctatcgtggtcgttaagtttaataactcaatgtttcgtaagaatttctcaaatggtcaagacacaaaagctgcaccagctggttgggccaatggaacatcaaagacattatcaaaagaacagctaccatataatgttattgctattggaagtcaggacagaacaattactgtttggacaacagcgagtgcgcggccattgtttgttgctaagcattttttctctcaaagtgtggttgatttatcttggagccctgatggttattcactttttgcatgttccttggatggatctgttgccaactttcactttgaagcaaaggagcttggatacaagttaagtgattctgaactggatgaattgaagaggagtagatatggtgatgtcagaggacgacaatcaaatctggctgaaagccctgcacagttactgctagaagaagcatcagcaaagcaatcagctagcaaaaaggggacttccattgtccagcaatttcaagcacccccaaaagtttcttcagatgtgcctaacccagctcctgttgtgcaaagtaagaaacctgctttgcctgaagctgagaagaaaacatcaggtcctactgctgaagatatgaataaagttactcggttatctagtccagtgaagcagagggaataccggcgtcctgatggccggaaaagaataatcccagaggctgttggatttccttccaaccaggataacatacccagccgttctcagaaccaggttgtggatttttcatccctagatcagcgaatgaatgggataggaccatcttatggtagtaacagtaacagtaacaactctggagttaaggatcgctctggtgttacagcaagggcgaacattacggagagtcttgttattcaaaaagcttcagccagtgctgggagtgatggaatgttgagtgtagaacgcattggatctgttgttccaggctctttgacctgcgcctcactttctatacatgtgttagataagaaagacaatgaggattccttgccagtctgccttgaagcaaagcctgtagaacgcgctgcaggtgatatgattggtgttggtggtgccttttcaacaaaagaaactgagataaggtgtacaagaggaacagaaactctttggttggatcgcatatctgcaaaggttactgtcttggcaggaaatgcaaatttctgggctgttggctgtgaagatggttacctgcaggtttacacaaaatgtggaaggcgagcaatgccggcaatgatgatggggtctgcagccatttttatagactgtgacgactgctggaaattgcttcttgtcacaagaagaggtgtaatgtacatatgggacctctataacaggacctgcattttgcaggactcattggcttctttggttgcatctccagatgagtcgtcagctaatcatgctggtgcagtaaaggttatatccgctaaattctcaagatgtggttttcccttagttgttcttgccagtcgccatacttttctttttgacatgagcatgaagtgctggttaaggattgccgatgattgttttccagcatcaaattttgctagctcatttagttccccccaaggtggagagctaggcaagttgcagattgatctaggcaagttcatggctagaaagcctatatggaacagggttacagatgatggtttgcagacacgtgcccatttagagacccagttggctgcttctttggctttgaagtcaccacaggagtatcgccaatgccttctatcctacgtacggtttctggcaagagaggcagatgaatctcgtttacgtgaggtttgtgagaacttcctaggtcctccgatgggtatgcttggatctgcatcatctatggattccaaaaatccatcgtgggatcctgatgttctcgggatgaagaagcacaaacttctcagggaagacatacttccatcgatggcatcgaaccggaaagtccagcggctgctcaacgagtttatggatctcctatcagagtatgaagctgctaagagcaaagttgacccaatggatgtcacacgggcgccacaaccagcagcaagtcaatga

SEQ ID NO: 20205 - protein, 959 aa, Sorghum bicolor
  misc_feature: Ceres ANNOT ID no. 8632431
  misc_feature: Up-regulated in root tissues in response to salicylic acid treatment
  misc_feature (23)..(194): SWISSPROT Homolog: EC 2.3.1.48 Histone acetyltransferase
  misc_feature (676)..(875): Pfam ID: Hira Pfam Description: TUP1-like enhancer of split
  misc_feature (115)..(153): Pfam ID: WD40 Pfam Description: WD domain, G-beta repeat
  misc_feature (157)..(195): Pfam ID: WD40 Pfam Description: WD domain, G-beta repeat
  misc_feature (56)..(94): Pfam ID: WD40 Pfam Description: WD domain, G-beta repeat
  misc_feature (251)..(322): Pfam ID: WD40 Pfam Description: WD domain, G-beta repeat
MITEKPSWIRHEGLQIFSIDIQPGGLRFATGGGDQKVRIWSMKSVDKNNANNDSSQGLLATMRDHFGSVNCVRWARHGRYLASGSDDQVILIHERKAGSGTSEFGSGEPPDVENWKVVMTLRGHTADVVDLNWSPDDSTLASGSLDNTVHIWNMTNGMCTAVLRGHSSLVKGVTWDPIGSFIASQSDDKSVIIWRTSDWSLAHKTEGHWEKSLGSTFFRRLAWSPCGHFITTTHGFQKPRHSAPVLERGEWSATFDFLGHNAPIVVVKFNNSMFRKNFSNGQDTKAAPAGWANGTSKTLSKEQLPYNVIAIGSQDRTITVWTTASARPLFVAKHFFSQSVVDLSWSPDGYSLFACSLDGSVANFHFEAKELGYKLSDSELDELKRSRYGDVRGRQSNLAESPAQLLLEEASAKQSASKKGTSIVQQFQAPPKVSSDVPNPAPVVQSKKPALPEAEKKTSGPTAEDMNKVTRLSSPVKQREYRRPDGRKRIIPEAVGFPSNQDNIPSRSQNQVVDFSSLDQRMNGIGPSYGSNSNSNNSGVKDRSGVTARANITESLVIQKASASAGSDGMLSVERIGSVVPGSLTCASLSIHVLDKKDNEDSLPVCLEAKPVERAAGDMIGVGGAFSTKETEIRCTRGTETLWLDRISAKVTVLAGNANFWAVGCEDGYLQVYTKCGRRAMPAMMMGSAAIFIDCDDCWKLLLVTRRGVMYIWDLYNRTCILQDSLASLVASPDESSANHAGAVKVISAKFSRCGFPLVVLASRHTFLFDMSMKCWLRIADDCFPASNFASSFSSPQGGELGKLQIDLGKFMARKPIWNRVTDDGLQTRAHLETQLAASLALKSPQEYRQCLLSYVRFLAREADESRLREVCENFLGPPMGMLGSASSMDSKNPSWDPDVLGMKKHKLLREDILPSMASNRKVQRLLNEFMDLLSEYEAAKSKVDPMDVTRAPQPAASQ

SEQ ID NO: 20206 - DNA, 2430 bp, Sorghum bicolor
  misc_feature: Ceres ANNOT ID no. 8632625
  misc_feature: Up-regulated in root tissues in response to salicylic acid treatment
  misc_feature: Encodes the peptide sequence at SEQ ID NO 20207
atgagcaccacccctgtttcaaggttcaggggaccggcctatttgcagctgtgtccccagtctagcgattgtgatgaacttttggtaaatgtggatgggctgagtgcaaaagatttgtcagttgatccaaacacattttgtcttccacaagatgctaatcaggaattctatacccgagctttacagtacagttgttctgtttcagagcagggatttgaagcccaaggtcttctcgtgaatgctgcagagtttggtctaaataatgattcttctgtggtgggaggaggatatcaacaatttgactaccttctggggcctcctcagcctgaagtgtatgaagtgatgcagatgcaaaatatcaacacaaatatcatccaccggcgtagaccttccaatgcatcctgtcttgatcatacagaagaactgacttcctatgacaatgatgacagagctatctcatttggaagtagttgtagcacaggaattgcgagttatccatatagtactcctttgcaaagcaataaccacatttcgagcacacaggatggaacttgggatgcccttatgcaaatgcaaaaagctttggaagcatccaacagtgacaatggactcaatgaagagtgcagtgacttgactttcaaccatgcagaactgtcaggtgggaataccatgaaacatcaagttgtttgggacaatggctctttaaaaagcccatctttcacctcaagttatttgcctttccctggtgatactgagaccaccctcacaagtgcctccactgtttgtagctttcagaactttgctgatctccagcataagatgaataacaatgagcaaaacaaattatcttttgaggtcgaacttcctcgtcagaaagggcccacaagtagccatgttaatggaagccgaggtgaattgcattctgctgaatggggaacaaatcctggtcacatagaatcttctggctttatgccaagcactggagacagacagaacgatatatcacatcaactgtcaagttcattcatacatactccagatggaattgtggataatggctcaaaaaagtcacccatcttgtatgaatgtgaagagcaaatggaaattgattcacttctaaattcatttggtgtatcaactgattccttttcgcaaacatgtggaatgtttgagcaaagcgacaatttggttgagtttggtatgaagatcgagttagatgaaagtggttctgctgcatgctttagtaatactaccccatatatgcaaactggaccaccagagtcagctatatctgatggatcttcttatcctgaacagtatcaatctacttctcaaacatgtggcttttatgcttcagcatctcagtggcaaaatgtgtcaagttctggattgcctttactggactgtcgcaaaagtgttggtgagcccagttcaataattaacctggggggaaatggtaaaggacacctgctagtacagcaaccacagagtgttgctactgatactaggttggaaatggccgacaatgttgctaattgctatctagagttcactggtagcttggatggccaatcttgtctgataggggcttctgtatctcatgatgaagcaatggcagccaaagttttacagacagcacaacctgacatagtcacagattgcacctttggagtaggtacttcaaaccacgctggatgctcagacatgcagctacctgttacacagactacttctgttcaagagcctggcctgagtttgtcaaaggacctcaactcatcctgtggcctgagtttgtcaaaggacctcaattcatcctgtattcaaggaacagagatcaagaaagtatatttaacaggaaaatacaattctgaatgtcatggcatcctccgccccaagtcttttgaacaaaacactcctgagagtatggatattaaaacatacatgtatggttgtgatgattatagccagattgtggatcctcagcagagtaccatactctcagcaagcaaaccttcacactcaagtgttttgccggttgacaagcttgatgacaaggtcatttcacagcaaaaaaagcggaaaagggcagcagaaaagcttttagcatggcatgcacaagtcatgaccatgcatgggagcaggcatcgcagaagaattcctgagttggattgggctcgtgctaccaaaagattgcttgagaaggttgatggtgagaatgcaacaatgggaagtagcagctttagtactcgagctcagaaaagacttattttgacaactagcctgattcagtatattcttcctgttgtaccagctagacttcttgccacaaatgttactgattccgctgaaactatcgtataccacctttctaaatccgcactcagtgatgcatgtggcactgttctgtctgttgggaatgacgacacgtaa

SEQ ID NO: 20207 - protein, 809 aa, Sorghum bicolor
  misc_feature: Ceres ANNOT ID no. 8632625
  misc_feature: Up-regulated in root tissues in response to salicylic acid treatment
MSTTPVSRFRGPAYLQLCPQSSDCDELLVNVDGLSAKDLSVDPNTFCLPQDANQEFYTRALQYSCSVSEQGFEAQGLLVNAAEFGLNNDSSVVGGGYQQFDYLLGPPQPEVYEVMQMQNINTNIIHRRRPSNASCLDHTEELTSYDNDDRAISFGSSCSTGIASYPYSTPLQSNNHISSTQDGTWDALMQMQKALEASNSDNGLNEECSDLTFNHAELSGGNTMKHQVVWDNGSLKSPSFTSSYLPFPGDTETTLTSASTVCSFQNFADLQHKMNNNEQNKLSFEVELPRQKGPTSSHVNGSRGELHSAEWGTNPGHIESSGFMPSTGDRQNDISHQLSSSFIHTPDGIVDNGSKKSPILYECEEQMEIDSLLNSFGVSTDSFSQTCGMFEQSDNLVEFGMKIELDESGSAACFSNTTPYMQTGPPESAISDGSSYPEQYQSTSQTCGFYASASQWQNVSSSGLPLLDCRKSVGEPSSIINLGGNGKGHLLVQQPQSVATDTRLEMADNVANCYLEFTGSLDGQSCLIGASVSHDEAMAAKVLQTAQPDIVTDCTFGVGTSNHAGCSDMQLPVTQTTSVQEPGLSLSKDLNSSCGLSLSKDLNSSCIQGTEIKKVYLTGKYNSECHGILRPKSFEQNTPESMDIKTYMYGCDDYSQIVDPQQSTILSASKPSHSSVLPVDKLDDKVISQQKKRKRAAEKLLAWHAQVMTMHGSRHRRRIPELDWARATKRLLEKVDGENATMGSSSFSTRAQKRLILTTSLIQYILPVVPARLLATNVTDSAETIVYHLSKSALSDACGTVLSVGNDDT

SEQ ID NO: 20208 - DNA, 1911 bp, Sorghum bicolor
  misc_feature: Ceres ANNOT ID no. 8632635
  misc_feature: Up-regulated in shoot tissues in response to methyl jasmonate treatment
  misc_feature: Up-regulated in root tissues in response to methyl jasmonate treatment
  misc_feature: Encodes the peptide sequence at SEQ ID NO 20209
atggggaagcacatgcgcatcaagacggcgcccaagggcaaccgtgccccccttctcggcgacggggagacgtcaagggggctcaccgacctggaagagggcagcaacgtccaggccaagcatgacgccgggaagctggtcctcgccactatggcgctgctcgttgcctccctcagcaaccttctcgttccgaaatatggtggcaagataattgacattgtgtcaagagacgttcggcgaccagaagataaggcgcaagccctggaggatgtgaagggcacaattttgtacattgtgacaatcgttttagtcggttcagtttgcacggctcttcgggcatggctattcaattctgctagtgagagagtagtcgctcgactaaggaaggacttgtttagtcatctcataaaccaggaaatagcgttttttgatgtgactagaacaggagagctcttaagcaggctttctgaagatacacagataataaagaatgctgctacaaccaatctatcagaggcactgcgcaatctcactactacagctattggtcttggttttatgttttcaacttcatggaagttaacattgctggcacttgtaattgtcccagttatatcagttgctgtgcgcaaatttggacgctttcttcgtgagctttcacatcagacacaagctgctgcagctgtagcttcatccatagctgaggaatcctttggtgccatccgtacagtaagatcctttgctcaggaatctcatgagatttcacgctatggtggaaaagttgaggagacacttaaacttggtctcaaacaagctaaagttgttggcttgttttctggagggcttaatgcagcgtcaaccttgtcagtggttattgttgttatttatggagccaacttaaccatcaatggctacatgacaactggttctcttacatcattcatcttatacagccttacagttggttcgtcagtatctgccttgtcaggactatacacaactgtaatgaaagcctctggtgcaagccgtagagtttttcaacttctggaccgtgtttcctcaatgacaaactctggggacaaatgtccaataaatgaaaaggatggggaagttgagcttgatgatgtctggttcgcatatccttctcgcccttctcatatgattcttaagggaataacgctgaagttagctccaggttcaaaggttgcacttgttgggccaagtggtggtggtaaaaccacaatagcaaatttgattgagcggttttatgaccctctaaagggaaggatattgcttaatggagtaccattggtagaaatttcacatcaatatcttcacagcaaggtaagcattgtcagtcaggagcctacactctttaactgcaccatcgaagagaatattgcttatggattagagggcaaagcgaactttgctgacgttgagagtgcggctaaaatggcgaatgcacacaacttcatatgcacctttcccgaccaatataagactgtcgttggcgagcgagggatcaggttatccggcgggcagaagcagaggatcgccattgcgagagctttgcttatgaacccacgagtgcttctcttggacgaagctaccagtgccctggatgctgaaagcgaatatcttgtccaggatgcaatggactccttgatgaaagggcggactgtccttgtgatagctcaccggctgtcgaccgtcaagagtgccgacaccgtcgccgtcatctctgacggcctaatcgtggagagtggcacgcacgacgaactcctggaccacaacggcatatacacagccttggtgaagaggcagctgcaagggccgaagtttgaggccaccagcagcatcaacgacgccagcgaaattgaagccgagcccagccgtaatgggcaatag

SEQ ID NO: 20209 - protein, 636 aa, Sorghum bicolor
  misc_feature: Ceres ANNOT ID no. 8632635
  misc_feature: Up-regulated in shoot tissues in response to methyl jasmonate treatment
  misc_feature: Up-regulated in root tissues in response to methyl jasmonate treatment
  misc_feature (119)..(634): SWISSPROT Homolog: EC 3.6.3.44 Xenobiotic-transporting ATPase
  misc_feature (46)..(325): Pfam ID: ABC_membrane Pfam Description: ABC transporter transmembrane region
  misc_feature (399)..(584): Pfam ID: ABC_tran Pfam Description: ABC transporter
MGKHMRIKTAPKGNRAPLLGDGETSRGLTDLEEGSNVQAKHDAGKLVLATMALLVASLSNLLVPKYGGKIIDIVSRDVRRPEDKAQALEDVKGTILYIVTIVLVGSVCTALRAWLFNSASERVVARLRKDLFSHLINQEIAFFDVTRTGELLSRLSEDTQIIKNAATTNLSEALRNLTTTAIGLGFMFSTSWKLTLLALVIVPVISVAVRKFGRFLRELSHQTQAAAAVASSIAEESFGAIRTVRSFAQESHEISRYGGKVEETLKLGLKQAKVVGLFSGGLNAASTLSVVIVVIYGANLTINGYMTTGSLTSFILYSLTVGSSVSALSGLYTTVMKASGASRRVFQLLDRVSSMTNSGDKCPINEKDGEVELDDVWFAYPSRPSHMILKGITLKLAPGSKVALVGPSGGGKTTIANLIERFYDPLKGRILLNGVPLVEISHQYLHSKVSIVSQEPTLFNCTIEENIAYGLEGKANFADVESAAKMANAHNFICTFPDQYKTVVGERGIRLSGGQKQRIAIARALLMNPRVLLLDEATSALDAESEYLVQDAMDSLMKGRTVLVIAHRLSTVKSADTVAVISDGLIVESGTHDELLDHNGIYTALVKRQLQGPKFEATSSINDASEIEAEPSRNGQ

SEQ ID NO: 20210 - DNA, 1197 bp, Sorghum bicolor
  misc_feature: Ceres ANNOT ID no. 8632650
  misc_feature: Up-regulated in root tissues in response to salicylic acid treatment
  misc_feature: Encodes the peptide sequence at SEQ ID NO 20211
atgggcatgttgttgacgatgaacgagagtgcgagtgggactagcggctgcatccagcagccatcgagacaggtccttgcatccctgcccttgctcgtctacgaatacaaggatgctggtgatgccacagatgagcagctggagcctactcctgttgttgatcatccagactctactgccactgctgccacagccacaaaaaagatgctcatatatagcctttccgagcggagcatcgtctacacgacgcacggcaggcctcggcctcagcctcagatcatgatggatggaaataacttctgcctcagcacgcctcagggatgggtgctcatcctcggacaagcctccgacgcctggctgtggcacccgctcaccggagagaccatcaccctcccaccaatccaagacgaccactacatccccgtcaactgcaattgcctgctcacccacaactccgccgcccacccagactgtgccgtcgttctcctcgatgttgccgatcctctcatgtggttctgccgggtcaatggcgggactgaccggaggtgggggcagcacacctacgacattggtgactgcgacatccccgaggagttccgcacctcctccacgcccacgaagaacgtcattcccaacgttgccgcactgagagggaagctgcatttcttcttcatagaatcaaaccaacacaagatgtgcatcgtcgacttggatttcccgcctgatcatgccagtcctcctgccgcagagttccacgagtttgatgtcaataatctcgagttccccgatgatttgtgctctgggaccatctgcttggtggagtccatggatgagctctttgccgtctgcatctgctatgtggattttgatcccaccaacatcggagccgtcgtcatctacaagatggaattctgcggtgagaaacctgtagcctggcaccgggtgcatggtattggggaagatagggcttttcttctgacagagatgaatatggcaacttggtgctcagcaagtgcccataataaccttcaaggaaacaccatttgttttctcaagaaatcattagtgtctggcgacaacagggatctatgcatatatgatattcagaagcaaaccatggagattgtccaggttcacaacgaagatttgaagatcgtgcgcatgccgccatactggattaatgtacctccgtgctag

SEQ ID NO: 20211 - protein, 398 aa, Sorghum bicolor
  misc_feature: Ceres ANNOT ID no. 8632650
  misc_feature: Up-regulated in root tissues in response to salicylic acid treatment
MGMLLTMNESASGTSGCIQQPSRQVLASLPLLVYEYKDAGDATDEQLEPTPVVDHPDSTATAATATKKMLIYSLSERSIVYTTHGRPRPQPQIMMDGNNFCLSTPQGWVLILGQASDAWLWHPLTGETITLPPIQDDHYIPVNCNCLLTHNSAAHPDCAVVLLDVADPLMWFCRVNGGTDRRWGQHTYDIGDCDIPEEFRTSSTPTKNVIPNVAALRGKLHFFFIESNQHKMCIVDLDFPPDHASPPAAEFHEFDVNNLEFPDDLCSGTICLVESMDELFAVCICYVDFDPTNIGAVVIYKMEFCGEKPVAWHRVHGIGEDRAFLLTEMNMATWCSASAHNNLQGNTICFLKKSLVSGDNRDLCIYDIQKQTMEIVQVHNEDLKIVRMPPYWINVPPC

SEQ ID NO: 20212 - DNA, 1197 bp, Sorghum bicolor; identical to SEQ ID NO: 20210
  misc_feature: Ceres ANNOT ID no. 8632653
  misc_feature: Up-regulated in root tissues in response to salicylic acid treatment
  misc_feature: Encodes the peptide sequence at SEQ ID NO 20213

SEQ ID NO: 20213 - protein, 398 aa, Sorghum bicolor; identical to SEQ ID NO: 20211
  misc_feature: Ceres ANNOT ID no. 8632653
  misc_feature: Up-regulated in root tissues in response to salicylic acid treatment

SEQ ID NO: 20214 - DNA, 2034 bp, Sorghum bicolor
  misc_feature: Ceres ANNOT ID no. 8632691
  misc_feature: Down-regulated in shoot tissues in response to aminocyclopropane carboxylic treatment
  misc_feature: Up-regulated in shoot tissues in response to methyl jasmonate treatment
  misc_feature: Up-regulated in root tissues in response to methyl jasmonate treatment
  misc_feature: Up-regulated in root tissues in response to salicylic acid treatment
  misc_feature: Encodes the peptide sequence at SEQ ID NO 20215
atgggcggcgagctcgccggccgcatcaggtcgggcgtcctcgagcccctggaggagcgcttcacggagattctaatatggtcgctgcaatgctacgacgcgcaggtccggaggcgcctcgtcccgctccttcgccgccacaggatggcgctgctcacggcgccggcggtggccgcgctgctgctcgtcttctggtccgcggcgtacggtggtgacgcccagggcgtgccgccgtacaaggaccccaagaacgacgtggaggtccgcgtcaaggacctgctcgcccggatgacgctggccgagaagatcggccagatgacgcagatcgagcggctcgtcgcgtcgccgcaggtgctcaaggactactacatcggcagcctgctcagcggcggcgggagcgtgccgcggaagcaggcgacggcggcggagtggatggccatgatcagcgacttccagaaggcgtgcctgtccacgcgcctcggcatcccgatgatctacggcatcgacgccgtccacggccacaacaacgtgtacggcgccaccatcttcccccacaacgtcggcctcggagccaccagggaccctaatctggtgaagaggatcggcgccgcgaccgcgcttgaagtgagagccaccggcatccagtacgcgttcgcgccatgcattgctgtgtgccgtgatccgaggtgggggcggtgctacgagagctacagcgaggaccaccgtatcgtgcagtccatgactgagctcatcccgggcctgcagggcgacgtcccgcagaacttcaccagcggcatgcccttcgccgccggaaagaacaaggtggcggcgtgcgccaagcacttcgtcggcgacggtggcacgcagaacggcatcaacgagaacaacaccatcatcgaccgcgacggtctgatgagcatccacatgccggcctacttggacgcgctccgtaagggcgtctccaccgtcatgatctcctactccagctggaacgggctcaagatgcacgccaatcacgacctcatcacgcgcttcctcaagggcaggctcaacttccagggcttcacgatctcggattgggagggcatcgacaggatcaccagccctccaggggcgaactactcctactctgtgcaggcttcaattcttgctggcattgacatgatcatggtgccaaacaactaccaagacttcatcaccatcctgaccggtcacgtcaacagcggtctgatcccgatgagcaggatcgacgacgccgtgacgaggattctgcgcgtcaagttcaccatgggcctgttcgagaaccccatgccggaccctagcctcgccgaccagctggggaagcaggagcacagggacctggcgcgggaggcggtgaggaagtcgctggtgctcctcaagaacggcaagccaggcgacgcgccgctgctgcccctgcccaagaaggccgccaagatcctggtcgccgggagccacgccgacaacctgggttaccagtgcggcgggtggacgatcgagtggcagggcgacacggggcgcatcaccgtcggcaccacgatcctggacgccgtgaaggcggccgtggacccgtcgacgacggtggtgttcgcggagaaccccgacgccgacttcgtcaagaacggcggcttctcgtacgccatcgtggccgtgggcgagcacccgtacacggagaccaagggcgacagcctgaacctgacgatcccggaccccgggccgagcaccgtccagacggtgtgcggcgccgtgcggtgcgcgaccgtgctcatcagcggccgccccgtggtgatacagccgttcctgggcgccatggacgcgctcgtggcggcctggctgccgggaacggaaggccagggcatcaccgacgtgctgttcggggactacgggttcacggggaagctgccgcggacgtggttcaagtccgtggaccagctgcccatgaactacggcgacaagaagtacgacccgttgttcccgctcgggttcgggctcaccacacagggcaaggggtactag

SEQ ID NO: 20215 - protein, 677 aa, Sorghum bicolor
  misc_feature: Ceres ANNOT ID no. 8632691
  misc_feature: Down-regulated in shoot tissues in response to aminocyclopropane carboxylic treatment
  misc_feature: Up-regulated in shoot tissues in response to methyl jasmonate treatment
  misc_feature: Up-regulated in root tissues in response to methyl jasmonate treatment
  misc_feature: Up-regulated in root tissues in response to salicylic acid treatment
  misc_feature (90)..(538): SWISSPROT Homolog: EC 3.2.1.21 Beta-glucosidase
  misc_feature (154)..(391): Pfam ID: Glyco_hydro_3 Pfam Description: Glycosyl hydrolase family 3 N terminal domain
  misc_feature (463)..(674): Pfam ID: Glyco_hydro_3_C Pfam Description: Glycosyl hydrolase family 3 C terminal domain
MGGELAGRIRSGVLEPLEERFTEILIWSLQCYDAQVRRRLVPLLRRHRMALLTAPAVAALLLVFWSAAYGGDAQGVPPYKDPKNDVEVRVKDLLARMTLAEKIGQMTQIERLVASPQVLKDYYIGSLLSGGGSVPRKQATAAEWMAMISDFQKACLSTRLGIPMIYGIDAVHGHNNVYGATIFPHNVGLGATRDPNLVKRIGAATALEVRATGIQYAFAPCIAVCRDPRWGRCYESYSEDHRIVQSMTELIPGLQGDVPQNFTSGMPFAAGKNKVAACAKHFVGDGGTQNGINENNTIIDRDGLMSIHMPAYLDALRKGVSTVMISYSSWNGLKMHANHDLITRFLKGRLNFQGFTISDWEGIDRITSPPGANYSYSVQASILAGIDMIMVPNNYQDFITILTGHVNSGLIPMSRIDDAVTRILRVKFTMGLFENPMPDPSLADQLGKQEHRDLAREAVRKSLVLLKNGKPGDAPLLPLPKKAAKILVAGSHADNLGYQCGGWTIEWQGDTGRITVGTTILDAVKAAVDPSTTVVFAENPDADFVKNGGFSYAIVAVGEHPYTETKGDSLNLTIPDPGPSTVQTVCGAVRCATVLISGRPVVIQPFLGAMDALVAAWLPGTEGQGITDVLFGDYGFTGKLPRTWFKSVDQLPMNYGDKKYDPLFPLGFGLTTQGKGY

SEQ ID NO: 20216 - DNA, 4872 bp, Sorghum bicolor
  misc_feature: Ceres ANNOT ID no. 8632712
  misc_feature: Up-regulated in shoot tissues in response to salicylic acid treatment
  misc_feature: Encodes the peptide sequence at SEQ ID NO 20217
atggagggaaaatgtcagtccacacgaccacaccccccaaacattcaaaaaccaatcgtgacactgacctctcctaccccacaaccctccccggggtcatcccaggcacgaaaccagatcaaaccgcacccagcgcagcccacaccccacgcaggcacgcagccgcggcccgcgtttccacggctgcggcgcaggccccgcgcgtcagttaccgccgctgcccacccacccaacgcagcaggccgcccgcagcgccggatgatcccaaaaacaaaacaaataaaaccccgcaggaaaaacgcgagagaagcacagcacaaggccgccggtcccttggctcccagttcccactactcgccgctggatcctccacccgccgctcctgctcaacccgccgcggcacctggccggagatccagccgccgggagcgcggaggtcggccggttgctcccgtttccgctggtggttgctcttcgccgctggagatcggcagacggaagcagttgacgccacaggggcttcgtgctgccgaattccccagatattttgggggttcaaccgaacccccaatgcccaacgccactgggcttgaaatgggccttaaaggctctaagggagctccaatgccaggaaaggaaggaattgtggcaaaggatttgaagaaggctccagcctccttggaggaaaacaagtcttccggtgatgaggatcttggaggagggcctgtcttgactgggaagaaaaggaaggaccggaggggttcctcggatgaggacaggagtggtgtgacaaaaagggtgttgaggtccgatgccatgaagctgcgtgctgaagctgaggcagcctgtggagtgggtgtggaggtcagcaaaacttactgtttggagaagaaacattgtgaggctattgtggaggctgagtcttgcaaaggcagggtgccgatggaagttacttgcaatggtgaggaagctaacggattggttaacttggacgcgagtgatgtctcggaagagtcagctaggtgttctgagaataatatgggaatgcctggtgttcctgcagcagatatttctcaaggtgatggattaggcactcaaggtagcaatgcagaatcagatgataagacagtcaagtcagatgagaaggtgtctgctgtaactcattcaaagcagaatgactccagagctggaataaacagtagtgttgatgaggcccaagataacaaagtgagacatgggccttgtcaaggtgaggtcatagactcagcaattgctaatgatgccgacacaagtacagatttaaccaaaatcatccctaccagtggatcagaatctgttaagcaggaggatagtaagcaggagaataatgtggaccataccgaggaagtgatactccacagtagtgatccggaagttgagaagcattctcacattgatgatgtttgtacagaaactgagatttctttgactgagaatggaagatgtacagtagataaccacactgatctaactgggtgcactaagcaggaggagaggggaatccccgtgaacgaagccaatgatgtttcatcacatgacattgtctttacaaggagaggtagaaaatcatgtgaggcaaagcaggggacatgtggagaggagtcgcggtttgagaagcgagttacaaggtcagctacagttaggcagagagaagtttctggaagctcacgtaaaagtaccacaaacgaggctgcactaggaagcagaggaaaaaagggagatattgttgctcattatacaaggaaagtgaacagtgcattatctcctaaaggtcaccatgctgagttgggagagcgtaataccagtatggagaagcaaacagtgaaagaaaaggtggtggatcatagagactcaggtgtcactgagaatgataatcatgtgaatggcactgagattaaggaatcggaaaatgaaacagggatcaatttgaagacacaaccaactgtgggaagtgtcagcgtcgttaagaaaacaactggagcagctgtttctgcggtggatcagaatatctctggttcagccatcactgagagaaatgatatggagcatactgattctgatggagttaaatctgaaaataagactcctgtgcagaaaccactactgtctgttggtgcgaagattgttgccagcaagaagaggatattggaagcagggcttgataaaatcactggaaggtcaccaattgctttgccatccatgaaaaagacaagaaatacgtcttgtgatcctgagatagaccaaccagataagtcttctggagagaagcttattgggaataacactgatttgggcaataaacgtgttctgagggaacggcagcatcgcaatcaaacaaatttgtcaagcagatctcctaaccactctaatcaaaatgctatcaagcagacacaggatcaatctgatgatgatgagatcagcagcgatacttcctacaggagaagtcgtagcggacgtcgtcgtggtgctgcccgtcttgttgtgccaaaacaagaggactccagtgattctgaagaagttgtcgtgaaaaagaatcggcggaaacggaagaaatctgtgcataaacaaagggctggatctaagttgaagcatacttctggtccttccaaagcaggtcgtttgggtagacctcctttgatcaaatctgaatctagctccttatctttgcatccaggaaaagggaaaatgaaggtgcctaaaggtacaagaactcttcgcgaagaaaagcaaaaaataagtgatcagataaaggccatgcttctagatgctggttggacgattgatttaagacccaggaatggtagagactacatggattccgtgtatatccctcctagtggcaaagggtcttactggtcagtcacaaaagcatattatgcgttttgtgcaagtatggaatctgagcagaaggaaagttctaaagaccagattttgtcaaaaaaatctgttggtagccccggcaaaaagcaggtctctagctctccaggctgtactttaacagaggatatccttagcaaattaaaaagagttgttgtaaacaaacgaacaaccaaagtagcgattcaaaggctcaaacagaaaaggttcaaaaaggaaaagaagaagaatgcaaattcaagaagactgcatttaggcaatgaaagaaaaaaacgaggtggttgtgctctacttgttcgtggatcgaacaaggagtctggcagcggcactgatggttttgttccatatgaatggaaacgtacgatcttctcctggctgattgatctggatgttctatcagtcaacactaagctgaaatgtatggatgaaagcaactcaaaggttttactagagggtattgtcactagggatgggattgactgcagctgctgtagcaaggtcctttcagtgcttgaatttgtggcgcatgctggttctgaagtaaatacgccatacagaaatatacttgtggatgggcaagacattgaccttttgcattgtctcattaatgcatggaatatgcagtctgatgctgaaaagcaagatttctttcctgttagcattgagggtgatgaccccaatgatgacacctgtggtatttgtggcgatggaggcaatttgatctgctgtgatggatgcccctcaacatttcacatgagttgtctaggactggaggaacttccctctgattattggtgttgtgcaaactgctcatgtaaattttgccatgaacattctaatgatggtgctgaagacactgctgatgttgattcttcattgcatacttgttcccagtgcgaagagcagtatcatgaagcctgttctcctgagaatgattccataactaacctttccagtcagacaggcaatttattctgccaacaaagctgcagactgctgtttgaggaattgcagaatcttcttgcagtcaagaaggatcttgaaccagaatattcatgcagagttgttcaacgcatccatgaagatgtaccagaagaagtccttcctttggacacaagagttgagtgtaactccaagattgctgttgcactttcattaatggatgaatgcttccttccgattgttgaccagagaactggcatcaacctgatacgcaatgttgtgtatagctgtggatcaaattttgcccgattggatttccgtggattctatatattcattttagaacgtggagatgaaataatagctgcagcatctgtccgaatacatggaaccaagttagctgagatgccgttcattggtacccggaatatgtataggcgacaagggatgtgccgccgacttgtagatggaattgaaatgatcctcagctctctcaatgttgagaagttgatcattcctgctatcacagaacttgtggacacctggacatctagatttggatttagtccacttgaagattctgagaaggaagaagtgaaatctattagcatgttagtttttcctggtacaggtcttctccaaaagccattgctgaaggccttacctaaaggtggtcaatgttctcaaggagataaaactgagaaatcacctgatgtagccaatgaagattctctttgctctgatgcaagtgttgatcccttagatttgggggtcaaagagcctggggacaacagcaaaaatgctgatggtacttgcagtgatgtttcacaacaatctccccattcttgctttttgggccccaagctttacatggacgaagcctccattagtttttgtacctcgagttttgactcagcagttagcatgacatccatccgttggcagaaagaggcttgcggttttttgcagattagttgctggggcacccctgtagtttttttactcccaaattga

SEQ ID NO: 20217 - protein, 1623 aa, Sorghum bicolor
  misc_feature: Ceres ANNOT ID no. 8632712
  misc_feature: Up-regulated in shoot tissues in response to salicylic acid treatment
  misc_feature (1199)..(1242): SWISSPROT Homolog: EC 2.1.1.43 Histone-lysine N-methyltransferase
  misc_feature (1202)..(1245): Pfam ID: PHD Pfam Description: PHD-finger
MEGKCQSTRPHPPNIQKPIVTLTSPTPQPSPGSSQARNQIKPHPAQPTPHAGTQPRPAFPRLRRRPRASVTAAAHPPNAAGRPQRRMIPKTKQIKPRRKNAREAQHKAAGPLAPSSHYSPLDPPPAAPAQPAAAPGRRSSRRERGGRPVAPVSAGGCSSPLEIGRRKQLTPQGLRAAEFPRYFGGSTEPPMPNATGLEMGLKGSKGAPMPGKEGIVAKDLKKAPASLEENKSSGDEDLGGGPVLTGKKRKDRRGSSDEDRSGVTKRVLRSDAMKLRAEAEAACGVGVEVSKTYCLEKKHCEAIVEAESCKGRVPMEVTCNGEEANGLVNLDASDVSEESARCSENNMGMPGVPAADISQGDGLGTQGSNAESDDKTVKSDEKVSAVTHSKQNDSRAGINSSVDEAQDNKVRHGPCQGEVIDSAIANDADTSTDLTKIIPTSGSESVKQEDSKQENNVDHTEEVILHSSDPEVEKHSHIDDVCTETEISLTENGRCTVDNHTDLTGCTKQEERGIPVNEANDVSSHDIVFTRRGRKSCEAKQGTCGEESRFEKRVTRSATVRQREVSGSSRKSTTNEAALGSRGKKGDIVAHYTRKVNSALSPKGHHAELGERNTSMEKQTVKEKVVDHRDSGVTENDNHVNGTEIKESENETGINLKTQPTVGSVSVVKKTTGAAVSAVDQNISGSAITERNDMEHTDSDGVKSENKTPVQKPLLSVGAKIVASKKRILEAGLDKITGRSPIALPSMKKTRNTSCDPEIDQPDKSSGEKLIGNNTDLGNKRVLRERQHRNQTNLSSRSPNHSNQNAIKQTQDQSDDDEISSDTSYRRSRSGRRRGAARLVVPKQEDSSDSEEVVVKKNRRKRKKSVHKQRAGSKLKHTSGPSKAGRLGRPPLIKSESSSLSLHPGKGKMKVPKGTRTLREEKQKISDQIKAMLLDAGWTIDLRPRNGRDYMDSVYIPPSGKGSYWSVTKAYYAFCASMESEQKESSKDQILSKKSVGSPGKKQVSSSPGCTLTEDILSKLKRVVVNKRTTKVAIQRLKQKRFKKEKKKNANSRRLHLGNERKKRGGCALLVRGSNKESGSGTDGFVPYEWKRTIFSWLIDLDVLSVNTKLKCMDESNSKVLLEGIVTRDGIDCSCCSKVLSVLEFVAHAGSEVNTPYRNILVDGQDIDLLHCLINAWNMQSDAEKQDFFPVSIEGDDPNDDTCGICGDGGNLICCDGCPSTFHMSCLGLEELPSDYWCCANCSCKFCHEHSNDGAEDTADVDSSLHTCSQCEEQYHEACSPENDSITNLSSQTGNLFCQQSCRLLFEELQNLLAVKKDLEPEYSCRVVQRIHEDVPEEVLPLDTRVECNSKIAVALSLMDECFLPIVDQRTGINLIRNVVYSCGSNFARLDFRGFYIFILERGDEIIAAASVRIHGTKLAEMPFIGTRNMYRRQGMCRRLVDGIEMILSSLNVEKLIIPAITELVDTWTSRFGFSPLEDSEKEEVKSISMLVFPGTGLLQKPLLKALPKGGQCSQGDKTEKSPDVANEDSLCSDASVDPLDLGVKEPGDNSKNADGTCSDVSQQSPHSCFLGPKLYMDEASISFCTSSFDSAVSMTSIRWQKEACGFLQISCWGTPVVFLLPN

SEQ ID NO: 20218 - DNA, 2262 bp, Sorghum bicolor
  misc_feature: Ceres ANNOT ID no. 8632768
  misc_feature: Up-regulated in root tissues in response to methyl jasmonate treatment
  misc_feature: Up-regulated in shoot tissues in response to methyl jasmonate treatment
  misc_feature: Up-regulated in root tissues in response to salicylic acid treatment
  misc_feature: Encodes the peptide sequence at SEQ ID NO 20219
atggacttcgcggagctggaggccgtagagggcctccggtggccgtggcactcgtggccgccgactgcccccgcggccgcgtccctcgtcgtgcccaccgccgtgctctgctcgccgctgcagcaccccacggcgcccgacctcctcccgctgctcccctacgcgccgctccgctgcgccaccgcggggtgcggcgccgcgctcaaccctttctcgcgcgtgcaccacggctccgcgcgctggtcctgccccttctgcggcgccgccgccaacccgttcccgcgcctcctggcccccgacgcgctccccgccgagctcttccccacccactccagcgtcgagtacgcgctgcccccggaccccgccgaggctggggggccggggccacctgcgctagtgttcgtgatcgatgcggccaccgcggccgaggagctggccgtgctgaaggacgaggtgcgcagggtcgtgcaggggctgcccgaggggatcagggtggcgctcgtcactttcgctgcgtccgtgtgggtgcacgatcttggatttgagggttgcgctcgggtggttgtgctcaatggcgagcgtgagctcgagtctgacaagatacaagaactacttggtgttcaccgttcaccgtacaagaagttggctatgccaaggtccactgaagcgcagcggtttttgctgcctgtttctgaatgtgaatttaacatcacatctgcaatagaggacctgggctccatgtctgcatgtccacgtgggcatcgccctttaagagcaactggcgcagcgatttccaccgctattgctcttctagagggttgctgctcacctagtaccggtggtcggattatggtctttacatctggtcctgcaacagttggtccagggtgtgtggtggaaactgatcttgggaaagcaattcgttctcatcgtgacatattcaatagcaatgcaccactgactgacaaagcacgtgatttctataagaaagtagcgaagaggttggcagaccatgcattagttcttgatctattcgcctgctctcttgatcaggttggggctgcagagctgaggaatccaattgaagtgtcagggggtttaatggtgcatacagagtcatttgagtctgagcagttcaaaagctgttttaggcatatgttcaagcgtgaaggcaccaattaccttaatatgaactttaatgcgacgattgaaatagtgacatcaaaggaggtgaagatttgtggtgcccttggtccctgcatttccctccgtaggaaaaatagctcagttagtgataaggaaattggtgaaggtgggacaaattattggaaaactagttcactgagcagcaagaccagcattgccttctttttccgagttgattgcagtcataaagctgagcccccgactgtcttctttattcagttcatgacaagataccgacatggtgatggtagttatcgcctaagggtaacaaccgttgcaagaaggtgggctgctcctcgatctcctgaaattgctgcagggtttgatcaggaagctgctgcaactgttatggccaggcttgctgtttacagggcagagacataccacgttagagatgttatacgatggcttgacaagatgcttatccgctttactgctaagtttggaaactatgttcctgaagatccatctacgtttcggctgtcaacaaacttctccttgtatccgcagttcatgtactacttgcggagatcacagttcattgatgttttcaacagttctcccgatgaaactgctttcttcaggttgatgctgaatagggagggagttgtggggtctctaatcatgatacagcctactctattccagtactcattcgatggaccacctattcctgtgctgttagatgtcagctccatctctcctgatgtcattttactatttgattcatacttttatatcgtgattcactatggctcaaagattgctcaatggaggaagcttggctatcataaggacccaaaccacgaaaatttgcggaagctccttgaagcaccagaagtagatgcagaggcactactggtagaccgtttccctgtaccaaaactcataaagtgtgaccagcatggtagccaggccaggttcttgcttgctcggttgaatccatctgtgacacagaaaacacagctttcagagggatctgaagtcattttcactgacgatgttagtttgcaagtgtttattgaacacttgcaggagttggctgttcagagctag

SEQ ID NO: 20219 - protein, 753 aa, Sorghum bicolor
  misc_feature: Ceres ANNOT ID no. 8632768
  misc_feature: Up-regulated in root tissues in response to methyl jasmonate treatment
  misc_feature: Up-regulated in shoot tissues in response to methyl jasmonate treatment
  misc_feature: Up-regulated in root tissues in response to salicylic acid treatment
  misc_feature (127)..(387): Pfam ID: Sec23_trunk Pfam Description: Sec23/Sec24 trunk domain
  misc_feature (398)..(499): Pfam ID: Sec23_BS Pfam Description: Sec23/Sec24 beta-sandwich domain
  misc_feature (512)..(612): Pfam ID: Sec23_helical Pfam Description: Sec23/Sec24 helical domain
  misc_feature (621)..(711): Pfam ID: Gelsolin Pfam Description: Gelsolin repeat
  misc_feature (55)..(97): Pfam ID: zf-Sec23_Sec24 Pfam Description: Sec23/Sec24 zinc finger
MDFAELEAVEGLRWPWHSWPPTAPAAASLVVPTAVLCSPLQHPTAPDLLPLLPYAPLRCATAGCGAALNPFSRVHHGSARWSCPFCGAAANPFPRLLAPDALPAELFPTHSSVEYALPPDPAEAGGPGPPALVFVIDAATAAEELAVLKDEVRRVVQGLPEGIRVALVTFAASVWVHDLGFEGCARVVVLNGERELESDKIQELLGVHRSPYKKLAMPRSTEAQRFLLPVSECEFNITSAIEDLGSMSACPRGHRPLRATGAAISTAIALLEGCCSPSTGGRIMVFTSGPATVGPGCVVETDLGKAIRSHRDIFNSNAPLTDKARDFYKKVAKRLADHALVLDLFACSLDQVGAAELRNPIEVSGGLMVHTESFESEQFKSCFRHMFKREGTNYLNMNFNATIEIVTSKEVKICGALGPCISLRRKNSSVSDKEIGEGGTNYWKTSSLSSKTSIAFFFRVDCSHKAEPPTVFFIQFMTRYRHGDGSYRLRVTTVARRWAAPRSPEIAAGFDQEAAATVMARLAVYRAETYHVRDVIRWLDKMLIRFTAKFGNYVPEDPSTFRLSTNFSLYPQFMYYLRRSQFIDVFNSSPDETAFFRLMLNREGVVGSLIMIQPTLFQYSFDGPPIPVLLDVSSISPDVILLFDSYFYIVIHYGSKIAQWRKLGYHKDPNHENLRKLLEAPEVDAEALLVDRFPVPKLIKCDQHGSQARFLLARLNPSVTQKTQLSEGSEVIFTDDVSLQVFIEHLQELAVQS

SEQ ID NO: 20220 - DNA, 1338 bp, Sorghum bicolor
  misc_feature: Ceres ANNOT ID no. 8632903
  misc_feature: Up-regulated in shoot tissues in response to methyl jasmonate treatment
  misc_feature: Up-regulated in root tissues in response to methyl jasmonate treatment
  misc_feature: Up-regulated in root tissues in response to salicylic acid treatment
  misc_feature: Encodes the peptide sequence at SEQ ID NO 20221
atgaggaggcgcctctcgctggcccgcgtgccagcggtggcgacgatggtggtggttatgctgctgtcgctgagctcgtccttgtgcgtgtcggcggcgagggcggagcagcagcggcacccggtggtgctgatcccgggcgcgggcggcaaccagctggaggcgcggctgacggaggactacaagccgtccagcctcgtgtgccgggtgtggccactcgtgcgcggccgcggcggctggttccgcctctggttcgacccctccgtgctggtcgcgccgctcaccaggtgcttcgccgagcggatgacgctctcctacgacgccgacgccgacgactaccgcaacgcgcccggcgtcgagaccagggtctccgacttcggctccacctccaccctccgctacctcgaccccaacctcaagctcctgacggggtacatgaacactctggcgagcacgctggaggagaaggccggctacgaggagggccgcgacctgttcggcgcgccgtacgacttccggtacgggctggccgggccggggcacccgtcgcaggtgggcagcgcgtacctgcagcggctcaggctgctggtggagtcggcgtgcgcggccaacggcgggcgggccgcgatcctggtggcgcacagcctgggcggcctgttcgcgctgcagctgctggcgcgcagcccggcgccgtggcgcgcggcgcacgtgcagcgcctcgtcacgctctccacgccgtggggcgggtcggtgcaggagatgctcaccttcgcctccggcaacacgctcggggtgcccttcgtcaacccgtccctcatccgcgacgagcagcggtccgccgagagcaacctgtggctgctgccgacgcccaaggtgttcggcaacaccacgctggtggtgtcgcggagccacaaccggtcctactccgccaagaacatgacgcagttcctccgggacatcggattcgagcaaggcgtggagccgtaccgcgcgcggatacgaccgctcgtcgaggccctgccggagcccggcgtgcccctgacgtgcctcgtgggcaccggcgtcgtcacggtggagagcctcgtgtacggcgacggcggcttcgacgaggaccccgaggaggtggtctacggcgacggggacgggacggtgaacctggccagcctcgtgggcccgatcaaggcctggtctgactcgcccacgcaggtcgtcgaggtggtggagctgcccaaggtgtcgcactccggcatgctcaacgacaagagcgcgctggagcagatcatcaggatcgtcgattctataaacttcaacaccacgagctatcatcagtcctcttag

SEQ ID NO: 20221 - protein, 445 aa, Sorghum bicolor
  misc_feature: Ceres ANNOT ID no. 8632903
  misc_feature: Up-regulated in shoot tissues in response to methyl jasmonate treatment
  misc_feature: Up-regulated in root tissues in response to methyl jasmonate treatment
  misc_feature: Up-regulated in root tissues in response to salicylic acid treatment
  misc_feature (71)..(431): SWISSPROT Homolog: EC 2.3.1.43 Phosphatidylcholine--sterol O-acyltransferase
  misc_feature (80)..(421): Pfam ID: LACT Pfam Description: Lecithin:cholesterol acyltransferase
MRRRLSLARVPAVATMVVVMLLSLSSSLCVSAARAEQQRHPVVLIPGAGGNQLEARLTEDYKPSSLVCRVWPLVRGRGGWFRLWFDPSVLVAPLTRCFAERMTLSYDADADDYRNAPGVETRVSDFGSTSTLRYLDPNLKLLTGYMNTLASTLEEKAGYEEGRDLFGAPYDFRYGLAGPGHPSQVGSAYLQRLRLLVESACAANGGRAAILVAHSLGGLFALQLLARSPAPWRAAHVQRLVTLSTPWGGSVQEMLTFASGNTLGVPFVNPSLIRDEQRSAESNLWLLPTPKVFGNTTLVVSRSHNRSYSAKNMTQFLRDIGFEQGVEPYRARIRPLVEALPEPGVPLTCLVGTGVVTVESLVYGDGGFDEDPEEVVYGDGDGTVNLASLVGPIKAWSDSPTQVVEVVELPKVSHSGMLNDKSALEQIIRIVDSINFNTTSYHQSS

SEQ ID NO: 20222 - DNA, 1440 bp, Sorghum bicolor
  misc_feature: Ceres ANNOT ID no. 8632949
  misc_feature: Up-regulated in root tissues in response to methyl jasmonate treatment
  misc_feature: Down-regulated in shoot tissues in response to aminocyclopropane carboxylic treatment
  misc_feature: Up-regulated in shoot tissues in response to methyl jasmonate treatment
  misc_feature: Up-regulated in shoot tissues in response to salicylic acid treatment
  misc_feature: Encodes the peptide sequence at SEQ ID NO 20223
atggaggagcgcacgggctcactctacggccgcctcaacaggaccagcacgcgggggttcctcgcctacgtcgccgccggggccgcttgcgcggccgtcctcgcctgcttcgtcctctccgccgcggacccgccggcgactgcggcgcgcaacgatgttgcggcgcgactccgcctgtcctcgcgctcaccgcgcgtctggcccgacctcgcgttcaactggcgggtagtggtcgccaccgttgtcgggttcctcggttccgcgttcggcaccgtcggcggcgtcggtggaggcgggatcttcgtgcccatgctcaacctcgtcgtcggtttcgacaccaaatccgccgcggccctctccaaatgcatgatcatgggggcctcggcgtcgtcggtttggtacaacctccaggtgtcacacccgaccaaggaggcgcccgtcatcgactacaagctcgcgctgctcttccagcccatgcttatgctcggcataaccatcggcgtagagctcagcgtcatcttcccatactggctaatcactgtcctcattataatcctcttcgtaggcacctcgtcgagatcgttctacaaggggattctgatgtggagggaggagaccaggattctgatggagacacgcgagcgagaagagcaatccaagtctacctgcgctgcaggtgatgtgataattgatccgagttatgaggagcccctcctgactcagcctcagcccaagaagaagtctgcattggagactttcctgttcaatttgaggtggaagaatatccttgttttaatgtctgtctggtcatccttcttggtgctgcaagttctcaagaataatgcgaaatcatgcagcactttctactgggtggtcaacattctacaggttccagttgcggtgagtgtattcttgtgggaggccatgcagttatgtagggagagtcgtgcacggcgtatgaatgggaacctggaatgtgtgtgtgaggcctctattgagtggtcaccagcacaactgatcttctgtgccttctgtggccttctcggtgggactgttggtggccttcttggatctggtggtgggttcatcctcggcccacttcttctcgagcttgggtgcataccacaggtcgcaagtgcaacagcaacattcgtgatgatgttctcctcctccctctctgtggtggagttttacttcctgcacagattccccctcccttttgctggctacctcatcttcatttccatattggctggattctggggccagtgtttggttaggaagattgtgcatgtgctcaagagagcatcggttattgtcttcatcctctcctctgttatcttcgccagtgctcttacaatgggtgtcgttggaacccagaagagcatttcaatgataaaaaaccacgaatacatggggttcctcgacttctgcgagtaa

SEQ ID NO: 20223 - protein, 479 aa, Sorghum bicolor
  misc_feature: Ceres ANNOT ID no. 8632949
  misc_feature: Up-regulated in root tissues in response to methyl jasmonate treatment
  misc_feature: Down-regulated in shoot tissues in response to aminocyclopropane carboxylic treatment
  misc_feature: Up-regulated in shoot tissues in response to methyl jasmonate treatment
  misc_feature: Up-regulated in shoot tissues in response to salicylic acid treatment
MEERTGSLYGRLNRTSTRGFLAYVAAGAACAAVLACFVLSAADPPATAARNDVAARLRLSSRSPRVWPDLAFNWRVVVATVVGFLGSAFGTVGGVGGGGIFVPMLNLVVGFDTKSAAALSKCMIMGASASSVWYNLQVSHPTKEAPVIDYKLALLFQPMLMLGITIGVELSVIFPYWLITVLIIILFVGTSSRSFYKGILMWREETRILMETREREEQSKSTCAAGDVIIDPSYEEPLLTQPQPKKKSALETFLFNLRWKNILVLMSVWSSFLVLQVLKNNAKSCSTFYWVVNILQVPVAVSVFLWEAMQLCRESRARRMNGNLECVCEASIEWSPAQLIFCAFCGLLGGTVGGLLGSGGGFILGPLLLELGCIPQVASATATFVMMFSSSLSVVEFYFLHRFPLPFAGYLIFISILAGFWGQCLVRKIVHVLKRASVIVFILSSVIFASALTMGVVGTQKSISMIKNHEYMGFLDFCE

SEQ ID NO: 20224 - DNA, 1179 bp, Sorghum bicolor
  misc_feature: Ceres ANNOT ID no. 8633041
  misc_feature: Up-regulated in root tissues in response to salicylic acid treatment
  misc_feature: Encodes the peptide sequence at SEQ ID NO 20225
atggccgggagcatgcaggcggcggacgcggcgggccggctaagcgcgctgctgtcgctgctcgcgctgcgccggctcctcgccgtgctccagccgctggccctgctcctgctcctgcccttcaggtggcgcccaaggccgggggccgtgcccacggccgtggcgtccgatgccgcgccctccgcgtcgtcgggggctagcgggaagaaggggaaggcgtcgtcgtcggtggttctaagggtgccggccggctcgcccatggtcgccgcgcggaggcaggcgtccgcaaggagggagatagccatgcgccgggcgcgggaggccgggcgggagtacgagctcatccccaccgctcgcggcgagacgctcttcacgcagtgctggtggccgcacccgccttcctccaccgttaaaccaagggcgctggttgttgtcatgcacgggctaaacgagcacagtgggaggtatgatcatttagcgaggcgattgaatgacatcggcatcaaggtgtacggaatggactggactggtcatggtggaagtgatggtctccatggatatgtgcaatctcttgattatgctgtcaatgatttgaaaatgtacctcaagaaagtattagccgagaaccctggtcttccatgcttctgcttcggccattcgactggtggaggtatcattctgaaggctgcgcttgatccagaggtaaaaactctcattagcggtattgtcctgacatcaccagctgtccgtgttcagcctgcccacccagtcatagcggtcatggcaccgattttcgccctcatcgcaccgaggtatcagttcacggcgtcgcacaggaacggcccaccggtgtcgcgcgacccggaggccctgcgtgccaaatacacggaccagctggtgttcacgggcgccatccgcgtgaggacgggctacgagatcctccgcctgacgtcgtacctgcagcagcacctgcaccgcatcgacgtcccgctgctggtgatgcacggcgccgacgacctggtgaccgaccccaagggctcgcgggcgctgtacgagcaggcctcctccgcggacaagtccctcaagctctacgacgggctgctgcacgacctcctgatcgagcccgagaaggacaaggtgatggacgacatcgtggcgtggctgagccccaaggtctaa

SEQ ID NO: 20225 - protein, 392 aa, Sorghum bicolor
  misc_feature: Ceres ANNOT ID no. 8633041
  misc_feature: Up-regulated in root tissues in response to salicylic acid treatment
  misc_feature (118)..(392): SWISSPROT Homolog: EC 3.1.1.23 Acylglycerol lipase
  misc_feature (168)..(385): Pfam ID: Abhydrolase_1 Pfam Description: alpha/beta hydrolase fold
MAGSMQAADAAGRLSALLSLLALRRLLAVLQPLALLLLLPFRWRPRPGAVPTAVASDAAPSASSGASGKKGKASSSVVLRVPAGSPMVAARRQASARREIAMRRAREAGREYELIPTARGETLFTQCWWPHPPSSTVKPRALVVVMHGLNEHSGRYDHLARRLNDIGIKVYGMDWTGHGGSDGLHGYVQSLDYAVNDLKMYLKKVLAENPGLPCFCFGHSTGGGIILKAALDPEVKTLISGIVLTSPAVRVQPAHPVIAVMAPIFALIAPRYQFTASHRNGPPVSRDPEALRAKYTDQLVFTGAIRVRTGYEILRLTSYLQQHLHRIDVPLLVMHGADDLVTDPKGSRALYEQASSADKSLKLYDGLLHDLLIEPEKDKVMDDIVAWLSPKV

SEQ ID NO: 20226 - DNA, 3306 bp, Sorghum bicolor
  misc_feature: Ceres ANNOT ID no. 8633039
  misc_feature: Down-regulated in shoot tissues in response to salicylic acid treatment
  misc_feature: Encodes the peptide sequence at SEQ ID NO 20227
atgtcggagaacattgatctggtgcttgagttcctgcggaagaaccggtttgccaaggcagaggcagctctccgtggggagctcaccggccgcgccgattcgaacggcgtggccacgcagaggcgtgtcactgagctgaaagaagacgaggagcaggaggacctggtgggctccaatgtagggcccaagggtgctgcgacggcgaggagtgcggactcatccagggagttcatagtgaaggagattgatgttggagccctgccgaacggttcggatggaaagaagggctctgggattggccagcctcaggagaacaacgtgggggatctgtatccttggaccttcagcattgcaaacagcactgctgaacagctagctgagctgctggtgtcagaagaggtgccaaggcataggcgtggtgcgatgctggcagagaagagggatcgaggtgttgggacagaacagcctgtcccagtgttggagcaaaaagtctcttttggaagagggaagggaaaagtcgatgctgctgggaggactgaaatcaatgaacaaggtcattccagggataaaaatctagtaccagaaaaagaggagatgttgaatggttgcacagttaagacagtgcttccattccctgcggaaaacccatcatctagttacaatagcacgcaccatgaaaatgagaggaaagaagtaaagaggagcactaatggagatggtgttggaaaaggtgcaaaaggacagcttgatgaggggaacaggcaatattacttcgaaaaatccctagatacagatcaggtgtctgaccgatgcttcgatttacagcttgttggagataatcagcgtgaggagcttccgaagttacctcctgtgaggctcaagtctgaagataagctagtcaacatgaactgggaggaaaagatcaatcaccatggatctggagccaagcagtctagtgttgatcatgcctttatgattggctcttatcttgatgttcccattgggcaagaaataacatcttcaggtggaagacgtacaattggcagtagttggttgtctgtcagtcaaggtattgcagaagatacctctgatctggtatctggttttgcaacacttggtgatgattcacttgaatatccaattggtgaatactgggattccgatgagtatgatgacgacgatgatgttggctacacccgacagccaattgaggatgaaacctggtttttagcacatgagattgattatcctagcgacaatgagaaggcaactggccacacaagagggactgatcgtcatgatcgccctacaaaggatgaagatgatgaccagtcatttgttgaggaagattcctacatatctggtgagcaatattttcatggaaagaatattgcacaaataggtacatctgagggtccaatgggccatgggattcctgataatgatatgatagctcagtatgatggccaacttttagatcctgaagagcttaatttgatgcattctgaaccagcctggcagggctttgtatcgcagaacagtgaactaggtatgttagggaatgggaaattccttaatgattcggaacgacctcatcctgatgacccttttgtggaggatgatcagcatggctctgttaggtcaattggtgttgggataagcagtgatgctgctgacattggcagtgaggtgcgagaaagtctgattggaggtagcagtgaaggggatattgaatacttcaatgaaagcagcttgagcattagtggaaaaagacattctcagcaggatactgaaaagaagagagtaggtgctaaaggagtaaaacatgaccaaatcatttatgctgagaagggcaatctaccactaggagcggctgatggtggattttcttttcctccacctttgcattctgggaaaattcatgactctgatgctaaacaacctttgtggtcaaagaaggatgaaatgtattgcattaacgatcctgatgactgtcaaaatggcatggtatcagatgatatgcttgccacatggaggaaaaagaacagtgagtcttctctaaggagctctagagatgaaatgacatccgatgttgttagatcaagaaattcaagtgcatcatatgacgaaacagaggacacaacgaatgttcggcaacacaaactagatgacgcacaagaagaagacactggaaccaacttggatgatgaggaagcagcagcattgcaagaacaagtcaggcagataaaggcacaggaggaagagtttgaaacgttcaatcttaagattgtgcatagaaaaaacagaactggttttgaagaagacaaaaatttccatgttgttctcaattctgtcattgcggggcgttatcatgtatcagagtatttgggttcagctgcattcagcaaagctatccaggcacatgatttgcacacaggaatggatgtatgtgttaaaattataaaaaataacaaagattttttcgaccagagccttgatgagatcaagctcctgaagtatgttaacaagcatgatccagctgacaagtaccaccttttgcgtctgtatgattacttctactatcgggagcatttgctgatagtctgtgaacttctgaaggcaaacctgtatgagtttcagaaatttaacagagaatcagggggtgaggtttacttcacaatgccaagactgcagtcaatagctattcaatgtctggaggcgctgcagtttctgcatggtcttggtttaatccactgtgatttaaagccagaaaacatattggtaaagagctacagcagatgtgaaataaaagtaattgatcttgggagcagctgctttgagacagatcatctatgttcatatgtgcaatcacgatcttaccgtgcacctgaggttatactgggcttgccttatgacaaaaagatagatatatggtcacttggttgtatattagcggaactttgcactggaaatgtccttttccaaaatgattctcctgcaacattacttgctcgtgtgatgggtatcattggctccatagaacaagctatgcttgcacagggacgggacacctacaaatatttcacaaagaaccacatgttgtatgaaagaaatcaggaaagtaacaggcttgaatacttgattccgaaaaagacatccttgcggcaccgtttgcccatggctgatcaagggtttattgagtttgttgcgtaccttctagaggtgaacccaaagaagcgcccaagtgcctcagaagcattgaaacatccatggctttcttttccttatgagccaatatcatcatga

SEQ ID NO: 20227 - protein, 1101 aa, Sorghum bicolor
  misc_feature: Ceres ANNOT ID no. 8633039
  misc_feature: Down-regulated in shoot tissues in response to salicylic acid treatment
  misc_feature (768)..(1092): SWISSPROT Homolog: EC 2.7.12.1 Dual-specificity kinase
  misc_feature (790)..(1092): Pfam ID: Pkinase Pfam Description: Protein kinase domain
MSENIDLVLEFLRKNRFAKAEAALRGELTGRADSNGVATQRRVTELKEDEEQEDLVGSNVGPKGAATARSADSSREFIVKEIDVGALPNGSDGKKGSGIGQPQENNVGDLYPWTFSIANSTAEQLAELLVSEEVPRHRRGAMLAEKRDRGVGTEQPVPVLEQKVSFGRGKGKVDAAGRTEINEQGHSRDKNLVPEKEEMLNGCTVKTVLPFPAENPSSSYNSTHHENERKEVKRSTNGDGVGKGAKGQLDEGNRQYYFEKSLDTDQVSDRCFDLQLVGDNQREELPKLPPVRLKSEDKLVNMNWEEKINHHGSGAKQSSVDHAFMIGSYLDVPIGQEITSSGGRRTIGSSWLSVSQGIAEDTSDLVSGFATLGDDSLEYPIGEYWDSDEYDDDDDVGYTRQPIEDETWFLAHEIDYPSDNEKATGHTRGTDRHDRPTKDEDDDQSFVEEDSYISGEQYFHGKNIAQIGTSEGPMGHGIPDNDMIAQYDGQLLDPEELNLMHSEPAWQGFVSQNSELGMLGNGKFLNDSERPHPDDPFVEDDQHGSVRSIGVGISSDAADIGSEVRESLIGGSSEGDIEYFNESSLSISGKRHSQQDTEKKRVGAKGVKHDQIIYAEKGNLPLGAADGGFSFPPPLHSGKIHDSDAKQPLWSKKDEMYCINDPDDCQNGMVSDDMLATWRKKNSESSLRSSRDEMTSDVVRSRNSSASYDETEDTTNVRQHKLDDAQEEDTGTNLDDEEAAALQEQVRQIKAQEEEFETFNLKIVHRKNRTGFEEDKNFHVVLNSVIAGRYHVSEYLGSAAFSKAIQAHDLHTGMDVCVKIIKNNKDFFDQSLDEIKLLKYVNKHDPADKYHLLRLYDYFYYREHLLIVCELLKANLYEFQKFNRESGGEVYFTMPRLQSIAIQCLEALQFLHGLGLIHCDLKPENILVKSYSRCEIKVIDLGSSCFETDHLCSYVQSRSYRAPEVILGLPYDKKIDIWSLGCILAELCTGNVLFQNDSPATLLARVMGIIGSIEQAMLAQGRDTYKYFTKNHMLYERNQESNRLEYLIPKKTSLRHRLPMADQGFIEFVAYLLEVNPKKRPSASEALKHPWLSFPYEPISS

SEQ ID NO: 20228 - DNA, 2094 bp, Sorghum bicolor
  misc_feature: Ceres ANNOT ID no. 8633075
  misc_feature: Down-regulated in root tissues in response to methyl jasmonate treatment
  misc_feature: Down-regulated in shoot tissues in response to methyl jasmonate treatment
  misc_feature: Down-regulated in shoot tissues in response to aminocyclopropane carboxylic treatment
  misc_feature: Encodes the peptide sequence at SEQ ID NO 20229
atgccgtccacgcgcgcgctccggcggttcgacccgcgacggtcgccgccggcacgacagagctcgcaggcggcggcggccgccgcgaaggaggaggaggaagcgtgcccgtggctgctgtcctcatcctccacctcgtcgtcttcctcctcggcctccgcgctcttcaagcactccgccaccttgtcggcggctgggccgagggccggatcggggacgcgcgtgtacccgctgcgggacttcccgggcggggacgcggccgcgctcggcggcgcgttccgggacaacgtgcggtggctcctgaagcagtggagctgcgcaccgggttccgggtcggcgtggcgcgcgctgctctcggacgagcgtacgggcgccttagtccccatcgtcgccgtggaggagctcgccgcggcgtcgtcatcgccgctctgcgatctctgtcgctgcgccggttggagccaccactgggtgtcaaagcggaagtaccatttcatcattccggcagtggtcgactgggaccagccattcagtgctgatgcgttgcttgggcacaccgatcaccttctacatggtctgatccatagtaatggctttggtcaccttgtcactctccatggtcgtgatggtggctccactttcctctctggctgccagatcatggatatatgggatcagctttgcgcagctctccgtgtaagagccgtctctattgtggacttgactcagaagcactctgtggacctccgtctcctgcttggagtggcacaaggcaagacatggttcactcgctgggggtactgcctcgccaagggttgtttcagcgtgtctaggtccacttatgctgctgcacttgaagcccttgctaccctgcctgttgattgtctccgtagtcgtcatgtccgtcgtgtggtcaccatctaccgccgcctatccaacaaacctctggctacagtccgtgagttcctcctctgcctccttgattggaagcaccttgaggccccgcattctcctcctcgcgtgaagacatccccacggctgatgttcttgcagccaaagtcatgtatggtgaagaggctcaggcagccatgccaacgctttgaggacgtagttgacctgcttgagtgtcggtggtcaaagaagcgtctgcttagtgctgcagaggttgttgttgaaaagctgcgggagcatgccgatggcacaaggataacacggcaggcagtgcgagatgctgccaggggttccatcggtgacactggtctcctggacttcgtcatcaagtccctcagtgacactgttgttggtaaccacattgtgcgccgcgtgcctgaccctgagaatcgtgtgcttcatttcagcctagaggaatatgctgatcctgagccacagccgcaggcagatcatgagcttgagccagtggaaattgatgcagagcacagccctcctgcagtccgatggccaaacacagcagaggcggagcgggatctgcgtgctgtgtgccgagcaatggtggaggcacgcagtgaagcagcacaggctgtactggactgcaagcactgggtgaaatggtggggccttagggatgagtctgatgaccagctaaggttccttgtcgagtggcgaccacagccatgggaggctactgaacttacaaagccaatgccgccaggggatatcgtggtagtacccctgcatacatccattggtgagctgcttgttgaggcggagcatgctctgcgggatacatactgcttctttgaggattttcaggccgagtcactggatggcattgctggggataaatgggatccggtgatgcttggtggagcagagtctggtgacaccatcggtgtgcacggccacggagcggacatggagactgggctgcggtgccagggaggtgcagatgcgtgggaggtgcagtgtgtttgtggtgcacaggacgacgatggcgagcgcatggtggcatgcgatgcatgcaatgtctggcaccatacacgctgtgtcggcattgcagatggtgctccggtgccaccattatttctctgcatatcctgtagtggcgcgctcatggccgctggaccaatttctgggtga

SEQ ID NO: 20229 - protein, 697 aa, Sorghum bicolor
  misc_feature: Ceres ANNOT ID no. 8633075
  misc_feature: Down-regulated in root tissues in response to methyl jasmonate treatment
  misc_feature: Down-regulated in shoot tissues in response to methyl jasmonate treatment
  misc_feature: Down-regulated in shoot tissues in response to aminocyclopropane carboxylic treatment
  misc_feature (640)..(688): Pfam ID: PHD Pfam Description: PHD-finger
MPSTRALRRFDPRRSPPARQSSQAAAAAAKEEEEACPWLLSSSSTSSSSSSASALFKHSATLSAAGPRAGSGTRVYPLRDFPGGDAAALGGAFRDNVRWLLKQWSCAPGSGSAWRALLSDERTGALVPIVAVEELAAASSSPLCDLCRCAGWSHHWVSKRKYHFIIPAVVDWDQPFSADALLGHTDHLLHGLIHSNGFGHLVTLHGRDGGSTFLSGCQIMDIWDQLCAALRVRAVSIVDLTQKHSVDLRLLLGVAQGKTWFTRWGYCLAKGCFSVSRSTYAAALEALATLPVDCLRSRHVRRVVTIYRRLSNKPLATVREFLLCLLDWKHLEAPHSPPRVKTSPRLMFLQPKSCMVKRLRQPCQRFEDVVDLLECRWSKKRLLSAAEVVVEKLREHADGTRITRQAVRDAARGSIGDTGLLDFVIKSLSDTVVGNHIVRRVPDPENRVLHFSLEEYADPEPQPQADHELEPVEIDAEHSPPAVRWPNTAEAERDLRAVCRAMVEARSEAAQAVLDCKHWVKWWGLRDESDDQLRFLVEWRPQPWEATELTKPMPPGDIVVVPLHTSIGELLVEAEHALRDTYCFFEDFQAESLDGIAGDKWDPVMLGGAESGDTIGVHGHGADMETGLRCQGGADAWEVQCVCGAQDDDGERMVACDACNVWHHTRCVGIADGAPVPPLFLCISCSGALMAAGPISG

SEQ ID NO: 20230 - DNA, 3654 bp, Sorghum bicolor
  misc_feature: Ceres ANNOT ID no. 8633118
  misc_feature: Down-regulated in shoot tissues in response to salicylic acid treatment
  misc_feature: Encodes the peptide sequence at SEQ ID NO 20231
atgctgaccaagttcgagacgaagagcaaccgggtgaagggcctgagtttccacccgcgtcggccatggatcctggcgagtctccacagcggggtgatccagatgtgggactaccgcatgggcaccctcctcgaccgcttcgacgagcacgacgggccggttcgcggcgtccacttccacgccacccagcccctcttcgtctccggaggtgatgattataagattaaggtctggaattacaagacgcaccgctgcctcttcacacttcatgggcaccttgactacattcgcactgtgcaattccatcatgagtacccatggattgtaagtgctagtgacgatcagacaatccgtatctggaactggcaatcacgcacctgtgtggctgtgctgactggacataaccactacgtcatgtgtgcatctttccatcccaaagaagacctggttgtatctgcatcacttgatcagactgtgcgtgtctgggatattggagctctgaggaagaagacagtgtcacctgctgatgacatcctccgtctcacccagatgaacacagatctttttggaggtgttgatgctgtagtgaaatatgtcctcgaaggccatgaccgtggggtcaactgggcctcgtttcatcccactttgccactcattgtttctggggcagatgaccggcaggtgaagctatggagaatgaatgataccaaggcttgggaagttgatactttaaggggccacatgaataatgtgtcttgtgtgatgttccatgcgaagcaagacatcattgtgtccaactcagaagacaaaagcattcgcatttgggatgccacaaagagaactggtattcagacatttagacgggagcatgaccgtttctggattcttgctgctcaccctgaaatgaaccttcttgctgctggtcatgacagtggcatgattgtgttcaaattagagagggaacgcccggccttctgtgttagtggtgacactgttttctatgtgaaggatcggtttctccggttctttgaatacactagccagaaggaagttcaagtggctccaataagaagacctggatcagtcagcttgaaccagtcacccaggacgctgtcctacagcccaactgagaatgctgtcttgatttgctctgatgctgacgggggttcatatgaactctacattgttcccaaggattctgctggcagatctgattacttgcaagaggcaaagaaaggagctggtggttctgctgtttttgtagcacgcaacaggtttgcagtccttgagaagagtagcaatcaagttttggtgaagaatcttaagaatgaaattgtgaagaaaagcccccttcccattgcgactgatgcaatatattatgctgggaccggtaacctgctgtgcaaatctgaagacagggtgaccatctttgatcttcagcaaaggttagttcttggtgagctccagactcctgctgtcaaatatgttgtttggtccagtgacatggaatccgttgcactgctgagcaagcatgcagtggttatagctagcaagaagcttgtccacaggtgcacactgcatgaaaccatccgtgtgaaaagtggtgcctgggatgagaatggtgtgttcatttacactacactgaaccatatgaagtactgtcttcccaatggagacagtgggatcataaaaacccttgatgttcctatttacataacgagggttgttgggaacaacattttctgcttagatcgtgatggaaagaacaagctgattgcagttgatgcatcggagtacattttcaagctcgcccttctcaggaaacgctatgatcatgttatgagtatgattaagaactcccagctgtgtgggcaggctgtgatttcttatttgcaacagaaaggtttcccagaagttgctctacactttgtgaaggatgagaagaccagatttaacctggctctcgagagtggtaacattcaaattgcagttgcttctgcaaaggagatcgatgacaaggatcactggtacaagttgggaattgaggccctgaggcagggaaatgttggtatagtggaatatgcttatcaacgaacaaagaattttgagaggcttgcttttctgtatcttattactggttacttggacaaggtcggcttcatgtgcaaaattgctggacagaacaacaatttgatgggacagttccacaatgcattgtatcttggggatgccaagaagcgtgttgagatcttggagaatgctgggcagatacctcttgcttatgttaccgctgtcactcatgggctcacagaaattgctgagaggcttgctgctgaattaggcgagaatgttccatctctgcctgaaggaaaatcccactcactactgatccctcctgcacctctcacagcgtgtggtgattggccattactgagggtaatgcgcggtattttcgaaggtggactggatgctactggaagggcagatcttgaggaagacgatgaagctgctggtgctgattggggtgatgaagacttggatattgttgatgcaagtgaagtggtggccaatggtgatggttttgatgtagaagagggtgagccaaatgaggaggatggtgaggaaggtggctgggatctggaagatctggaacttccacctgaaactgagactccaaaatctgttggcaatgctcgctccgctgtatttgttgctcctacaccaggtattcctgtcagccaaatttggacccagagatcttctctggctggggagcaagcggctgcagggaactttgacacagcaatgaggttgcttagccgccagttgggtatcaagaactttgttccactgaagcccttgtttcttgacctgcacatgggcagtcatacatatctgcgtgcgcttgccgccgctcctgttatatcagttgcagtagagaaaggttggaatgagtctgcaagtcctaacgtgaggggccctcctgcacttgttttcagcttctcacaaatggaggatagactcaaggctgcctacaaagccacaactgagggaaagttccctgaagcactgagacagttccttagcatcttgcataccattccagttattgtggtggattcacggagagaagttgatgaggtaaaggaattaattgagatagtgagggagtatgttcttggtctgaggatggaactcaagagaaaggaattgagggatgatgtgacccgtcaacaggagttggctgcttacttcacaaactgcaagcttcagagagttcatatgaggcttgtgcttgcaagcgctatggctctttgcttcaagcagaaaaactatgcaactgcaggacactttgcaaggatgcttcttgagaacagccctcaggaggcccaagcaaagaaggctagacaggttctgcaagcttgccaggacaagaacgattctcaccaactgaactatgatttcagaaatccattcgttgtttgtggcgccacatatgttcctatctatcgtggccaaaaggatgtttcctgcccttactgtggatcccgatttgttccttccatcgaagggcagctttgtaccatatgtgagcttgctgcggttggggcagatgcttcaggcctcctctgctcccctacacagtcgagataa

SEQ ID NO: 20231 - protein, 1217 aa, Sorghum bicolor
  misc_feature: Ceres ANNOT ID no. 8633118
  misc_feature: Down-regulated in shoot tissues in response to salicylic acid treatment
  misc_feature (33)..(275): SWISSPROT Homolog: EC 2.7.11.7 [Myosin heavy-chain] kinase
  misc_feature (807)..(1217): Pfam ID: COPI_C Pfam Description: Coatomer (COPI) alpha subunit C-terminus
  misc_feature (337)..(784): Pfam ID: Coatomer_WDAD Pfam Description: Coatomer WD associated region
  misc_feature (125)..(163): Pfam ID: WD40 Pfam Description: WD domain, G-beta repeat
  misc_feature (83)..(121): Pfam ID: WD40 Pfam Description: WD domain, G-beta repeat
  misc_feature (41)..(79): Pfam ID: WD40 Pfam Description: WD domain, G-beta repeat
  misc_feature (194)..(232): Pfam ID: WD40 Pfam Description: WD domain, G-beta repeat
  misc_feature (238)..(276): Pfam ID: WD40 Pfam Description: WD domain, G-beta repeat
MLTKFETKSNRVKGLSFHPRRPWILASLHSGVIQMWDYRMGTLLDRFDEHDGPVRGVHFHATQPLFVSGGDDYKIKVWNYKTHRCLFTLHGHLDYIRTVQFHHEYPWIVSASDDQTIRIWNWQSRTCVAVLTGHNHYVMCASFHPKEDLVVSASLDQTVRVWDIGALRKKTVSPADDILRLTQMNTDLFGGVDAVVKYVLEGHDRGVNWASFHPTLPLIVSGADDRQVKLWRMNDTKAWEVDTLRGHMNNVSCVMFHAKQDIIVSNSEDKSIRIWDATKRTGIQTFRREHDRFWILAAHPEMNLLAAGHDSGMIVFKLERERPAFCVSGDTVFYVKDRFLRFFEYTSQKEVQVAPIRRPGSVSLNQSPRTLSYSPTENAVLICSDADGGSYELYIVPKDSAGRSDYLQEAKKGAGGSAVFVARNRFAVLEKSSNQVLVKNLKNEIVKKSPLPIATDAIYYAGTGNLLCKSEDRVTIFDLQQRLVLGELQTPAVKYVVWSSDMESVALLSKHAVVIASKKLVHRCTLHETIRVKSGAWDENGVFIYTTLNHMKYCLPNGDSGIIKTLDVPIYITRVVGNNIFCLDRDGKNKLIAVDASEYIFKLALLRKRYDHVMSMIKNSQLCGQAVISYLQQKGFPEVALHFVKDEKTRFNLALESGNIQIAVASAKEIDDKDHWYKLGIEALRQGNVGIVEYAYQRTKNFERLAFLYLITGYLDKVGFMCKIAGQNNNLMGQFHNALYLGDAKKRVEILENAGQIPLAYVTAVTHGLTEIAERLAAELGENVPSLPEGKSHSLLIPPAPLTACGDWPLLRVMRGIFEGGLDATGRADLEEDDEAAGADWGDEDLDIVDASEVVANGDGFDVEEGEPNEEDGEEGGWDLEDLELPPETETPKSVGNARSAVFVAPTPGIPVSQIWTQRSSLAGEQAAAGNFDTAMRLLSRQLGIKNFVPLKPLFLDLHMGSHTYLRALAAAPVISVAVEKGWNESASPNVRGPPALVFSFSQMEDRLKAAYKATTEGKFPEALRQFLSILHTIPVIVVDSRREVDEVKELIEIVREYVLGLRMELKRKELRDDVTRQQELAAYFTNCKLQRVHMRLVLASAMALCFKQKNYATAGHFARMLLENSPQEAQAKKARQVLQACQDKNDSHQLNYDFRNPFVVCGATYVPIYRGQKDVSCPYCGSRFVPSIEGQLCTICELAAVGADASGLLCSPTQSR

SEQ ID NO: 20232 - DNA, 1830 bp, Sorghum bicolor
  misc_feature: Ceres ANNOT ID no. 8633170
  misc_feature: Down-regulated in shoot tissues in response to methyl jasmonate treatment
  misc_feature: Down-regulated in shoot tissues in response to salicylic acid treatment
  misc_feature: Encodes the peptide sequence at SEQ ID NO 20233
atggcttcttccctcgcgcccgcgtcgtgggtgctgctgctgcagacgggcggtgctggggcggcagcggcggggccttcctcctgccgcttgatgctcgccgtcgcggagccccgctgccgctgggcagcgtcgccgcgccgggcaagggtgctcgtggcgccccggtgcgcggcgctcgactggcccggcggcagcggcgaggaggaggccaagatcgaggacgagaggaagaagaagccggcgcgcggccgaccggtgtggaggcggatcctgttcgcctccaagaagacacgaagcatcatcatcctcaacgccctcacggtcatctatgcaagtgatattccggttctgaaagaggtcgaagccctgacagagcctgcggtcttcaacatggtgcggttcgttgttgcagccatccccttcgtgccattcgcggtccgtgcctttggggaccgccgtgtacgctatgcaggactggagctgggagtctgggttagcttaggttacctttctcaagcaattggattgctctcatctgatgctggccgagcatccttcatcacggccatcacggtcatagttgtgcctctaattgatggccttcttggtgcctcgatccccaaactcacttggttcggagccatcatgtcactatttggaatcggcctgctggaatgtggcggctctcctccctgcgttggtgatattttgaacttcttcagcgccgtgttttttgggatccatatgcttagaacagagcaaatatcaaggagtacggacaagaagaagtttctagctcttcttagcttcgaggtccttgtggtcgctttctcttctgttctctggtgtatgttcaaagacggctatgttgatactagtgaatccagctttgactcttggactttcggtatgctttgggatacagcagcttcatttccttggataccagcattgtacactggagttctttctacggtgttatgcatgtgggcagagctggtagcgatgggcgatgtttcagcaactgaaactgcaattgtttacggcttggagccagtttggggagctgcttttgcttggttcctccttggtgaaagatgggataacaccacatgtattggagctgcccttgtattatgtggcagtttgactgttcagctatttgggtcagctcctaagaagtacaagaaagttaaaaaacgcagcagcaatgctttagaaacgccagtgaaacaacaagactacttatcgttatctcctataccagttgattcggggaagttcataggaaggcaattagaaagtccagctcagctacgggcgtattataagcccccccaggccccagccgtctccatcgtccggcctgattatgccgcgaacggggtccccgaaccacgattttctctgctgcggaagctcagggcagcgtgggcgtatgggacgcgagagcgacgtgccgctttttttcaattggccgttaggcggccggccggcggggccctggcccccgcaacggcagcgcccggcccccgttcgttcggttcggttcgttttccttccccatcccgggacgctggcccccatcggcacgttctcccgccccccgcccgtccccagttccacttccagtcctcgattcccctcgaccagaattcggaattccccgtgcaggcgcgagattttttagattttctttctttttgggtttccgccgcgtcgtcgcgcgcgcggccgggagaacagcatcatggacggctggacgccttgttttgccgcgacgggccgatcggaggacagtggtgggtgaagaatttcggcgcgtga

SEQ ID NO: 20233 - protein, 609 aa, Sorghum bicolor
  misc_feature: Ceres ANNOT ID no. 8633170
  misc_feature: Down-regulated in shoot tissues in response to methyl jasmonate treatment
  misc_feature: Down-regulated in shoot tissues in response to salicylic acid treatment
MASSLAPASWVLLLQTGGAGAAAAGPSSCRLMLAVAEPRCRWAASPRRARVLVAPRCAALDWPGGSGEEEAKIEDERKKKPARGRPVWRRILFASKKTRSIIILNALTVIYASDIPVLKEVEALTEPAVFNMVRFVVAAIPFVPFAVRAFGDRRVRYAGLELGVWVSLGYLSQAIGLLSSDAGRASFITAITVIVVPLIDGLLGASIPKLTWFGAIMSLFGIGLLECGGSPPCVGDILNFFSAVFFGIHMLRTEQISRSTDKKKFLALLSFEVLVVAFSSVLWCMFKDGYVDTSESSFDSWTFGMLWDTAASFPWIPALYTGVLSTVLCMWAELVAMGDVSATETAIVYGLEPVWGAAFAWFLLGERWDNTTCIGAALVLCGSLTVQLFGSAPKKYKKVKKRSSNALETPVKQQDYLSLSPIPVDSGKFIGRQLESPAQLRAYYKPPQAPAVSIVRPDYAANGVPEPRFSLLRKLRAAWAYGTRERRAAFFQLAVRRPAGGALAPATAAPGPRSFGSVRFPSPSRDAGPHRHVLPPPARPQFHFQSSIPLDQNSEFPVQARDFLDFLSFWVSAASSRARPGEQHHGRLDALFCRDGPIGGQWWVKNFGA

SEQ ID NO: 20234 - DNA, 2157 bp, Sorghum bicolor
  misc_feature: Ceres ANNOT ID no. 8633185
  misc_feature: Down-regulated in shoot tissues in response to aminocyclopropane carboxylic treatment
  misc_feature: Down-regulated in shoot tissues in response to methyl jasmonate treatment
  misc_feature: Encodes the peptide sequence at SEQ ID NO 20235
atgatcgccgccggcagcgctggcggcgaggagacggcggaaggtgcggtggtggagaagacgctgctcaacggcgacgtctaccgcggcgggttctccggcggctcgccgcacggcaagggcaagtacgtgtgggcggacggctgcatgtacgagggggagtggcggcggggcaaggcgtccgggaagggccgcttctcgtggccgtcgggcgccacgttcgagggggagttccgcagcggacggatcgaggggcagggcgtcttcgtcggccccgacggcgcaacctaccgcggcgcgtgggtggcggaccggcgccacggcgtgggcgcaaagagctacgccaacggggactactacgagggccagtggcgccgcaacttccaggacggccacgggcgctacgtctgggccaacggcaaccagtacgtcggggagtggcgcgccggggtgctctccggccgcggcgtgctgatctgggccaatggcagccgctacgacggggtctgggagaacggcgtccccagggggacaggcgtcttcacgtggcccgacggcagccggtacgtcggctcctggcctgggagctgcgtcgacctgccggctataagcggcacgttcttcgcgccagtcggcgctggggctactggtcttgtgaggaagaggtcctccgtggagggtgtgggggagaaggctaccccgcggatctgcatctgggagtcggagggcgaggccggagacatcacctgcgacatcgttgacgcgctcgaggcgtccgtgctctacaaggaggccgccgctgtcgccgggggaccaacgtacatgcggaaactaccgcagaggaatacccggcgagcagccagcggaatcccacgctgggcttcgtcggcggccaccacgccggagagtaagcgacccgggcagacgatctccaagggacacaagaactacgagctcatgctgcagctgcaactgggtatcaggcattccgtgggaaagtcttccgctgttccgatgcgagcactggaacagggcgattttgacccaggggagaagttctggacacggttcccaccagagggttcgaaggtcacactaccacattcaactgcagagttccggtggaaggactactgccccatggtgttcaggcatttgaggaagttgtttgctgttgatacagcggattacatgcttgcgatctgtggcaatgatgctctgagggagctgtcttcacccggaaagagtgggagcttcttttaccttacccaagatgaccggttcatgattaagactgtgaagaaatcagaagtcaagctgctaattcgaatgttaaatagctactacaaacatgtcaatcgatacaagaactcgttaatcacgagattctatggtgtacactgtgtgaagccccttaacggacaaaaggtccgattcattgtcatgggtaatctgttctgttcagaataccagattcatcgccgttttgatttgaaaggttcatcctatggacgaacagcagacaagtttgaagatgagattgatgagacaactacactgaaggacttggacctcaattttgtcttccggttgcagcgatcttggtacaccgatctccatgaacaactgagacgagactgcgattttttggaatcggaagggattatggattacagtttcttagtaggagttcacttttgtgatgacatctctgcctcaaagatgggatcgtctacttttactgcttctccaaagcttttaacaaagagtgagtcatttcaaggttgtggcacgccagagctctgcttctcggatgatgactttgatatcattcctgattgccgtcggaaacctttgattagactgggtgcacacatgccagccagggcagagcaagcatccagaaggagtgaatttgatccgcttctccttaccggcgggggattcctattcccaaaccagaccggtgaagtacacgacgtgattctctttttcgggataattgacatcctccaggattacagctttagaaagtgggctgagcatacttacaagtcgttacagacagatcccaactcgatctctgccgtggacccaaagctctactcgaagaggtttcaagacttcatcggcagaatttttgtggaagatggctaa

SEQ ID NO: 20235 - protein, 718 aa, Sorghum bicolor
  misc_feature: Ceres ANNOT ID no. 8633185
  misc_feature: Down-regulated in shoot tissues in response to aminocyclopropane carboxylic treatment
  misc_feature: Down-regulated in shoot tissues in response to methyl jasmonate treatment
  misc_feature (20)..(640): SWISSPROT Homolog: EC 2.7.1.68 1-phosphatidylinositol-4-phosphate 5-kinase
  misc_feature (399)..(714): Pfam ID: PIP5K Pfam Description: Phosphatidylinositol-4-phosphate 5-Kinase
  misc_feature (51)..(73): Pfam ID: MORN Pfam Description: MORN repeat
  misc_feature (120)..(142): Pfam ID: MORN Pfam Description: MORN repeat
  misc_feature (143)..(165): Pfam ID: MORN Pfam Description: MORN repeat
  misc_feature (166)..(188): Pfam ID: MORN Pfam Description: MORN repeat
  misc_feature (28)..(50): Pfam ID: MORN Pfam Description: MORN repeat
  misc_feature (74)..(96): Pfam ID: MORN Pfam Description: MORN repeat
  misc_feature (97)..(119): Pfam ID: MORN Pfam Description: MORN repeat
MIAAGSAGGEETAEGAVVEKTLLNGDVYRGGFSGGSPHGKGKYVWADGCMYEGEWRRGKASGKGRFSWPSGATFEGEFRSGRIEGQGVFVGPDGATYRGAWVADRRHGVGAKSYANGDYYEGQWRRNFQDGHGRYVWANGNQYVGEWRAGVLSGRGVLIWANGSRYDGVWENGVPRGTGVFTWPDGSRYVGSWPGSCVDLPAISGTFFAPVGAGATGLVRKRSSVEGVGEKATPRICIWESEGEAGDITCDIVDALEASVLYKEAAAVAGGPTYMRKLPQRNTRRAASGIPRWASSAATTPESKRPGQTISKGHKNYELMLQLQLGIRHSVGKSSAVPMRALEQGDFDPGEKFWTRFPPEGSKVTLPHSTAEFRWKDYCPMVFRHLRKLFAVDTADYMLAICGNDALRELSSPGKSGSFFYLTQDDRFMIKTVKKSEVKLLIRMLNSYYKHVNRYKNSLITRFYGVHCVKPLNGQKVRFIVMGNLFCSEYQIHRRFDLKGSSYGRTADKFEDEIDETTTLKDLDLNFVFRLQRSWYTDLHEQLRRDCDFLESEGIMDYSFLVGVHFCDDISASKMGSSTFTASPKLLTKSESFQGCGTPELCFSDDDFDIIPDCRRKPLIRLGAHMPARAEQASRRSEFDPLLLTGGGFLFPNQTGEVHDVILFFGIIDILQDYSFRKWAEHTYKSLQTDPNSISAVDPKLYSKRFQDFIGRIFVEDG

SEQ ID NO: 20236 - DNA, 2274 bp, Sorghum bicolor
  misc_feature: Ceres ANNOT ID no. 8633277
  misc_feature: Down-regulated in root tissues in response to salicylic acid treatment
  misc_feature: Encodes the peptide sequence at SEQ ID NO 20237
atggcgcggctcgcgtggacgcgcctccccaccgctgacggggaggaggcaggcccctccacttccgcggcggcggactatgagctcttatccgccgccgccatcgagagcctcgactacgaggtcatcgagaactacgcgtaccgggaggagcaggcgcagcggagcaagttctgggtgccctactacgtcatgctcaagtggctgttctctctgctgatcggcgttggtactggattagctgctatattcataaacctggctgttgagaacttctctggatggaaatatactgcgacatttgctataataaagcattcatattttgtgggattcttcgtgtacacagttttcaatttagccctggtcttctcttctgtatatatagtcacaaactttgctccagcagctgctggatctggtattccagagatcaaaggttacttaaatggagtggatacacctggaatcctccttttgaggacattagttgggaagatatttgggagcattggatcagttggaggtggattggctctagggaaagaagggcctcttgttcatactggggcctgcattgcttcgcttcttggacaaggtggatctgcaaagtaccacttgaattctaggtgggtacggatttttgaaagcgatcgtgataggcgagaccttgtgacatgtggatgtgcagctggagttgctgcagccttcagagctcctgttggtggggtactatttgccttggaggaagttacatcctggtggagaagtcatcttatgtggagagtattcttcacatctgctgtggtggccgttgttgtgcgttcagccatgaattggtgcaacagtggaaaatgtggtcattttggagctggaggttttataatctgggacatatctggaggtcaagaagattactcatatcaggaactgttccctatggcaattattggtgttattggtggacttcttggggcattatttaaccaacttaccctgtatataactaaatggcggcgaacatatcttcataagaaagggaaacgagtccaaatctttgaagcctgccttatatctttggtaacatccacaatttcctttgtgttgccattactgaggaaatgcagtccatgccctcagttagaaactaattctggcatagaatgccctcatccacctggcacagatgggaattttgttaatttctattgttcaaaagatagagagtacaatgatctagcaaccattttcttcaatactcaggatgatgcaatacgtaatcttttcagtgcaaaaacattccatgaatacagtgcacaaagcttgattaccttcctggtcatgttttattccttagctgttgtgacatttggaactgcagttccggctggccagtttgtcccaggaataatgattggatctacatatggaaggcttgttggaatgtttgttgtcaagttctataagaaactaaacatcgaggagggcacgtatgcactccttggtgctgcatcctttcttggaggttcaatgagaatgactgtatctttatgtgttatcatggttgagattacgaacaacttgcaactcttgccattgatcatgcttgttcttctagtttctaaggcggttggtgacttctttaacgaagggttatatgaagagcaagcccgattaaggggcatccctctactggactccaggcctaagcaagttatgagaaatatgactgcaaaggatgcgtgcaagaatcaaaaggttgtctgcctaccacgtgtttcaaggattgttgatatcgtttccgttttgcgtaccaacaagcataatggtttccctgttgttgaccgtgggcagaatggtgagccacttgtcataggtctcatacttcgtagccacttattggtacttctacaagcgaaagtagatttccagaacagtcctttcccatgtggaccaggcgtactgaacaggcacaattttagtgactttgttaaaccagcatcaagtaaaggaaagtcaattgatgatattcatttgacagaggatgaactggggctgtatttggatcttgccccatttttaaatccttcaccatacatagtgccagaggacatgtcattggcaaaggtgtacaatctcttccgtcagcttggattgagacatatatttgttgttcctaggccttctcgtgttgtaggattgataaccagaaaagatttattacttgaggtgataagttatacttttagcttaagagttgaggaatatacgtaa

SEQ ID NO: 20237 - protein, 757 aa, Sorghum bicolor
  misc_feature: Ceres ANNOT ID no. 8633277
  misc_feature: Down-regulated in root tissues in response to salicylic acid treatment
  misc_feature (121)..(547): Pfam ID: Voltage_CLC Pfam Description: Voltage gated chloride channel
  misc_feature (581)..(745): Pfam ID: CBS Pfam Description: CBS domain pair
MARLAWTRLPTADGEEAGPSTSAAADYELLSAAAIESLDYEVIENYAYREEQAQRSKFWVPYYVMLKWLFSLLIGVGTGLAAIFINLAVENFSGWKYTATFAIIKHSYFVGFFVYTVFNLALVFSSVYIVTNFAPAAAGSGIPEIKGYLNGVDTPGILLLRTLVGKIFGSIGSVGGGLALGKEGPLVHTGACIASLLGQGGSAKYHLNSRWVRIFESDRDRRDLVTCGCAAGVAAAFRAPVGGVLFALEEVTSWWRSHLMWRVFFTSAVVAVVVRSAMNWCNSGKCGHFGAGGFIIWDISGGQEDYSYQELFPMAIIGVIGGLLGALFNQLTLYITKWRRTYLHKKGKRVQIFEACLISLVTSTISFVLPLLRKCSPCPQLETNSGIECPHPPGTDGNFVNFYCSKDREYNDLATIFFNTQDDAIRNLFSAKTFHEYSAQSLITFLVMFYSLAVVTFGTAVPAGQFVPGIMIGSTYGRLVGMFVVKFYKKLNIEEGTYALLGAASFLGGSMRMTVSLCVIMVEITNNLQLLPLIMLVLLVSKAVGDFFNEGLYEEQARLRGIPLLDSRPKQVMRNMTAKDACKNQKVVCLPRVSRIVDIVSVLRTNKHNGFPVVDRGQNGEPLVIGLILRSHLLVLLQAKVDFQNSPFPCGPGVLNRHNFSDFVKPASSKGKSIDDIHLTEDELGLYLDLAPFLNPSPYIVPEDMSLAKVYNLFRQLGLRHIFVVPRPSRVVGLITRKDLLLEVISYTFSLRVEEYT

SEQ ID NO: 20238 - DNA, 2022 bp, Sorghum bicolor
  misc_feature: Ceres ANNOT ID no. 8633286
  misc_feature: Up-regulated in root tissues in response to salicylic acid treatment
  misc_feature: Down-regulated in shoot tissues in response to salicylic acid treatment
  misc_feature: Encodes the peptide sequence at SEQ ID NO 20239
atggcgaccacgaccttccccacctcgaccccattcttcgcggcgcaccaccagggcccccgccggagccagccctccatctccgccgcggtctacggcggccgcggccgcaggtggcgcccgctgcgggtagcgtgcgagaaggtggtgggcatcgacctggggaccaccaactccgcggtggccgctatggagggcggcaagcccacgatcgtgaccaacgccgagggggcgcggaccacgccctcggtggtggcgtacaccaagtccggcgaccgcctcgttggccagatcgccaagcgccaggccgtggtcaacccggagaacaccttcttctccgtcaagcgcttcatcggccgcaagatgaacgaggtcgacgaggagtccaagcaggtctcgtatcgcgtcatgagggacgacaacggcaacgtcaagctcgattgcccggcgattggcaagcagttcgcagctgaggagatctccgcgcaggtgctgagaaagctggtggatgatgcatcaaagtttttaaatgacaaggtcacaaaggcagtgatcacagttcctgcttacttcaacgactcgcagaggacagcaaccaaagatgctggccgcattgctgggctggaggttctacgtattataaatgagcctaccgcagcatcgctagcatatggttttgagaaaaagaacaatgaaacaattctggtttttgaccttggaggtggcaccttcgacgtttcagttcttgaagttggtgatggtgtttttgaggtgctgtctacatcgggtgacactcaccttggtggtgatgactttgacaagagaattgtcgattggctcgctggaaacttcaagaatgatgagggtattgacttgcttaaagataagcaagctctgcagcgattgacagaagcagcggagaaggcgaagatggaactgtcatctttgacccaaacaaacataagcttgccttttattacagctactgcagatggccccaagcatattgagaccactcttaccagggctaaatttgaagagctatgctcagatctccttgacaggctgaggacccctgtggacaatgcccttagagatgcaaagttgcaattcaaagatattgatgaggttattcttgtcggtggctcaactagaataccagctgttcaggagcttgtcaagaaaatgacaggaaaggatcccaatgtgacggtcaaccctgatgaggttgttgcacttggagcagctgtgcaggctggagttttgtctggtgatgttagcgacattgtccttcttgatgtgacccccttgtcccttggtttggagacactgggtggtgttatgaccaagattatcccacggaatacaacattgcctacctcaaagtcggaagttttctcaacggctgctgatggccagactagtgtggagatcaatgttctccaaggagaaagagatttcttccggcttgatggaatccctcctgccccacgtggtgttccacagatcgaagtcaagtttgatattgatgctaacggtatcctttctgtcactgctgtggacaagggtacagggaagaagcaggatattacaattactggtgccagcactctgccaaaagacgaggtggagaggatggttgacgaagctgagaagtttgcaaaggaggataaggagaagagagatgccattgacaccaagaaccaagccgagtcggtcatctaccagaccgagaagcaactgaaggaactaggggacaaggtcccaggtgaagtcaagggaaaggtggagtcaaagctgcaagagctcaaggatgctgttgctggtggctccacacagacgatgaaggatgccatcagtgcattgaaccaggaagtcatgcagattgggcagtccctctacagccagcagggtgccccaggcgcaggacctgcccctggtgctgatgcttctgctggctcagctgagaagccaggcgacgaaggcgatgtaattgatgcagattttactgacagcaagtga

SEQ ID NO: 20239 - protein, 673 aa, Sorghum bicolor
  misc_feature: Ceres ANNOT ID no. 8633286
  misc_feature: Up-regulated in root tissues in response to salicylic acid treatment
  misc_feature: Down-regulated in shoot tissues in response to salicylic acid treatment
  misc_feature (49)..(635): Pfam ID: HSP70 Pfam Description: Hsp70 protein
MATTTFPTSTPFFAAHHQGPRRSQPSISAAVYGGRGRRWRPLRVACEKVVGIDLGTTNSAVAAMEGGKPTIVTNAEGARTTPSVVAYTKSGDRLVGQIAKRQAVVNPENTFFSVKRFIGRKMNEVDEESKQVSYRVMRDDNGNVKLDCPAIGKQFAAEEISAQVLRKLVDDASKFLNDKVTKAVITVPAYFNDSQRTATKDAGRIAGLEVLRIINEPTAASLAYGFEKKNNETILVFDLGGGTFDVSVLEVGDGVFEVLSTSGDTHLGGDDFDKRIVDWLAGNFKNDEGIDLLKDKQALQRLTEAAEKAKMELSSLTQTNISLPFITATADGPKHIETTLTRAKFEELCSDLLDRLRTPVDNALRDAKLQFKDIDEVILVGGSTRIPAVQELVKKMTGKDPNVTVNPDEVVALGAAVQAGVLSGDVSDIVLLDVTPLSLGLETLGGVMTKIIPRNTTLPTSKSEVFSTAADGQTSVEINVLQGERDFFRLDGIPPAPRGVPQIEVKFDIDANGILSVTAVDKGTGKKQDITITGASTLPKDEVERMVDEAEKFAKEDKEKRDAIDTKNQAESVIYQTEKQLKELGDKVPGEVKGKVESKLQELKDAVAGGSTQTMKDAISALNQEVMQIGQSLYSQQGAPGAGPAPGADASAGSAEKPGDEGDVIDADFTDSK

SEQ ID NO: 20240 - DNA, 759 bp, Sorghum bicolor
  misc_feature: Ceres ANNOT ID no. 8633306
  misc_feature: Up-regulated in root tissues in response to methyl jasmonate treatment
  misc_feature: Up-regulated in shoot tissues in response to methyl jasmonate treatment
  misc_feature: Encodes the peptide sequence at SEQ ID NO 20241
atgtctccactgctccgccgcgtccttctcctcgccctcgccgccgccgtcgcggccacggcgtccgccgcgtcgctgaacggcgcggcgaacgacctgctccccaagtacggcctcccgaaggggctcatcccggactccgtggcctcctacagctttgacgaggccacgggcgccttcgagatccacctcgccagcacctgttacgtccacttcggctcccacctcgtctactacgagaggaccataacgggcaagctctccgagggcgccatctcggacctctccggcgtccaggccaagaagctcttcctctgggtctacgtcacggggatggtcgcgcaccccgaccagggcaccatcgagttccaggccggattcatctcggagtctctgtcggcctcgatgtttgacgatgtgcccacctgcggttccagcgtcggtgcgcagctgcgcggcgcggctggggtgatcggggagcttgggctgctccccgttgcgcagctggatcttagtgtacagcatgctcatgagtccaatgatggagccaacaggagccagccactggttgccctaatgaactgtactgccaaatgttcactaacttctagagttctaggagatgggactcttgaaaattcttttccattttttggctatgtatggaaagagagaaataaaatgactacaattttaagtattagcttaattttgttaggtctaggtgcatttcttcttttagtattcaaggttctttaa

SEQ ID NO: 20241 - protein, 252 aa, Sorghum bicolor
  misc_feature: Ceres ANNOT ID no. 8633306
  misc_feature: Up-regulated in root tissues in response to methyl jasmonate treatment
  misc_feature: Up-regulated in shoot tissues in response to methyl jasmonate treatment
MSPLLRRVLLLALAAAVAATASAASLNGAANDLLPKYGLPKGLIPDSVASYSFDEATGAFEIHLASTCYVHFGSHLVYYERTITGKLSEGAISDLSGVQAKKLFLWVYVTGMVAHPDQGTIEFQAGFISESLSASMFDDVPTCGSSVGAQLRGAAGVIGELGLLPVAQLDLSVQHAHESNDGANRSQPLVALMNCTAKCSLTSRVLGDGTLENSFPFFGYVWKERNKMTTILSISLILLGLGAFLLLVFKVL

SEQ ID NO: 20242 - DNA, 687 bp, Sorghum bicolor
  misc_feature: Ceres ANNOT ID no. 8633329
  misc_feature: Up-regulated in shoot tissues in response to methyl jasmonate treatment
  misc_feature: Encodes the peptide sequence at SEQ ID NO 20243
atggccgccgccgccctccgttcctccgccgcacgccggctcctgcgcctcgccccggcagcctcgtcggctctgtccgctgcttcccggcccaccgccggggttgcgccgctctcgcgccccttcgccgcgctctcaggtggcaacaatcctatctcatggaaactgagacgcttcttcagttcaaatgaaaagcacttgcctgcaatatctgatccagagatagaatctgcatttaaggacttgttggctgctagttggaatgaacttccagattctctcgtagaggaagcaaagaaagcagtatctaaagccaccgatgacaatgctggtcaagaggctttgaaaaatgtatttcgtgcagctgaggcatgtgaagaatttagtggaaccttggttaccctaagaatggctcttgatgatctttgtggcctgactggtgaaaatgtgggtcccttgcctggttatattgaagatgctgttaaagctgcatataatcgctacatgacatatctggagtcctttggccctgaggaaaattatctaagaaagaaggtggagactgagttggggacaaaaatgatacacctcaaaatgagatgcagtggcataggttctgaatggggaaagatctccctgattggcacctcagggatctcaggttcctacgttgagctaagggcatga

SEQ ID NO: 20243 - protein, 228 aa, Sorghum bicolor
  misc_feature: Ceres ANNOT ID no. 8633329
  misc_feature: Up-regulated in shoot tissues in response to methyl jasmonate treatment
MAAAALRSSAARRLLRLAPAASSALSAASRPTAGVAPLSRPFAALSGGNNPISWKLRRFFSSNEKHLPAISDPEIESAFKDLLAASWNELPDSLVEEAKKAVSKATDDNAGQEALKNVFRAAEACEEFSGTLVTLRMALDDLCGLTGENVGPLPGYIEDAVKAAYNRYMTYLESFGPEENYLRKKVETELGTKMIHLKMRCSGIGSEWGKISLIGTSGISGSYVELRA

SEQ ID NO: 20244 - DNA, 1377 bp, Sorghum bicolor
  misc_feature: Ceres ANNOT ID no. 8633341
  misc_feature: Up-regulated in root tissues in response to methyl jasmonate treatment
  misc_feature: Encodes the peptide sequence at SEQ ID NO 20245
atggccacctccccagccgcctcgtcctcttccgctccgaccgcctccgccgccgctgcggccacgatggctgccgaggccaccgacgggccggtgctcagcgtagtatcgaagcgtctccgcgcgctgcggaagaagtacaaccgcatcacgcagatggaggagtcgctcgccgccggcaagacgctcaaccgagagcaggaggaggttctccgctccaagcccgtcgtcgccgccctgatcgacgagcttgagcgcctccgccccccgctcgcatccgccgtcgcggaggagctctcctcccgccccgcccccgcccctgcccctgcccccgccgccgccgcttcctcctccgactcagattcgtcagtccaggacctcctcgcgctcatctacttcggctccctcttcgacgtcaagcagcaaagcgacttcgtctctttggtttacgcgagcgagctcgagcggagcagctgcatcacttatgactacgtcggggatgatccggaggacagtctcgcggagaccgatctgaacgcggtttctgcccttgcctccctcgccgcgtcgcgccctccagctgcagccggagtctcgcaccgtgacgcccttcaggcttgtgcccatcacgcccgcctctggctccgccgtgcggatgaacccatccaccctgactccaccgtcacatatgctggggtgagggcaaagctggataggatcatggcatcgggctactacacagctcagctagaaatgaggccaccattggatctggctgctgcagtggcaagctttggagctggaggtgctcagatgcaggagagtatggttgtgtcgcctcaggcaccggaagcagttgaggagaacccagctgttgaaggacacaaggctactgaaatctacagtgaccatcaggctcctgttgttgatgctgaacatgtggaggatgaaggcctggtgaatccaactgatgaggttccttcagctgaggcagagcaggagacatttgatgctgatgtggaggatcaggaacaaaaagaccaacaattcacccagcggcggtcttaccagaaccagcgtgggggtggtggtcgtggtggcggcaggaggggctatcctaatggtcgtggagggcgtggtggccgaggcggtgggtaccagaacggccgtggcggtggtggataccagaacggccgtggcggaggcggtgggtactactatgaatctggatactaccagccgaggaactacaacaacaacagaggccggggtggtcgctctggcggtggcaactcttactacaacaaccatggtggaggtgcacagggaggcggccatggcaatcctgggagggttgagcttggtgcaaacgcctag

SEQ ID NO: 20245 - protein, 458 aa, Sorghum bicolor
  misc_feature: Ceres ANNOT ID no. 8633341
  misc_feature: Up-regulated in root tissues in response to methyl jasmonate treatment
MATSPAASSSSAPTASAAAAATMAAEATDGPVLSVVSKRLRALRKKYNRITQMEESLAAGKTLNREQEEVLRSKPVVAALIDELERLRPPLASAVAEELSSRPAPAPAPAPAAAASSSDSDSSVQDLLALIYFGSLFDVKQQSDFVSLVYASELERSSCITYDYVGDDPEDSLAETDLNAVSALASLAASRPPAAAGVSHRDALQACAHHARLWLRRADEPIHPDSTVTYAGVRAKLDRIMASGYYTAQLEMRPPLDLAAAVASFGAGGAQMQESMVVSPQAPEAVEENPAVEGHKATEIYSDHQAPVVDAEHVEDEGLVNPTDEVPSAEAEQETFDADVEDQEQKDQQFTQRRSYQNQRGGGGRGGGRRGYPNGRGGRGGRGGGYQNGRGGGGYQNGRGGGGGYYYESGYYQPRNYNNNRGRGGRSGGGNSYYNNHGGGAQGGGHGNPGRVELGANA

SEQ ID NO: 20246 - DNA, 2253 bp, Sorghum bicolor
  misc_feature: Ceres ANNOT ID no. 8633538
  misc_feature: Up-regulated in shoot tissues in response to methyl jasmonate treatment
  misc_feature: Encodes the peptide sequence at SEQ ID NO 20247
atgtcgaaggcgaagaccaataatggttatcttggagtcactgagccaatctcgctgagtggaccgactgataaggaccttatgcagacaactgaggttgaaaagtacctttcagacgcaggactctatgagagccaagatgaggctgtcttgcgagaagaggttttaggaaagctggaccagactgtgaaagcttggattaagaaggccactaggatcagcgggtatggggagcaatttgtgcatgaagcaaatgcaaagatctttacatttggttcataccgtcttggggtacatggccctggtgccgacattgacaccctatgtgttggtccaagacatgcaactcgaaacgagtacttcttcagatggcttcacgatatgttagctgagatgccagaagtttccgagttacatccagtaccagatgctcatgtgcctgttctggggttcaaaattaatggggtctctattgaccttctgtatgctaatcttgctcatgcagtgattcctgaggacctagatctttctcaggactccatactgaataatgtcgatgaacagactgttcgtagtctaaatgggtgtcgggttactgatcaaattctaagattggttccaaacattctgagttttcgcacaaccttaagattcataagatattggggcaagcgccgtggggtttactcaaatgttatgggatttctgggtggtataaactgggcaatccttgttggtcgcatctgtcaactgtacccaaatgcatcaccgagcatgttgatatctcgttttttccgagtctacagcaaatggaagtggcctaatcctgttatgctttgccatattgaggagggttatcttggtctccctgtgtgggatccaagaagaaattacagagacaggggccaccaaatgcctattattacacctgcttacccatgcatgaattccagctacaatgtatctgttagtactaggtatgtgatgacccaagaattcacgcgagcgtttgagatttgtcaggccatagatgaaggaaaagcagactgggatgcattgtttgagccatatccattttttgaatcatataaaaactatctagaagttaatatcacagcaagaaatgaagatgaactcaggagttggaaaggctgggtggaatctcgccttcgcactcttgtattaaagattgagcgatattcacatgagatgattcttgcacacccttatcccaaagatttctcagacaaatccaggcccttacattgcttttacttcatgggtctttggagaaaacaaaccacccaaactcaggaagctgagcaatttgacatcaggggaattgtaaatgagtttaagaatactatttgtgcatatcaacagtggaaagaaggaatggacattgaagtgtctcatgtaaaaagaaaagaaatccctttgtttgtttttcctggtggagtgcgtccttctcgttcttctagaacagcacacaagaacagccgtactgttccaacatgtgatgtttcagctgatgatcaggtgggaaacctattgggcgttgccagttgtagtgatgctcaacctgtatcatgtaaaggcagctatatgaaacaaccagaaccagattgtgctggaggctttcagttgccgggaagtacttctgtgttgccccctagcttacccaataaagtagctttgaatgggtctgctaattttcatgcagaatctgttgagcatgaacatccagaacactatcaggaaagcaagtttgcgactgtgcagaatgctgtgcgcaatgtagtcaagcaacctaacagtttgctgccaaattcaaacaacgcttggcaattgtatggatctgattcctctcttaacaattcacaaagggaatgtgcaggcagtgctgcaaacaacttgctgaacttatccccagctattctagccacacctgatgaacttgatgagctggtatcccatcatcaagttaaagttaatcagaaagatgtaaatgctgaccggaggccatctttggagatcggttctgaaaataacttggaacaagtatccagtctgaggccccaggattctaataataatctgaagcgcaaagccaatcaagagctcgagccacttgagcttgccgctccatccactggtgctgcgccgcaatcgacagcatctgccccaagaaagccactcagattgaggctgacgactttgggcaaaccaaagccagctgaaggaacttcctga

SEQ ID NO: 20247 - protein, 750 aa, Sorghum bicolor
  misc_feature: Ceres ANNOT ID no. 8633538
  misc_feature: Up-regulated in shoot tissues in response to methyl jasmonate treatment
  misc_feature (10)..(696): SWISSPROT Homolog: EC 2.7.7.19 Polynucleotide adenylyltransferase
  misc_feature (8)..(357): Pfam ID: PAP_central Pfam Description: Poly(A) polymerase central domain
  misc_feature (358)..(493): Pfam ID: PAP_RNA-bind Pfam Description: Poly(A) polymerase predicted RNA binding domain
MSKAKTNNGYLGVTEPISLSGPTDKDLMQTTEVEKYLSDAGLYESQDEAVLREEVLGKLDQTVKAWIKKATRISGYGEQFVHEANAKIFTFGSYRLGVHGPGADIDTLCVGPRHATRNEYFFRWLHDMLAEMPEVSELHPVPDAHVPVLGFKINGVSIDLLYANLAHAVIPEDLDLSQDSILNNVDEQTVRSLNGCRVTDQILRLVPNILSFRTTLRFIRYWGKRRGVYSNVMGFLGGINWAILVGRICQLYPNASPSMLISRFFRVYSKWKWPNPVMLCHIEEGYLGLPVWDPRRNYRDRGHQMPIITPAYPCMNSSYNVSVSTRYVMTQEFTRAFEICQAIDEGKADWDALFEPYPFFESYKNYLEVNITARNEDELRSWKGWVESRLRTLVLKIERYSHEMILAHPYPKDFSDKSRPLHCFYFMGLWRKQTTQTQEAEQFDIRGIVNEFKNTICAYQQWKEGMDIEVSHVKRKEIPLFVFPGGVRPSRSSRTAHKNSRTVPTCDVSADDQVGNLLGVASCSDAQPVSCKGSYMKQPEPDCAGGFQLPGSTSVLPPSLPNKVALNGSANFHAESVEHEHPEHYQESKFATVQNAVRNVVKQPNSLLPNSNNAWQLYGSDSSLNNSQRECAGSAANNLLNLSPAILATPDELDELVSHHQVKVNQKDVNADRRPSLEIGSENNLEQVSSLRPQDSNNNLKRKANQELEPLELAAPSTGAAPQSTASAPRKPLRLRLTTLGKPKPAEGTS

SEQ ID NO: 20248 - DNA, 1446 bp, Sorghum bicolor
  misc_feature: Ceres ANNOT ID no. 8633584
  misc_feature: Up-regulated in root tissues in response to methyl jasmonate treatment
  misc_feature: Up-regulated in shoot tissues in response to methyl jasmonate treatment
  misc_feature: Up-regulated in shoot tissues in response to salicylic acid treatment
  misc_feature: Encodes the peptide sequence at SEQ ID NO 20249
atgtcgatgcattacttggctgctctgtcggtgactctgctgggagctatcttgctccgttgggccttcaaatggatgaactacggccggacgggcggtgaagaagggatgctgctgccgccggggtctaggggcctgccgttcctcggcgagacgctcgagttcttcgcggcgtccccgacccttgagctagtgccattcttcaagcgacggctggagaggttcgggcccatcttccggacgaacatagtcggcgaggacatgatcgtgtcgctggacccggagctgaacgcgcgcgtgctgcagcaggaggagcgcggcttccagatctggtacccttcctctttcatgcgcatcttgggcgctgacaacatggtctccatgctcggaccgctccaccgccacattaggaacctcgtgctccgcctcttcgggcccgaggccctccgcctggtgctgctccgcgacgtgcagcggagcgcgcgcgacgagctccggtcatggctcgaccggccggaagtcgaggtcaggacggccacctccaggatgatatttggcgtcacggcaaagaagctgatcagccacgacgacgtggcatcaggaggaagcctgtggaaatgcttcgacgcctggactaagggcctgatgtcattcccgatctgcgttcctggaacagccttctatagatgcatgcagggacgcaagaacgttatgaaggtactcaagcaacagctcgatgagcgcaggaacggagccgagcgcaagaccgtggatttcttcgatcttgtgattgatgagctcgacaagccaaactctataatgagcgagagcatcgcgttgaacttattgttcttgctcctctttgcaagccatgaaacgacgtcaatggggctgaccgtgatactcaagtttctaacggacaatccaaaatccttgcaagaattgaccgaggagcatgaaaaaatcatggaaagaagggtggatccagactctgatatcacctgggaggagtacaagtctatgaaattcacatctcacgtcatacatgaatctcttaggctcgcaaacatcgctccggtggtgttcagacaagcaaaccaggacgtacacataaagggatacactatcccagaaggatcaaagatcatgatttgtccatctgcagctcacctgaattcaaaggtttacgaggaccccttggcattcaatccatggagatggaaggatactcctgaaccagttggtggctctaaggattttatggcctttgggggtggtttgcggttatgtgttggtgctgagtttgccaagctgcaaatggctatgttcctccactacttggtcaccaattacagatggaaagccctcagcaaagggacgatgatgctttatcccggcctgcgatttccggacggctttcacatccagcttcataagaaaacatga

SEQ ID NO: 20249 - protein, 481 aa, Sorghum bicolor
  misc_feature: Ceres ANNOT ID no. 8633584
  misc_feature: Up-regulated in root tissues in response to methyl jasmonate treatment
  misc_feature: Up-regulated in shoot tissues in response to methyl jasmonate treatment
  misc_feature: Up-regulated in shoot tissues in response to salicylic acid treatment
  misc_feature (7)..(480): SWISSPROT Homolog: EC 1.14.13.93 (+)-abscisic acid 8'-hydroxylase
  misc_feature (40)..(477): Pfam ID: p450 Pfam Description: Cytochrome P450
MSMHYLAALSVTLLGAILLRWAFKWMNYGRTGGEEGMLLPPGSRGLPFLGETLEFFAASPTLELVPFFKRRLERFGPIFRTNIVGEDMIVSLDPELNARVLQQEERGFQIWYPSSFMRILGADNMVSMLGPLHRHIRNLVLRLFGPEALRLVLLRDVQRSARDELRSWLDRPEVEVRTATSRMIFGVTAKKLISHDDVASGGSLWKCFDAWTKGLMSFPICVPGTAFYRCMQGRKNVMKVLKQQLDERRNGAERKTVDFFDLVIDELDKPNSIMSESIALNLLFLLLFASHETTSMGLTVILKFLTDNPKSLQELTEEHEKIMERRVDPDSDITWEEYKSMKFTSHVIHESLRLANIAPVVFRQANQDVHIKGYTIPEGSKIMICPSAAHLNSKVYEDPLAFNPWRWKDTPEPVGGSKDFMAFGGGLRLCVGAEFAKLQMAMFLHYLVTNYRWKALSKGTMMLYPGLRFPDGFHIQLHKKT

SEQ ID NO: 20250 - DNA, 1989 bp, Sorghum bicolor
  misc_feature: Ceres ANNOT ID no. 8633627
  misc_feature: Down-regulated in root tissues in response to methyl jasmonate treatment
  misc_feature: Down-regulated in shoot tissues in response to methyl jasmonate treatment
  misc_feature: Down-regulated in shoot tissues in response to salicylic acid treatment
  misc_feature: Encodes the peptide sequence at SEQ ID NO 20251
atggcgtcccgcatgagtctcttttctccccctcttatgttgcaattgtatctttcaattgtttcagatgctgcagaggcggggagcagtggcggcggcgggaggggatggggcggcgggttccggagcctgatgcggcggaagcaggtggactccgatcgggtccgcgccaagggccagccgcagctcgccaaggagctcaacgtgccggagctggtcgccatcggggttggttccacagttggagctggagtatacgttctcgtgggaacagttgctagggagcacgctggtccggcattgacaatttcatttctgatagctggaatagctgccgcgctttcagctttctgttatgctgagcttgctagtcgttgcccctctgctggaagtgcctaccattattcatacatctgtgttggagaaggtgttgcctggttgattggctgggctcttgtgctggaatatactattggtggatctgctgttgcccgtggcatatctccaaatttagcattgttttttggaggacaagatagtctgccatggattttagcacgccatcagcttccatggtttggtatcattgttgacccctgcgcagctgctcttgtttttgttgtgactgttttactgtgcgtgggaattaaagagagttcatttgcacaaggagtggtaacagttctgaatgcttgtgtaatgatatttgttattgtggctggtagttatattggctttcaaataggatgggtcggctacaaggtttctgacgggtatttcccacatggagtaaatggaatgcttgctggatcagcaactgttttctttgcatacataggctttgatacagtcgctagtacagctgaagaggtaaagaatccacagagagatttgccattgggaattggagcagcgttggctatttgttgtgtgttgtatatggctgtttctgtcgttattgttgggctggtaccatatttcgccatggacccagatactcctatttcatctgccttcacagaacatggaatgcaatggactttaccatctaattttaggtatgttgtgacaagtggtgctgttcttgcactctgctcgaccttgatgggttcacttcttccacagcctagaatacttatggccatggcacgagatggtctgttgccatccttcttctctgatgttaacaaacaaactcaagtacctgttaagagcacaattgtgactggcatttttgcagctgctctggcttttgcaatggatgtttcacagttagcaggaatggtcagtgtaggcacacttcttgcattcactatagttgctgtctcaatcttgatactcagatatgtccctccagatgaggtccctttgccaccctctatgcaagaatcattccatttgaaccaggaatgcgatgaggaaacggacaggggccttcttggcgttgggaactgtaacttgtctcagacaaagaatgtgattgtggtagtagaatcagtgaaggaccctctcattgataaaagactgcataaaggcaagatggatgagactaaacgccgaaagattgcctctttaagcatagcgtctgtgtgtgtaggggttctgatcctcacatcttcagcctctgccacatggttgccttttctcccgatatgtattggctgcatcattggagttatgctccttctggctggcctcagcttgctctcctggatcgaccaagatgctggcaggcactcctttggtcattccggaggattcacatgcccttttgttccagtgctaccagttttgtgtatcctgataaatacgtatctgttgataaacctgggtggtgacacatggatgagggttggcatatggctgctgatgggtgttcttgtgtacgttttctatggacgaacccacagctccctaacagatgtcgtctacgttccggtagcacaagctgatgagatatacaggagttcatcaggatatgtatcatag

SEQ ID NO: 20251 - protein, 662 aa, Sorghum bicolor
  misc_feature: Ceres ANNOT ID no. 8633627
  misc_feature: Down-regulated in root tissues in response to methyl jasmonate treatment
  misc_feature: Down-regulated in shoot tissues in response to methyl jasmonate treatment
  misc_feature: Down-regulated in shoot tissues in response to salicylic acid treatment
  misc_feature (71)..(526): Pfam ID: AA_permease Pfam Description: Amino acid permease
MASRMSLFSPPLMLQLYLSIVSDAAEAGSSGGGGRGWGGGFRSLMRRKQVDSDRVRAKGQPQLAKELNVPELVAIGVGSTVGAGVYVLVGTVAREHAGPALTISFLIAGIAAALSAFCYAELASRCPSAGSAYHYSYICVGEGVAWLIGWALVLEYTIGGSAVARGISPNLALFFGGQDSLPWILARHQLPWFGIIVDPCAAALVFVVTVLLCVGIKESSFAQGVVTVLNACVMIFVIVAGSYIGFQIGWVGYKVSDGYFPHGVNGMLAGSATVFFAYIGFDTVASTAEEVKNPQRDLPLGIGAALAICCVLYMAVSVVIVGLVPYFAMDPDTPISSAFTEHGMQWTLPSNFRYVVTSGAVLALCSTLMGSLLPQPRILMAMARDGLLPSFFSDVNKQTQVPVKSTIVTGIFAAALAFAMDVSQLAGMVSVGTLLAFTIVAVSILILRYVPPDEVPLPPSMQESFHLNQECDEETDRGLLGVGNCNLSQTKNVIVVVESVKDPLIDKRLHKGKMDETKRRKIASLSIASVCVGVLILTSSASATWLPFLPICIGCIIGVMLLLAGLSLLSWIDQDAGRHSFGHSGGFTCPFVPVLPVLCILINTYLLINLGGDTWMRVGIWLLMGVLVYVFYGRTHSSLTDVVYVPVAQADEIYRSSSGYVS

SEQ ID NO: 20252 - DNA, 2940 bp, Sorghum bicolor
  misc_feature: Ceres ANNOT ID no. 8633640
  misc_feature: Up-regulated in root tissues in response to methyl jasmonate treatment
  misc_feature: Up-regulated in shoot tissues in response to methyl jasmonate treatment
  misc_feature: Up-regulated in root tissues in response to salicylic acid treatment
  misc_feature: Encodes the peptide sequence at SEQ ID NO 20253
atgtcggcggcggagaggaccgacgatgcgtcggcctcggcctcagcgggtgacccgcgcggggtccgcaacacgtgcatcctcgcgcacgtggaccacggcaagaccacgctggcggaccacctggtggcgtcctgcggggacgggctcctccacccgaagctcgccggccggctccgcttcatggactacctcgacgaggagcagcggcgggccatcaccatgaagtccgccgccgtcgcgctccgctcccgggccggacaccgcgtcagcctcatcgattcccccggccacatcgacttctgctccgaggtctcctccgccgcgcgcctctcggactcggcgctcatcctcgtcgacgccgtcgaaggggtgcacatccagacgcacgccgcgctgcgccaggccttcatcgagcgcctccgcccctgcctcgtgctcaacaagatcgaccgcctcatcaccgagctcagcctcacccccgccgaggcctacgtccgcctccaccgcatcgtctccgacgtcaactccatctactccgcgctgcgctcccactcctacttctccctactctccgccctcgaggacagcccctccacaagctcttcctccttagctgaggacctaccggaggactttgaagacgacgatgacaacgaggacgccttccagcccctcaagggcaattttgtgttgagtgccctgtggaagatgtacgagctggtgctggagggcggtggtgagagtaatgcggtgaagaaattgattgaaaactttgacttgaaaattccggaacgggagctgaagaacagagatacaaaggctgtgctgcagtctgtcatgagccgctggctgccgctggcagatgctgtgatggatatggtggtggagtgcacccctgatcctgttgctgctcaaggggtcagggttgcaaggcttatgccaaagagggaggttactccagaagatgctgctggttgccctgatgttgttgaggaggccgagagggtgcggaggtgtgtcgaggcctgtgatgtgagtgctgatgcgccagtcgtagtttatgtgtcaaagatgtttgctgtgccatctaagatgttgccattgaagggagtggatggtgaactgttgaaccaccatagtagtagtgagtcagaggagtgctttatggcatttgcaagggtcttcagtggtgtccttcatgcagggcagaaggtatttgtgctgtcgccattgtatgatccagtgaaaggggatacagttcagaagcatgtgcaggaggtggagcttcaatacttgtatgagatgctaggacaaggcctgaagccagttgccagtgtgggtgcggggaatgtggttgcaatccagggccttgggcagcatatattgaagagtgccacattgtcgtcgaccaagaattgctggcccttctcgagtatgatgttccaggcatctccaatgcttaaagttgcgattgagccctcaaatccagctgatctaggagctcttgttaaagggcttaggcttcttaaccgggcagatccatttgtcgagtatactgtttcgcagaggggtgagcatgtccttgctgctgctggtgagatacatttggagcggtgcataaaggatttggaggagagattttcaaaggtcaaattggtggtctcagaccccctagtttccttcaaagagacaattgacggggaaggtgtcagtttagtggagagcttgaagaacccacaggagtttgttgagaggactactccaaatgggaggtgtactgtgcgagttcaggtcctgaggcttcccaatgctctgactaaggtccttgaggaaagtgagcagttgcttggtcaaataattgatgggaaaacagcaaacagggatggtgtattggatcctcgcctttctcacgaagatggtgattctgctgcaactctcagacagcggatgatcgatgccatagacagtgaattagacacaatttctaagcaggttgataaagaaaaacttgacaggtatagaaagacatggcttggacaccttgaaagaatctggtcactaggtccttggcaggttggtccaaatatccttcttctgcctgattcaaaatcaagtggtggtacaataactgtccaggatggaaggcaaggtatacttgttagtggcagagctcatgtgtctgagaaattggggtttgtgagggaaggtgataccaaagataatgatcttgacaatggtgacgaatatgcagcagatgctcctgaatcgttgcatatagagtctacggcactaaggaacagcattgtctcaggattccagattgccactaatgctgggcctttatgtgatgaacctatgtggggtcttgcgtttattgttgagccttacatattcgatgacggctctgatgctgccaaccactctgatcaatacaatgtcttcagcggtcaagtaatcactgcggttaaagaagcatgcagagcagctgttcttcagaacaagccaaggcttgttgaggctatgtacttctgtgagttgaccaccccaaccgagcagttaggtgcaacttacgcagttcttggtaagaggagagcaagggttctgaaagaagagatgcaagaaggaacctcattatttacagtgcatgcttacctgccagtcgctgagagcattgggttttcgaatcaacttaggagtttaactgcaggtgcagttagtgctctcctcgttcttagccactgggaagctattcctgaggaccccttctttgtcccaaagacacaggatgagcttgaagaatttggagatggttcaagcattgggccaaacctggctaaaaagctcatgaattctgttagacgaaggaaaggactgcatgtggaagagaaagttgtggagcatggcacaaaacagcggactcttgctaaaaaggtatag

SEQ ID NO: 20253 - protein, 979 aa, Sorghum bicolor
  misc_feature: Ceres ANNOT ID no. 8633640
  misc_feature: Up-regulated in root tissues in response to methyl jasmonate treatment
  misc_feature: Up-regulated in shoot tissues in response to methyl jasmonate treatment
  misc_feature: Up-regulated in root tissues in response to salicylic acid treatment
  misc_feature (20)..(301): Pfam ID: GTP_EFTU Pfam Description: Elongation factor Tu GTP binding domain
  misc_feature (837)..(925): Pfam ID: EFG_C Pfam Description: Elongation factor G C-terminus
MSAAERTDDASASASAGDPRGVRNTCILAHVDHGKTTLADHLVASCGDGLLHPKLAGRLRFMDYLDEEQRRAITMKSAAVALRSRAGHRVSLIDSPGHIDFCSEVSSAARLSDSALILVDAVEGVHIQTHAALRQAFIERLRPCLVLNKIDRLITELSLTPAEAYVRLHRIVSDVNSIYSALRSHSYFSLLSALEDSPSTSSSSLAEDLPEDFEDDDDNEDAFQPLKGNFVLSALWKMYELVLEGGGESNAVKKLIENFDLKIPERELKNRDTKAVLQSVMSRWLPLADAVMDMVVECTPDPVAAQGVRVARLMPKREVTPEDAAGCPDVVEEAERVRRCVEACDVSADAPVVVYVSKMFAVPSKMLPLKGVDGELLNHHSSSESEECFMAFARVFSGVLHAGQKVFVLSPLYDPVKGDTVQKHVQEVELQYLYEMLGQGLKPVASVGAGNVVAIQGLGQHILKSATLSSTKNCWPFSSMMFQASPMLKVAIEPSNPADLGALVKGLRLLNRADPFVEYTVSQRGEHVLAAAGEIHLERCIKDLEERFSKVKLVVSDPLVSFKETIDGEGVSLVESLKNPQEFVERTTPNGRCTVRVQVLRLPNALTKVLEESEQLLGQIIDGKTANRDGVLDPRLSHEDGDSAATLRQRMIDAIDSELDTISKQVDKEKLDRYRKTWLGHLERIWSLGPWQVGPNILLLPDSKSSGGTITVQDGRQGILVSGRAHVSEKLGFVREGDTKDNDLDNGDEYAADAPESLHIESTALRNSIVSGFQIATNAGPLCDEPMWGLAFIVEPYIFDDGSDAANHSDQYNVFSGQVITAVKEACRAAVLQNKPRLVEAMYFCELTTPTEQLGATYAVLGKRRARVLKEEMQEGTSLFTVHAYLPVAESIGFSNQLRSLTAGAVSALLVLSHWEAIPEDPFFVPKTQDELEEFGDGSSIGPNLAKKLMNSVRRRKGLHVEEKVVEHGTKQRTLAKKV

SEQ ID NO: 20254 - DNA, 735 bp, Sorghum bicolor
  misc_feature: Ceres ANNOT ID no. 8633673
  misc_feature: Down-regulated in shoot tissues in response to salicylic acid treatment
  misc_feature: Down-regulated in root tissues in response to salicylic acid treatment
  misc_feature: Encodes the peptide sequence at SEQ ID NO 20255
atggcagccgccgacgcgacgcgtacgctgctcgttgcgctatctctcgccgtagtcgcctgctgcttcccgcagctggcggcggcggacacgaacggcgtctacgagccgtgcagcgacgcacggatccagcgcggggatggcttcaccttcggggtggtcttcgcgggatacaacaccttcttctccggcaacacacagctctccccctgcgaccgccgcctcaacctcgctgcctccgggcagctcgccctcttccgccccaaggtcgacgagatctccctgctcaccatcaacaccaccaccggattcaacccagcttcagctggtggattcatggtagcatttgctggtaggaagtatgcagctagatctgttccgatatttgtatccaacacctcagttacagtgtccagcttcaccctggtacttgagttcaataaaggcaggcttcaaaacttgcactggaagaaggatggctgtggagcttgctccggcaagtcaaactttgtctgccttggcaaacaaacatgcgccatcaggacgcagagctgcaagacccaagggcctgtcgactgcagcatcggcatccagctggctttctctggtacggacaagcacgagtcagttctgaactcatggtacgaagtctccaacctcaggcaatactccctgtatgggctctactcaaacctcaaggacaccctgagtggccagttcaacaagatcttctag

SEQ ID NO: 20255 - protein, 244 aa, Sorghum bicolor
  misc_feature: Ceres ANNOT ID no. 8633673
  misc_feature: Down-regulated in shoot tissues in response to salicylic acid treatment
  misc_feature: Down-regulated in root tissues in response to salicylic acid treatment
MAAADATRTLLVALSLAVVACCFPQLAAADTNGVYEPCSDARIQRGDGFTFGVVFAGYNTFFSGNTQLSPCDRRLNLAASGQLALFRPKVDEISLLTINTTTGFNPASAGGFMVAFAGRKYAARSVPIFVSNTSVTVSSFTLVLEFNKGRLQNLHWKKDGCGACSGKSNFVCLGKQTCAIRTQSCKTQGPVDCSIGIQLAFSGTDKHESVLNSWYEVSNLRQYSLYGLYSNLKDTLSGQFNKIF

SEQ ID NO: 20256 - DNA, 3636 bp, Sorghum bicolor
  misc_feature: Ceres ANNOT ID no. 8633680
  misc_feature: Up-regulated in root tissues in response to salicylic acid treatment
  misc_feature: Up-regulated in shoot tissues in response to salicylic acid treatment
  misc_feature: Encodes the peptide sequence at SEQ ID NO 20257
atggaggatgacgagtacgaggaggggatggagatgggctacggcgggcatcagcagcacggcggcggccacgcggggtacggcgcggatgaggacgacgagatggggtacggcggcgggggcggggacggggacggggacggggaagagatggaggaggaggcggacggggaccccgatctgcgggatgagatcgggcaggacgacgcctgggccgttatctccgcttacttcgaggagaagggcctcgtgcgccagcagctcgactccttcgacgagttcatccagaacaccatgcaggagattgtcgatgagtcagctgacatcgagatccgccccgagtcgcagcacaaccctggccgccaggctgaatttgccgagactctgcacaagatcagctttggtcaaatctatctcagcaagccaatgatgactgaagccgatggagagacagctactttatttccaaaatcagcaaggctcaggaacttgacatactctgcaccactgtatgttgatgtgtcatacagagtaatgaagaaaggacatgactgtgaggaagttacagagactgcagactatccaaaagtgtttattgggaaggttccaataatgttgcgttctagttactgcacactgtatcaacaatctgagaaggatctcactgaacttggggagtgtccttatgaccaaggtggttatttcattatcaatggaagtgaaaaggttcttattgcccaggagaagatgagcaccaaccatgtctatgtttttaagaagaggcagcctaacaaatttgcatatgtggctgaagtccgttccatggctgagaaccagaacagaccagccagcagcatgtttgtacggatgctttcgcgagcaggagcaaaagggggatcatctggtcaatatattcgtgctactctgccttatattcgtgcggacattcccattatcattgtatttcgagcattaggatttgttgcggacaaggatatactggagcatatttgttatgacttctctgatacacaaatgatggaattgctacgcccatctctcgaggaagcttttgtcattcaaaatcaacaggttgctctggactacattggaaaacgtggtgcaacagttggtgtcactcgagaaaagagaattaaatatgcaaaggaaatacttcaaaaggaaatgttgcctcatgttggtgttggggaattctgtgaaactaagaaggcatactattttggatatattattcaccgcctactgatgtgcgctcttggtcgaagagctgaggatgaccgagatcattacggaaacaaaagattagatcttgctggtccactgcttggtgggctgtttagaatgtgtgtagataatggaaaggaagttaatttgcaatttgctatcaaagcaaaaactatcaccagtggcttgaagtactcccttgctactggaaactggggacaggctaaccaagctggaaccagagcaggggtttctcaggtgcttaatcgcctcacctatgcttctacactttcacatctccggaggctgaactctcccattgggcgtgaaggaaaattggcaaaaccccgccagttgcataattcgcattggggaatgatgtgtcctgctgaaacaccagaaggacaggcttgtggcttggtgaaaaatcttgccttgatggtatatatcactgttggttctgctgcgaatccaattttggaatttttggaggagtggggcacagaaaattttgaggagatatcaccagctgtcattccacaagctgctaaaatttttgtcaatggttgttgggttggaattcataggaaccctgacctgttggttaagactcttaggcgtctaagaagacagattgatgtcaacactgaagttggtgtggttcgtgatatccgtcttaaagaacttcgactctacacggattatggacgctgcagtcgtccattgtttattgttgagggtcagaggctgctcatcaagaaggcgcatataatagctttgcaacatagggagactcctgatgaaggctggcatgaattagtctcaaaaggatatatagagtacatagatactgaagaagaggagactaccatgatctccatgaccataagtgaccttcataatgcaaggcacaacccagaggatgcttactctgaaacttacacacattgtgagattcatccttcattgatacttggagtttgtgcatcgattattccttttcctgaccacaaccagtctgctatgggaaagcaagccatgggaatttatgtcaccaattatcagttaaggatggacactttggcctatgttctatactacccacaaaagcctctagtcactacccgtgctatggaacatttgcacttcagacagttaccagctggcattaatgcaattgttgctatcgcttgttattctggatataatcaagaagattcagttattatgaatcaatcttccatagatcgtgggttcttccgatcactatttttccgctcttacagagatgaggaaaagaagatgggtacacttgtcaaagaggaatttggtcgtccaaatagggaaaatactatgggaatgcgtcatgggtcatatgataaactagatgatgatggccttgcaccacctggaacaagggtctcaggggaagatgtcattattgggaagacatctcctattccacaggatgacgctcaagggcaagcttctagatactcgaagcgtgatcatagtacttctctgcgtcacagtgaaagtggcatggtagatcaggttctgttaacaacaaatgcggatggtctaagatttgtcaaggttaggatgcgatctgttcgcataccacaaattggagacaagtttagcagtaggcatgggcaaaaaggaactgttgggatgacttacactcaagaggatatgccatggacaatcgaaggcatcacacccgatattattgtgaatccacatgctattccatcccgtatgactattgggcagctgattgagtgcattatgggtaaagttgcggcccagatggggagggaaggcgatgccactccattcaccgatgtgactgtggataacatcagcaaagctcttcatagatgtaattatcaaatgcgtggatttgaaaccatgtacaatggtcacactggaagaaaactgactgcaatgattttcctgggtcccacgtattaccaaagactcaagcacatggtggatgacaaaatacattctagaggacgtggtcctgttcagatactcacccggcaaccagcagaggggcgatctcgtgatggtggtctccgctttggagaaatggaaagggattgtatgatcgcacatggagcagctttcttccttaaggaaaggctgtttgaccagagtgacgcatacagagtccatgtatgcgagaaatgtggtctcatcgcaattgctaacctaaagaaaaactcgttcgaatgtaggggctgcaagaacaagactgacattgtccaagtacacataccctatgcttgtaagcttctgttccaggagcttatggcaatggccattgctcccagaatgcttacccatgatatgaagacagggaaggatcagaagaagcgctga

SEQ ID NO: 20257 - protein, 1211 aa, Sorghum bicolor
  misc_feature: Ceres ANNOT ID no. 8633680
  misc_feature: Up-regulated in root tissues in response to salicylic acid treatment
  misc_feature: Up-regulated in shoot tissues in response to salicylic acid treatment
  misc_feature (451)..(1211): SWISSPROT Homolog: EC 2.7.7.6 DNA-directed RNA polymerase
  misc_feature (741)..(1106): Pfam ID: RNA_pol_Rpb2_6 Pfam Description: RNA polymerase Rpb2, domain 6
  misc_feature (82)..(485): Pfam ID: RNA_pol_Rpb2_1 Pfam Description: RNA polymerase beta subunit
  misc_feature (251)..(443): Pfam ID: RNA_pol_Rpb2_2 Pfam Description: RNA polymerase Rpb2, domain 2
  misc_feature (1108)..(1200): Pfam ID: RNA_pol_Rpb2_7 Pfam Description: RNA polymerase Rpb2, domain 7
  misc_feature (600)..(662): Pfam ID: RNA_pol_Rpb2_4 Pfam Description: RNA polymerase Rpb2, domain 4
  misc_feature (501)..(566): Pfam ID: RNA_pol_Rpb2_3 Pfam Description: RNA polymerase Rpb2, domain 3
  misc_feature (685)..(736): Pfam ID: RNA_pol_Rpb2_5 Pfam Description: RNA polymerase Rpb2, domain 5
MEDDEYEEGMEMGYGGHQQHGGGHAGYGADEDDEMGYGGGGGDGDGDGEEMEEEADGDPDLRDEIGQDDAWAVISAYFEEKGLVRQQLDSFDEFIQNTMQEIVDESADIEIRPESQHNPGRQAEFAETLHKISFGQIYLSKPMMTEADGETATLFPKSARLRNLTYSAPLYVDVSYRVMKKGHDCEEVTETADYPKVFIGKVPIMLRSSYCTLYQQSEKDLTELGECPYDQGGYFIINGSEKVLIAQEKMSTNHVYVFKKRQPNKFAYVAEVRSMAENQNRPASSMFVRMLSRAGAKGGSSGQYIRATLPYIRADIPIIIVFRALGFVADKDILEHICYDFSDTQMMELLRPSLEEAFVIQNQQVALDYIGKRGATVGVTREKRIKYAKEILQKEMLPHVGVGEFCETKKAYYFGYIIHRLLMCALGRRAEDDRDHYGNKRLDLAGPLLGGLFRMCVDNGKEVNLQFAIKAKTITSGLKYSLATGNWGQANQAGTRAGVSQVLNRLTYASTLSHLRRLNSPIGREGKLAKPRQLHNSHWGMMCPAETPEGQACGLVKNLALMVYITVGSAANPILEFLEEWGTENFEEISPAVIPQAAKIFVNGCWVGIHRNPDLLVKTLRRLRRQIDVNTEVGVVRDIRLKELRLYTDYGRCSRPLFIVEGQRLLIKKAHIIALQHRETPDEGWHELVSKGYIEYIDTEEEETTMISMTISDLHNARHNPEDAYSETYTHCEIHPSLILGVCASIIPFPDHNQSAMGKQAMGIYVTNYQLRMDTLAYVLYYPQKPLVTTRAMEHLHFRQLPAGINAIVAIACYSGYNQEDSVIMNQSSIDRGFFRSLFFRSYRDEEKKMGTLVKEEFGRPNRENTMGMRHGSYDKLDDDGLAPPGTRVSGEDVIIGKTSPIPQDDAQGQASRYSKRDHSTSLRHSESGMVDQVLLTTNADGLRFVKVRMRSVRIPQIGDKFSSRHGQKGTVGMTYTQEDMPWTIEGITPDIIVNPHAIPSRMTIGQLIECIMGKVAAQMGREGDATPFTDVTVDNISKALHRCNYQMRGFETMYNGHTGRKLTAMIFLGPTYYQRLKHMVDDKIHSRGRGPVQILTRQPAEGRSRDGGLRFGEMERDCMIAHGAAFFLKERLFDQSDAYRVHVCEKCGLIAIANLKKNSFECRGCKNKTDIVQVHIPYACKLLFQELMAMAIAPRMLTHDMKTGKDQKKR

SEQ ID NO: 20258 - DNA, 1410 bp, Sorghum bicolor
  misc_feature: Ceres ANNOT ID no. 8633717
  misc_feature: Up-regulated in shoot tissues in response to methyl jasmonate treatment
  misc_feature: Up-regulated in shoot tissues in response to salicylic acid treatment
  misc_feature: Encodes the peptide sequence at SEQ ID NO 20259
atggcgacggcgctggcgcggcggggcgccgcggccctggcgcggtggcgcgggatgtgctcgagctcggcggcggcagggcgcgccgcggcgctgtcctcggaggagctcatgcggatggaacgggactgcagcgcgcacaactaccacccaatccccatggtgttttccaaaggagaaggttcacacatagtggaccctgaaggcaacaaatacatcgattttctctctgcttattccgcagtcaatcagggtcattgccatccaaaagtcctgagagctttgatagaacaggcagaaaggcttacgctcagttctagagctttctacaatgataagttcccaatctttgcggaatatctgacaagcatgtttggatatgacatgatgttgccaatgaatactggagctgaaggagttgaaactgctatcaaattggctaggaaatggggttatgagaagaaacggataccaaagaatgaggctttgcttgtctcttgctgtgggtgtttccatggtcgaactcttggtgtcatttccatgagctgtgacaacgatgcaactcgtggttttggtcctttggttcctggccatcttaaagttgattttggagatattgatgggttaaagaaaatctttgaagagcatggagatcggatttgtggttttttatttgaacctatccaaggtgaagcgggggtagtaatcccaccagatggctatttgaaaggtgtcagagacttgtgttctaaacataacattttgatgattgctgatgagatccaaactggcatagctagaactggtaaaatgctggcatgtgattgggaaaacatacggcctgacatggtgattctaggcaaagcactcggtgctggagttgttccagtcagtgcagttcttgcagacaaggatgtcatgctgtgtattagaccaggggaacatggaagtacattcggtgggaatccattagctagcgctgtggcagttgcatcactgaaagtggtcagagacgaaggtcttgttgaaagggctgcaaagttaggacaggagtttagggaccagttacagaaggtccagcaaaaattccctcaaatcataagagaagtgcgcgggaggggtttgctgaacgcagtggatttaaacaatgacgcgctatctcctgcttctgcatatgacatctgcatcaagttgaaggagagaggcattttagcgaaacccacacatgacactataatccgacttgctcctcccctctcaatcagtcctgaggagcttgcagaagcatccaaggcgcttagtgacgtgctggagcatgacttgccacagttgcagaagcagataaaaaagccagaatctgaggcagagaagccagtctgtgacagatgcggccgggacttgtacggatga

SEQ ID NO: 20259 - protein, 469 aa, Sorghum bicolor
  misc_feature: Ceres ANNOT ID no. 8633717
  misc_feature: Up-regulated in shoot tissues in response to methyl jasmonate treatment
  misc_feature: Up-regulated in shoot tissues in response to salicylic acid treatment
  misc_feature (35)..(456): SWISSPROT Homolog: EC 2.6.1.13 Ornithine aminotransferase
  misc_feature (55)..(383): Pfam ID: Aminotran_3 Pfam Description: Aminotransferase class-III
MATALARRGAAALARWRGMCSSSAAAGRAAALSSEELMRMERDCSAHNYHPIPMVFSKGEGSHIVDPEGNKYIDFLSAYSAVNQGHCHPKVLRALIEQAERLTLSSRAFYNDKFPIFAEYLTSMFGYDMMLPMNTGAEGVETAIKLARKWGYEKKRIPKNEALLVSCCGCFHGRTLGVISMSCDNDATRGFGPLVPGHLKVDFGDIDGLKKIFEEHGDRICGFLFEPIQGEAGVVIPPDGYLKGVRDLCSKHNILMIADEIQTGIARTGKMLACDWENIRPDMVILGKALGAGVVPVSAVLADKDVMLCIRPGEHGSTFGGNPLASAVAVASLKVVRDEGLVERAAKLGQEFRDQLQKVQQKFPQIIREVRGRGLLNAVDLNNDALSPASAYDICIKLKERGILAKPTHDTIIRLAPPLSISPEELAEASKALSDVLEHDLPQLQKQIKKPESEAEKPVCDRCGRDLYG

SEQ ID NO: 20260 - DNA, 1017 bp, Sorghum bicolor
  misc_feature: Ceres ANNOT ID no. 8633837
  misc_feature: Up-regulated in shoot tissues in response to salicylic acid treatment
  misc_feature: Up-regulated in root tissues in response to salicylic acid treatment
  misc_feature: Encodes the peptide sequence at SEQ ID NO 20261
atgggcaactgcagcagctttactcttccaaaatggggaagcaagctactcaataatggcatggtttcgattgatgaggatggaactcatgaaggaataaagacaattccagttcagaaagtctgtgaattcaccaccaactctgtgctctgcatttgcatcgtcacatggaacatgaatagcaagatgtctgtggaagatgtaacgaaattggtgagctccaacagaaagttcgatttgctagttgttgggctgcaggaagccccaaaatcagatgtttcacaagttctgcaggaggcgttggccgagacgcacgtgctattgggtcagaagagcatgcagtctcttcagatgcttcttttcggttcaaggagttcggagaagtacatcagagagatgaaggtggacaaacatgcggttggaggttgcggtggtatcattgggagaaagaaaggagcagtggccatgtacatcaacttcagtgggatccggatggtttttgtgtcctgtcatcttgcagcacatgaacacaaggtggagaagaggaactcagaattccagcatatttcacagtcgctcttctccaagtatggcacaccatacgcccaatctgccgacataacagtgtggctcggcgatctcaattatagactcgaaggaataagctcgatgcctgcacggaagatgattgaggagaaccgtcagagtaagctaagaggcaaagaccagcttctgcaagaagctgaaaagggcgaagtgttcaacgggtactgcgaagggaccctgtcgtttaagccaacgtacaaatatgatgtcgggagtagcatctacgacacaagctctaagataagggtgccttcttggacagacaggatattgttcaaggttggccattcttcaggcttggatgcagtcttgagctcatatgagtccctcgactgtgttcggagctccgaccacaagcctgtgaaagcccatctttgtctcagagtacgcagtgacggtgatgctgactaa

SEQ ID NO: 20261 - protein, 338 aa, Sorghum bicolor
  misc_feature: Ceres ANNOT ID no. 8633837
  misc_feature: Up-regulated in shoot tissues in response to salicylic acid treatment
  misc_feature: Up-regulated in root tissues in response to salicylic acid treatment
  misc_feature (29)..(330): SWISSPROT Homolog: EC 3.1.3.56 Inositol-polyphosphate 5-phosphatase
  misc_feature (52)..(327): Pfam ID: Exo_endo_phos Pfam Description: Endonuclease/Exonuclease/phosphatase family
MGNCSSFTLPKWGSKLLNNGMVSIDEDGTHEGIKTIPVQKVCEFTTNSVLCICIVTWNMNSKMSVEDVTKLVSSNRKFDLLVVGLQEAPKSDVSQVLQEALAETHVLLGQKSMQSLQMLLFGSRSSEKYIREMKVDKHAVGGCGGIIGRKKGAVAMYINFSGIRMVFVSCHLAAHEHKVEKRNSEFQHISQSLFSKYGTPYAQSADITVWLGDLNYRLEGISSMPARKMIEENRQSKLRGKDQLLQEAEKGEVFNGYCEGTLSFKPTYKYDVGSSIYDTSSKIRVPSWTDRILFKVGHSSGLDAVLSSYESLDCVRSSDHKPVKAHLCLRVRSDGDAD

SEQ ID NO: 20262 - DNA, 2670 bp, Sorghum bicolor
  misc_feature: Ceres ANNOT ID no. 8633844
  misc_feature: Down-regulated in root tissues in response to salicylic acid treatment
  misc_feature: Encodes the peptide sequence at SEQ ID NO 20263
atggcgaagtcgagcgcggacgacgccgagctgcggcgcgcgtgcgccgcggccgtggcggcgtcgggcgcgcgcggagaggacgtggccttctccatccgcgtcgccaagggccgcggcatcttcgagaagctcggcaggctcgccaagccccgcgtcctcgcgctcaccgttaaacaatcatcaagaggcgaggcaaacaaagcttttctccgagtattaaagtattcatctggggcagtgcttgagccagccaaactttacaagctgaaacatctaacaaaggttgaggttatttctaatgacccaagtggttgtacatttgttctgggatttgataaccttaggagtcagagtgttgccccgccacaatggacgatgcgtaacatcgatgacagaaaccgtctacttttttgtattctgaacatgtgcaaggagatactcagttatcttccgaaagttgttggaattgatattgtggagctagctctttgggcaaaggaaaacacactgaccatagataatcaattgagtacccaagatggtcaagaaacatcagttgctactcagaccgagaggaaagtaacagtaactgttgaaaatgatctcgtgtcccaagcaaaggaggaggaagaagacatggaggcacttcttgacacgtatgttatgggcataggtgaagcagatgcgttctctgagagattgaagcaggagcttgtggcattggaggccgcaaatgtatatcaattactggaaagtgagcctttaatagaagaggtcttgcagggtctggatgctgctagtgcaactgtagatgatatggatgagtggttacggattttcaacctgaagctgaggcatatgagagaagatattgcatcgattgaatcacgtaacaacggcttggagatgcagtccgtaaataacaaaggacttatggaagagctagataaattgcttgagcgtctgcggattccacaggagtttgcagcatcattaactggaggctcatttgaagagtcacggatgctgaaaaatgtcgaggcatgcgaatggttgacaggggccattcgtactcttgaagttcctaatttggacccatgctatgtcaacatgcgcgctgttagagaaaaaaaggcagaactggagaaactgaaaacaacttttgttcgacgagcatcagagtttttgcggaactacttctccagcttggtagacttcatgattagtgacaaaagctacttttcacagcgaggacaattgaagcggcctgatcatgcagaccttaggtataaatgcaggacatatgcccgacttctgcagcacttaaagagtctggacaagagctgcttaggtcccttaaggaaggcatactgccattcccttaatttgctactacgacgagaggcacgtgaatttgccaatgaacttcgtgcaagtacaaaagcacccaagaatcctgctgtttggcttgaaggttctggcggctctggtcataatggaagcagtgctgatacttcaacagtctcagatgcatactcaaagatgcttacgatatttatcccacttcttgtggatgagagttccttttttgcacattttatgtgctttgaagtacctgcacttgttccagctggttctcctaatgctaataagagcaaatctggaggaaatgacgccgatgatgatttgggtcttatggatccagatggcaacgatctgaaacctgatagtacctctgctgaactgggtacattgaatgaagctcttcaagaattactcgatggaatccaggaagacttctatgcggttgtagattgggcgtataaaattgaccccttgcgttgcatctcaatgcatgggattacagagcgctacctttctggacagaaagctgatgctgcaggatttgttcgcaaactacttgatgacttggaatcaagaatatcagtacagttcagccggtttattgatgaagcatgccatcaaattgagcgtaatgaaagaaatgtgcggcaaactggaattctagcctacattccaagatttgctgtccttgcatcacggatggaacagtatattcaagggcagtccagggatttaattgataaagcatacacaaagctagttagcacaatgttcgcaactttggagaaaattgcacagagtgatcctaaaactgctgatattgtgctgattgagaattatgctgctttccagaacagtctttatgacttggctaatgttgtgccaacgcttgcaaagttctaccatcaagccagtgaatcatatgaactagcttgcactcgccatatcagctcactcatttatctccaatttgagaggttatttcaattcaaccggaaagttgaagaattgacatacaccattgctgctgaggagattccgtttcagctggggttgtcaaaaactgacctaaggagggtgctgaagtccagcttatctgggattgataagtcgattggcgccatgtacaggaggttgcagaagacactgacgtctgatgagttgtttccttcgctgtgggacaagtgcaagaaggaatttctggacaaatatgagagctttgttcagatggtaacacggatatatgggaatgagccgatcatgtcggtcaacgaaatgaaagaagtccttgctagtttttag

SEQ ID NO: 20263 - protein, 889 aa, Sorghum bicolor
  misc_feature: Ceres ANNOT ID no. 8633844
  misc_feature: Down-regulated in root tissues in response to salicylic acid treatment
MAKSSADDAELRRACAAAVAASGARGEDVAFSIRVAKGRGIFEKLGRLAKPRVLALTVKQSSRGEANKAFLRVLKYSSGAVLEPAKLYKLKHLTKVEVISNDPSGCTFVLGFDNLRSQSVAPPQWTMRNIDDRNRLLFCILNMCKEILSYLPKVVGIDIVELALWAKENTLTIDNQLSTQDGQETSVATQTERKVTVTVENDLVSQAKEEEEDMEALLDTYVMGIGEADAFSERLKQELVALEAANVYQLLESEPLIEEVLQGLDAASATVDDMDEWLRIFNLKLRHMREDIASIESRNNGLEMQSVNNKGLMEELDKLLERLRIPQEFAASLTGGSFEESRMLKNVEACEWLTGAIRTLEVPNLDPCYVNMRAVREKKAELEKLKTTFVRRASEFLRNYFSSLVDFMISDKSYFSQRGQLKRPDHADLRYKCRTYARLLQHLKSLDKSCLGPLRKAYCHSLNLLLRREAREFANELRASTKAPKNPAVWLEGSGGSGHNGSSADTSTVSDAYSKMLTIFIPLLVDESSFFAHFMCFEVPALVPAGSPNANKSKSGGNDADDDLGLMDPDGNDLKPDSTSAELGTLNEALQELLDGIQEDFYAVVDWAYKIDPLRCISMHGITERYLSGQKADAAGFVRKLLDDLESRISVQFSRFIDEACHQIERNERNVRQTGILAYIPRFAVLASRMEQYIQGQSRDLIDKAYTKLVSTMFATLEKIAQSDPKTADIVLIENYAAFQNSLYDLANVVPTLAKFYHQASESYELACTRHISSLIYLQFERLFQFNRKVEELTYTIAAEEIPFQLGLSKTDLRRVLKSSLSGIDKSIGAMYRRLQKTLTSDELFPSLWDKCKKEFLDKYESFVQMVTRIYGNEPIMSVNEMKEVLASF

SEQ ID NO: 20264 - DNA, 1071 bp, Sorghum bicolor
  misc_feature: Ceres ANNOT ID no. 8633900
  misc_feature: Up-regulated in shoot tissues in response to methyl jasmonate treatment
  misc_feature: Encodes the peptide sequence at SEQ ID NO 20265
atgggcgggctcaccatggagcaggccttcgtgcaggcccccgagcaccgccccaagcccaccgtcaccgaggccaccggcatcctggtcatcgacctctcgcctctcaccgccagcgacaccgacgcggccgcggtggacgcgctggccgccgaggtgggcgcggcgagccgggactggggcttcttcgtggtggttggccacggcgtgcccgcggagaccgtggcgcgcgcgacggcggcgcagcgcgcgttcttcgcgctgccggcggagcggaaggccgccgtgcggaggagcgaggcggagccgctcgggtactacgagtcggagcacaccaagaacgtcagggactggaaggaggtgttcgacctcgtcccgcgcgatccgccgccgccagcagccgtggccgacggcgagctcgtcttcaagaacaagtggccccaggatctgccgggcttcagagaggcgctggaggagtacgcggcagcgatggaggagctgtcgttcaagctgctggagctgatcgcccggagcttgaagctgaggcccgaccggctgcacggcttcttcaaggaccagacgacgttcatccggctgaaccactaccctccatgcccgagcccggacctggcgctgggagtggggcggcacaaggacgcgggggcgctgaccatcctgtaccaggacgaagtgggcgggctggacgtccggcggcgctcctccgacggcggcggcggcgagtgggtgcgggtgaggcccgtgccggagtcgttcgtcatcaacgtcggcgacctcgtccaggtgtggagcaacgacaggtacgagagcgcggagcaccgggtgtcggtgaactcggcgagggagaggttctccatgccctacttcttcaacccggcgagctacaccatggtggagccggtggaggagctggtgagcgacgacgacccgcccaggtacgacgcctacagctggggcgagttcttcagcaccaggaagaacagcaacttcaagaagctcagcgtggagaacattcagatcgcgcatttcaagaagaccctcgtcctcgcctag

SEQ ID NO: 20265 - protein, 356 aa, Sorghum bicolor
  misc_feature: Ceres ANNOT ID no. 8633900
  misc_feature: Up-regulated in shoot tissues in response to methyl jasmonate treatment
  misc_feature (171)..(327): SWISSPROT Homolog: EC 1.14.11.13 Gibberellin 2-beta-dioxygenase
  misc_feature (193)..(298): Pfam ID: 2OG-FeII_Oxy Pfam Description: 2OG-Fe(II) oxygenase superfamily
MGGLTMEQAFVQAPEHRPKPTVTEATGILVIDLSPLTASDTDAAAVDALAAEVGAASRDWGFFVVVGHGVPAETVARATAAQRAFFALPAERKAAVRRSEAEPLGYYESEHTKNVRDWKEVFDLVPRDPPPPAAVADGELVFKNKWPQDLPGFREALEEYAAAMEELSFKLLELIARSLKLRPDRLHGFFKDQTTFIRLNHYPPCPSPDLALGVGRHKDAGALTILYQDEVGGLDVRRRSSDGGGGEWVRVRPVPESFVINVGDLVQVWSNDRYESAEHRVSVNSARERFSMPYFFNPASYTMVEPVEELVSDDDPPRYDAYSWGEFFSTRKNSNFKKLSVENIQIAHFKKTLVLA

SEQ ID NO: 20266 - DNA, 2016 bp, Sorghum bicolor
  misc_feature: Ceres ANNOT ID no. 8634061
  misc_feature: Up-regulated in shoot tissues in response to methyl jasmonate treatment
  misc_feature: Up-regulated in root tissues in response to methyl jasmonate treatment
  misc_feature: Up-regulated in shoot tissues in response to salicylic acid treatment
  misc_feature: Down-regulated in root tissues in response to methyl jasmonate treatment
  misc_feature: Down-regulated in shoot tissues in response to methyl jasmonate treatment
  misc_feature: Down-regulated in shoot tissues in response to salicylic acid treatment
  misc_feature: Encodes the peptide sequence at SEQ ID NO 20267
atgcccgccgcggcgtccacctccgcgacctcgctgctgctgggcggcggcaggctcccgcggctccagctccagtccctccgcgcccccgccaagccccccttccgccgcccggcctcgtccccgtccacaccgctccccagatgccgcgccagcgcgagcccccgccctctgggccccgtctccgcctccgccctcgcgctgcccgtgtcggtgacggccgctcccccaccgcaggtggaggatggtggctgggtgggaggcgcggccgcggccgcggccgtgaggagagtagctgtggcggtggcgtgcggggcgctcgcggcggcgtggtgccgccgggcgatggctgtgggggcggccacggcggcgggagcgggagcgggggccggggccggggcgacgggggcggtggaagctgccgcggggattggagggatggcgctgcacgggggctggccgagagtgctgcagattctgcagctgctcagggagcagggcctggttctggccgcgctgctcggcctctctgcgttcttctccatggcagaaacttctatcacgacgctttggccttggaaggttcgtgaactagctgagaaggaacctgagaatggtgttttcaaaatgctccgaaatgacgtcactcgtttcctgacaactattctcattggcacaactgtggtcaacattggcgcaacagcaattgttactgaggcagcaacagcaatgtttggtgaagcaggtgttagtgcagcaacaggtgtcatgacagttgccatcttacttcttacagagatcactcccaaaagtgttgcagtccataatgccaccgaggtcgctaggtttgtgaccggtcgcatggctttcgctgatcctctatccagttgggcggattgctacttttctgtctatgggaatgctaaagattctagtgaaccatatgttactgaagatgaactgaagttaatgttacgaggagcagagttgagtggtgcaattgcagaagatgaacaggatatgatcgagaatgtcctggaaattaaagatacacaggtgagggaagtaatgacgcctttggtggacgtagttgcaattgatgctattgcaacacttattgatttcaaaaacttgtgggaaactcatcagtactctagagttcctgtatttgaggagcgcatagataatattgttggaattgcatatgcaatggacatgcttgaatatgttgaagaggttgagaagctgaatgaaatcactgttaagaaaatcgcacatatgcctacatactttgttccagattcaatgtctgtttggaacctattaagagagttccggatcaggcaggttcatatggcagtggtccttaatgaatatggtggaactattggtattgtaacactagaagatgtagtggaagaaatagttggtgaaatatttgacgagaatgattccaaggaggaaatccagaagaaaacaggctatatagtgaggcggggagatggaacatttgatgttgatgcaaatacatcaatagatcacctctctgaagagcttggtatcaaaataccagaggggcatcagtatgagacggtgtctggttttgtctgtgcatcttttggctatattccagaagaaggtgggaaaatgcttgtgattcttgaaaaggattacagagaagaaaacggtgaatatcaggaggaaggttctgatcgccaagatgatagagaaaaaactcaagcttacgaacttgagatagtggaagctaatgcaaggaaggtgggcaaagtcctatttaagccaataagcagtgaatgtgttggtgttgacaacaagggtgtgaaccgcctggtctccaagaagatcatcaaacggaagaagcagggctatgatgattcctccggtgacgagtatccagatacaacagagaatggctgccctgctgaggcactctcctactcggatggtaacagtgccttgttggaagatgcaagcagttctagtgccaagaggtga

SEQ ID NO: 20267 - protein, 671 aa, Sorghum bicolor
  misc_feature: Ceres ANNOT ID no. 8634061
  misc_feature: Up-regulated in shoot tissues in response to methyl jasmonate treatment
  misc_feature: Up-regulated in root tissues in response to methyl jasmonate treatment
  misc_feature: Up-regulated in shoot tissues in response to salicylic acid treatment
  misc_feature: Down-regulated in root tissues in response to methyl jasmonate treatment
  misc_feature: Down-regulated in shoot tissues in response to methyl jasmonate treatment
  misc_feature: Down-regulated in shoot tissues in response to salicylic acid treatment
  misc_feature (357)..(476): Pfam ID: CBS Pfam Description: CBS domain pair
  misc_feature (497)..(603): Pfam ID: CorC_HlyC Pfam Description: Transporter associated domain
MPAAASTSATSLLLGGGRLPRLQLQSLRAPAKPPFRRPASSPSTPLPRCRASASPRPLGPVSASALALPVSVTAAPPPQVEDGGWVGGAAAAAAVRRVAVAVACGALAAAWCRRAMAVGAATAAGAGAGAGAGATGAVEAAAGIGGMALHGGWPRVLQILQLLREQGLVLAALLGLSAFFSMAETSITTLWPWKVRELAEKEPENGVFKMLRNDVTRFLTTILIGTTVVNIGATAIVTEAATAMFGEAGVSAATGVMTVAILLLTEITPKSVAVHNATEVARFVTGRMAFADPLSSWADCYFSVYGNAKDSSEPYVTEDELKLMLRGAELSGAIAEDEQDMIENVLEIKDTQVREVMTPLVDVVAIDAIATLIDFKNLWETHQYSRVPVFEERIDNIVGIAYAMDMLEYVEEVEKLNEITVKKIAHMPTYFVPDSMSVWNLLREFRIRQVHMAVVLNEYGGTIGIVTLEDVVEEIVGEIFDENDSKEEIQKKTGYIVRRGDGTFDVDANTSIDHLSEELGIKIPEGHQYETVSGFVCASFGYIPEEGGKMLVILEKDYREENGEYQEEGSDRQDDREKTQAYELEIVEANARKVGKVLFKPISSECVGVDNKGVNRLVSKKIIKRKKQGYDDSSGDEYPDTTENGCPAEALSYSDGNSALLEDASSSSAKR

SEQ ID NO: 20268 - DNA, 1200 bp, Sorghum bicolor
  misc_feature: Ceres ANNOT ID no. 8634238
  misc_feature: Up-regulated in shoot tissues in response to salicylic acid treatment
  misc_feature: Encodes the peptide sequence at SEQ ID NO 20269
atggggagcgcggtggagacgctctgcgggcaagcctacggggcgcacaagtacgacatgctgggcatctacctgcagcgctccacgatcctcctcatggcgaccggcgtcccactcgccgtcatctacgccttctcccgcccgatcctcgtcctcctcggcgagtccccggcgatcgcgtccgccgccgccgtcttcgtgtacggcctgatcccgcagatcttcgcgtacgcggccaacttcccgatccagaagttcatgcaggcgcagagcatcatggcgcccagcgcctacatctccgccgccacgctcgccgtccacgtcgcgctcagctacctcgccgtctaccggtgggggatgggcctgctcggggcgtcgctgatactcagcctcagctggtgggtcatcgtcgtcgcgcagttcgtctacatcgtcaccagcgagaggtgccgcctcacgtggacgggcttctcgtgggaggccttctcgggcctgcctagcttcttcaagctctcggtggcgtcggctgttatgctctgccttgagacatggtactttcagatacttgtgctcattgctggactcctcaaggatcctgagcttgccttgtcatcactctctgtctgcatgacaattacagggtgggtgttcatgatatcagttgggttcaatgcagcagccagtgtacgagtgagcaatgagcttggtgccggcaacccaaaggcggcgtcgttctctgtggtcgtagtgacactgctctccttcgtcctgtcggtgctaatctccatcgtcatcctgctgtgccgggactacatcagctacatcttcaccgagggcgaggacgtgtcgcgggcggtctccaagctcactccgctgctggcggtcaccctcatcctcaacggcatccagcccgtcctctctggggttgctgtggggtgtggatggcaagcgttcgtcgcatacgtcaatgttggttgctactacatcgtcggcatcccccttgggtgtctcctaggattctattttgacctcggagcagcgggtatttggagtggtatgatcgggggcaccttcatgcagaccttgatcctggtgtgggttacatacaggaccaactggaccaaagaggttcaagaagcacagaaaagattaaacaaatggaatgatggcaaggctcctctattgtcagcccaagaatga

SEQ ID NO: 20269 - protein, 399 aa, Sorghum bicolor
  misc_feature: Ceres ANNOT ID no. 8634238
  misc_feature: Up-regulated in shoot tissues in response to salicylic acid treatment
  misc_feature (174)..(337): Pfam ID: MatE Pfam Description: MatE
  misc_feature (1)..(113): Pfam ID: MatE Pfam Description: MatE
MGSAVETLCGQAYGAHKYDMLGIYLQRSTILLMATGVPLAVIYAFSRPILVLLGESPAIASAAAVFVYGLIPQIFAYAANFPIQKFMQAQSIMAPSAYISAATLAVHVALSYLAVYRWGMGLLGASLILSLSWWVIVVAQFVYIVTSERCRLTWTGFSWEAFSGLPSFFKLSVASAVMLCLETWYFQILVLIAGLLKDPELALSSLSVCMTITGWVFMISVGFNAAASVRVSNELGAGNPKAASFSVVVVTLLSFVLSVLISIVILLCRDYISYIFTEGEDVSRAVSKLTPLLAVTLILNGIQPVLSGVAVGCGWQAFVAYVNVGCYYIVGIPLGCLLGFYFDLGAAGIWSGMIGGTFMQTLILVWVTYRTNWTKEVQEAQKRLNKWNDGKAPLLSAQE

SEQ ID NO: 20270 - DNA, 1575 bp, Sorghum bicolor
  misc_feature: Ceres ANNOT ID no. 8634239
  misc_feature: Up-regulated in root tissues in response to methyl jasmonate treatment
  misc_feature: Up-regulated in shoot tissues in response to methyl jasmonate treatment
  misc_feature: Up-regulated in root tissues in response to salicylic acid treatment
  misc_feature: Up-regulated in shoot tissues in response to salicylic acid treatment
  misc_feature: Encodes the peptide sequence at SEQ ID NO 20271
atgggcacggcgagcgatcagaacacgccgctcctcccggcagatggcggcaacgatgacggcgaaggcgtggcggtgctgccgggcgaagcagctggcggcgccggtggcgggcacggcggggtgagcgcgcagctggagcgtatcctcgccgacgagtcggtgccccgtgcgcggcggctggcgcgcgcggcgcgtgtggagctccgcctgctcgtggcgctggccgcccccgccgtggccgtctacatgatcaactactccatgtccctgtccacgaggatcttctgcgggcagctcggcacgctcgagctcgccgccgcctccctcggcaacgtcggcatccaggtcttcgcgtacggcctcatgctgggcatgggcagcgcggtggagacgctgtgcgggcaggcctacggcgcgcacaagtacgacatgctgggcatctacatgcagcgctccatcgtcctgctcacggccaccggcgtcccgctcgccgtcgtctacgtgttctcgaagcagatcctgctgctcctgggggagtcggagcggatcgcggaggcggcgtgggtgttcgtgctgggcctcatcccgcagatcttcgcctacgccttcaacttcccgatccagaagttcctgcaggcgcagagcatcgtggcgcccagcgcctacatctccacggcggcgctggccgggcacctggtcctcagctggctcgccgtctacaggatggggctgggcctgctgggcgcgtcgctgatcctcagcctcagctggtgggtcatcgtcgtcgcccagttcgtgtacatcgtcaggtcccagaggtgccgccgccggacgtggacgggattctcctgcagggcgttctccggcttgccggagttcctcaagctctcgttcgcgtcggcggtcatgctttgcctcgagacgtggtacacgcagatcaccgtgcttgtagcgggcttgctcaaggacccggagatcgcccttgattcgcttgctgtctgcatgtccatatcaggatgggtgttcatggtatcggtaggcttcaacgctgctgctagcgtgagagtgagcaacgagctcggagccgggcatcccatggcgacatctttctctgtcaaggtcgtgaccacgctgtctctgatggtggcgtccattatagctgtcatcgtcatgtgcctccgcgactacatcagctacgtgttcaccaaaggggatgacgtcgcgcgcgccgtgtccaccatgaccccgctgctcgccgtcaccatcgtgctcaacggcattcagcccgtcctatctggtgtggccgtcggctgcggttggcaggccttcgtggcatatgtgaacatcgcatgctactacggcatcgggatcccgcttggctgtgttttgggattctactttgatctaggtgccatgggaatatggggtggaatgataggtggattgattgttcagacgcttgttcttatctgggtcacacttcgcaccgattggaataaagaggttgaacaagcgcgcatgaggctaaataaatgggaagacaaaaagaagccccttttggcggaagattga

SEQ ID NO: 20271 - protein, 524 aa, Sorghum bicolor
  misc_feature: Ceres ANNOT ID no. 8634239
  misc_feature: Up-regulated in root tissues in response to methyl jasmonate treatment
  misc_feature: Up-regulated in shoot tissues in response to methyl jasmonate treatment
  misc_feature: Up-regulated in root tissues in response to salicylic acid treatment
  misc_feature: Up-regulated in shoot tissues in response to salicylic acid treatment
  misc_feature (78)..(238): Pfam ID: MatE Pfam Description: MatE
  misc_feature (300)..(463): Pfam ID: MatE Pfam Description: MatE
MGTASDQNTPLLPADGGNDDGEGVAVLPGEAAGGAGGGHGGVSAQLERILADESVPRARRLARAARVELRLLVALAAPAVAVYMINYSMSLSTRIFCGQLGTLELAAASLGNVGIQVFAYGLMLGMGSAVETLCGQAYGAHKYDMLGIYMQRSIVLLTATGVPLAVVYVFSKQILLLLGESERIAEAAWVFVLGLIPQIFAYAFNFPIQKFLQAQSIVAPSAYISTAALAGHLVLSWLAVYRMGLGLLGASLILSLSWWVIVVAQFVYIVRSQRCRRRTWTGFSCRAFSGLPEFLKLSFASAVMLCLETWYTQITVLVAGLLKDPEIALDSLAVCMSISGWVFMVSVGFNAAASVRVSNELGAGHPMATSFSVKVVTTLSLMVASIIAVIVMCLRDYISYVFTKGDDVARAVSTMTPLLAVTIVLNGIQPVLSGVAVGCGWQAFVAYVNIACYYGIGIPLGCVLGFYFDLGAMGIWGGMIGGLIVQTLVLIWVTLRTDWNKEVEQARMRLNKWEDKKKPLLAED

SEQ ID NO: 20272 - DNA, 3870 bp, Sorghum bicolor
  misc_feature: Ceres ANNOT ID no. 8634330
  misc_feature: Up-regulated in root tissues in response to methyl jasmonate treatment
  misc_feature: Down-regulated in shoot tissues in response to methyl jasmonate treatment
  misc_feature: Encodes the peptide sequence at SEQ ID NO 20273
atggtggggtgcgagggtgcggccgcggggcacgaaggcggggaggccggggcgtcgccgaggaggggcgaggaggacggcgacgagctcggggatgcgagtgcggagtcgtggagcacgaggtcgatgggggccacgccgagcttctccgcggcgcgcgcgacggcaagtaaaccccatcctacaggcacccctccggccaacaaggaggggcaggccaacaaggaggggcaggacctcaccggcaagttatattttttagagttcaagattggggaaggaggcacaggaggcgctgatgtggtgcagccaaaggttaactgcccacactacactgacaaggatgcttcccgcttgaagaccaattggacggatatatggtctttcaaaggtgctaccttgtgtgagtcttgccaaaaagatgcccgcacggaaaggaagcagaccgcgaagaagaaaaagagtcgcgcaacagtcactaagggacaagccaatgaccaggcaatttgggtatgcttgcattgtggaaggatgttctgcggtggtagagataaggtgccacaaggccatatcagaccacactatcgggataatggtcatttgtgggctgcaagtcctgaagacccaacttcaatctactgcttcaagtgtaagaaggaagtctcaatcagttttctagattttaagctgatggagacaaaaccagaggggggtaagatggcaatgaagaaggtgataaaaaagttggaggatgtgctgtctcctccatcagatctgatggtgtcatcacctccagtagatcagacgatgccgcatgctccatcatgttctgaagggggatctcaccaggtgttgggtccactggatactgacctgaaggtgacaccatctccagatatcaaaacatctgctgacactaatacggaacagctaaaagtctcaccacctggagtgactagtaaatctgctgctgctgaggagggcctggtgatcacaaaggcacgtaatatcgttaaagggctgaaaaattatggtaatacatgctatttcaatgcagtcattcagagtttacttgcacttagtagcatgcgtgcaataatactaaggtcggatgttcaagctggccatcttgccatgcagttaagggaactgtttctgatgacagaagcttcaagtagaacagcagctgaacttaacattgggaggctcctacatgcatttttagacatcaacagtcaatttgcagacaaaaaaatgcagtgtagtcatgattgtttcgtttcttttcgttggtctttgcattgggaggaggttgaggaatggaagcgagcgaaggatgcttcaattgaagatcatataacaataccaaactttatttttataggaacccaatgttcaactgtaactggtaaagtgtgcaagcactcttctcccagtggagcgaccccatttggtgaactgttgctatcagctccatcaaaatctcttggagatagagatgtggtggatggtccaatatcacttgatgactgcttgaaagcgtactttgggcaagttcatataccaaaatgggaatgtactgagtgtaattctggaagaaaagagacagaacctattgtcagagtagatgctgataaaaggtcttgtataatgagggctccaatagttttgactattagtttgggcagaacagtagatgttgataagaagttgtatggtcatgttagctttccgcttgttcttgacatgagtgaattcttgcacccaagatccgtggacaccaggaatgccatgtacaatttggttgctgttattgaacactctggaaccccaggtcttgatggtcattacatttcatatactaaatcaggcagcacttggttccgtgcaagtgatgacatagtagaaccagttcatgaaacagaagttctggcctgtgaggcattcttactcttttatgaaagagtgggagacatagtacctcctcctgcactcttagtcaaagaggaccaatggacttttgttggcaagaagaaaatgaagaaggccatgactccgcagttacctgtaccatcccaacgacataagtctgttgcgcgagcaaaaacctcgtcgaaatttgagaagcctgataagaaattgcagacaacagttcctccagctttttacaaatattctccccatgatggtgatagcacaacatatttagatgtggcagcgaaattgccggatgaggaagtcatagaactttttcagaagttcttgaacacaaattatcaatgcttgaaagggattctcagtggtgacagctcatttctacttaatgtttcatattgtgacattctaaagtactctcgacatcttgctatgacattgtgcaaagactacagcaggttaactaagaaactggaggcagctgcaatagatttctttaaggagtccaagggatctgatcctaaggttattttgaaaattcttcagcgtcctctaaggcatgaaacctggataggctatcgaatgcgtacatgtattttcgcaaagcctatggaagtgtatggacacaaccgatccacattgcaaaattctccaccacagtctaagagtgttatttacaagcctacaacagaggctctcttgatgctaaaaggcatcttatgtgatatgatttcaaagcataagaaaggtttttcttggggtggaaactttgacactgatgatgttgatgtattcaacgggaggatcttcttaatccgtaaatctccaaacaagttcacagacttagctgagctgataaaagctatggaagaggacttccgccaatacaccaaattgttcctctcagagcttattgcatttgtgtccaatggggacagggacattccctatcttggaagctttaatgacatcttgagtaaaatggaggaatttgctaagtattggttagatgaaaagacagcagaaaggttccgtgaattactaataaatcatcctttcttgaaaccttcgataatcagatcttatttgctatcaggcatctacacagcatgccgtgcacatgatttgtcagattctgatgctacattcaaatctacattgaaacttgctggcggcacagttagttggattcgtcaaatcaagactttagcaaatacagtctgcactgctgtgttatgttttgatccaaggacggatcacggcaagaaagaaaatgataaagataaaaggagtggtcaagttgttgaagacgacaaggctgatgagatcttttctgaaaatctagagtcttttgtcgagtatatgagacacacatttcaccacggtcctgatcattcgaaagagaagagaaaacaaatagtggattctgatggtaatttttatgatcctgagaacaagccacgaaagcaatacatgcaaagtctcgaggaaagtgagactggtgctgcagtggcagttgccgaagttgtttgggatcttctgctgctacttgtggtgaaagcaaactgcatcagtgggatgcttgtagatgtatggaaggcttacaaggattaccccaacagcagatggtggtaccagcagactagggttccagctttccaggtctcagtgcgaagatctactgatcaggaggaggtgatgctgagaggaggtgatgctgcaggtaccggtgttgtgggggttgctgggattgccacagaagatgcagaagccactggcgtggagatgagacatgccggagtcgtggcagctgggcctttgctggtggtgtcacaaatggaagaaaactcagatatcattggggagagtgaaatggacgagtggcttagtagcatgctactaggtgatgatggtcaagagggtgtgaatgaataa

SEQ ID NO: 20273 - protein, 1289 aa, Sorghum bicolor
  misc_feature: Ceres ANNOT ID no. 8634330
  misc_feature: Up-regulated in root tissues in response to methyl jasmonate treatment
  misc_feature: Down-regulated in shoot tissues in response to methyl jasmonate treatment
  misc_feature (484)..(656): SWISSPROT Homolog: EC 3.1.2.15 Ubiquitin thiolesterase
  misc_feature (336)..(653): Pfam ID: UCH Pfam Description: Ubiquitin carboxyl-terminal hydrolase
  misc_feature (158)..(232): Pfam ID: zf-UBP Pfam Description: Zn-finger in ubiquitin-hydrolases and other protein
MVGCEGAAAGHEGGEAGASPRRGEEDGDELGDASAESWSTRSMGATPSFSAARATASKPHPTGTPPANKEGQANKEGQDLTGKLYFLEFKIGEGGTGGADVVQPKVNCPHYTDKDASRLKTNWTDIWSFKGATLCESCQKDARTERKQTAKKKKSRATVTKGQANDQAIWVCLHCGRMFCGGRDKVPQGHIRPHYRDNGHLWAASPEDPTSIYCFKCKKEVSISFLDFKLMETKPEGGKMAMKKVIKKLEDVLSPPSDLMVSSPPVDQTMPHAPSCSEGGSHQVLGPLDTDLKVTPSPDIKTSADTNTEQLKVSPPGVTSKSAAAEEGLVITKARNIVKGLKNYGNTCYFNAVIQSLLALSSMRAIILRSDVQAGHLAMQLRELFLMTEASSRTAAELNIGRLLHAFLDINSQFADKKMQCSHDCFVSFRWSLHWEEVEEWKRAKDASIEDHITIPNFIFIGTQCSTVTGKVCKHSSPSGATPFGELLLSAPSKSLGDRDVVDGPISLDDCLKAYFGQVHIPKWECTECNSGRKETEPIVRVDADKRSCIMRAPIVLTISLGRTVDVDKKLYGHVSFPLVLDMSEFLHPRSVDTRNAMYNLVAVIEHSGTPGLDGHYISYTKSGSTWFRASDDIVEPVHETEVLACEAFLLFYERVGDIVPPPALLVKEDQWTFVGKKKMKKAMTPQLPVPSQRHKSVARAKTSSKFEKPDKKLQTTVPPAFYKYSPHDGDSTTYLDVAAKLPDEEVIELFQKFLNTNYQCLKGILSGDSSFLLNVSYCDILKYSRHLAMTLCKDYSRLTKKLEAAAIDFFKESKGSDPKVILKILQRPLRHETWIGYRMRTCIFAKPMEVYGHNRSTLQNSPPQSKSVIYKPTTEALLMLKGILCDMISKHKKGFSWGGNFDTDDVDVFNGRIFLIRKSPNKFTDLAELIKAMEEDFRQYTKLFLSELIAFVSNGDRDIPYLGSFNDILSKMEEFAKYWLDEKTAERFRELLINHPFLKPSIIRSYLLSGIYTACRAHDLSDSDATFKSTLKLAGGTVSWIRQIKTLANTVCTAVLCFDPRTDHGKKENDKDKRSGQVVEDDKADEIFSENLESFVEYMRHTFHHGPDHSKEKRKQIVDSDGNFYDPENKPRKQYMQSLEESETGAAVAVAEVVWDLLLLLVVKANCISGMLVDVWKAYKDYPNSRWWYQQTRVPAFQVSVRRSTDQEEVMLRGGDAAGTGVVGVAGIATEDAEATGVEMRHAGVVAAGPLLVVSQMEENSDIIGESEMDEWLSSMLLGDDGQEGVNE

SEQ ID NO: 20274 - DNA, 1650 bp, Sorghum bicolor
  misc_feature: Ceres ANNOT ID no. 8634525
  misc_feature: Up-regulated in shoot tissues in response to salicylic acid treatment
  misc_feature: Up-regulated in root tissues in response to salicylic acid treatment
  misc_feature: Encodes the peptide sequence at SEQ ID NO 20275
atggcggttggcatgtgggcagtggtgggcttttggtttttggtggtcacccatccaagcactgcaactaggcccaaaattgtagccaatatgatactttcgcatactctcatggttttctatattgggacagatagatttgctatcaaaggttataatagcacgcctgtcctctctcgcagagtcgcagctcgcaccctcaccggaaggcggcttcaggcgcacacagccacgcaaacccccctcttcatcaacctcgaatcgagcccgcgcgcgtccccgaatcgagagaagatgagccgcgctcacgacggccacaagtccttctttccagtggggaatcccttcaggatgattttcccaagaggagcccacctgtctccgaagctcaccgagctcctcgcttcgtatgaggatggcctggcctcgagcttgaggaagctcaagccagaggccacctcagaggtgctcacgctatcatggatgaagctcgccgtggactgcttatcggagctgcacaccaatatagccaccctgattactgagcttgagctgcccttatcggactgggaccagaagtgggtggacatttacctgaacagcagtgtgaagctgctggacatctgcattgcactgagctcagagctctctcggttggatcaagggcagctgcttgtgcgatatctcctgaatgtgttggactctgggagcgacatgccatcccaggagcagctcaagaaagctgcggtgtcgcttaaggaatggatcgagcgagcaagtgaaaggtctccgaggcttgatagctgcttggcagcgctacatgagctttctgggaacctttgcctgatgaaggttaagcattctgctaaggggaaagtgctcatgcgggcattgtatggaatcgaggccgttacagtcttaatctgcagcgtccttgtagccgttctgtcaggtagcttcaagccactggtggagtttgatgtccctgagaaatttggttggtctacggccttcattgatctccgtaaggccataagtggggaacttagcactcaactatccagaggtagtgttccagctgtaaaagagctggaggatgttgaggtatgtgctagacagctgcatgcattgacttgtgctgctcagcttgaagaggagaatgctagcttggctcatgcttttagccattcaaaggaagtggtcctgccagttactacagcccaggaaggaggccatgtggataatcttaagatggctgaggacattagctgtcagcatgaagtcatcatgctgcaaagcattactacaggaggaatggatacagctgacatcaaggaggatgccaagactatcggccatacaaaagaagtgatggtgcctgataaaacaagtgacagaggacacctagatgataacgcaaagcaggccactggtgttggcactgagatcaattgcttggaaaggagagaggagctgctgaactgcatctccagcatgtcgaaaagcgctgaaaggctccggttggggttggactcactgtcgaagcgggtgggtgacttcttccagatcgtacttacagggcgtgatgcactactttgcaatctcaggatttcagatgggggcaaggttgctgcagaggtcaggtcttaa

SEQ ID NO: 20275 - protein, 549 aa, Sorghum bicolor
  misc_feature: Ceres ANNOT ID no. 8634525
  misc_feature: Up-regulated in shoot tissues in response to salicylic acid treatment
  misc_feature: Up-regulated in root tissues in response to salicylic acid treatment
MAVGMWAVVGFWFLVVTHPSTATRPKIVANMILSHTLMVFYIGTDRFAIKGYNSTPVLSRRVAARTLTGRRLQAHTATQTPLFINLESSPRASPNREKMSRAHDGHKSFFPVGNPFRMIFPRGAHLSPKLTELLASYEDGLASSLRKLKPEATSEVLTLSWMKLAVDCLSELHTNIATLITELELPLSDWDQKWVDIYLNSSVKLLDICIALSSELSRLDQGQLLVRYLLNVLDSGSDMPSQEQLKKAAVSLKEWIERASERSPRLDSCLAALHELSGNLCLMKVKHSAKGKVLMRALYGIEAVTVLICSVLVAVLSGSFKPLVEFDVPEKFGWSTAFIDLRKAISGELSTQLSRGSVPAVKELEDVEVCARQLHALTCAAQLEEENASLAHAFSHSKEVVLPVTTAQEGGHVDNLKMAEDISCQHEVIMLQSITTGGMDTADIKEDAKTIGHTKEVMVPDKTSDRGHLDDNAKQATGVGTEINCLERREELLNCISSMSKSAERLRLGLDSLSKRVGDFFQIVLTGRDALLCNLRISDGGKVAAEVRS

SEQ ID NO: 20276 - DNA, 1650 bp, Sorghum bicolor; identical to SEQ ID NO: 20274
  misc_feature: Ceres ANNOT ID no. 8634529
  misc_feature: Up-regulated in shoot tissues in response to salicylic acid treatment
  misc_feature: Up-regulated in root tissues in response to salicylic acid treatment
  misc_feature: Encodes the peptide sequence at SEQ ID NO 20277

SEQ ID NO: 20277 - protein, 549 aa, Sorghum bicolor; identical to SEQ ID NO: 20275
  misc_feature: Ceres ANNOT ID no. 8634529
  misc_feature: Up-regulated in shoot tissues in response to salicylic acid treatment
  misc_feature: Up-regulated in root tissues in response to salicylic acid treatment

SEQ ID NO: 20278 - DNA, 1800 bp, Sorghum bicolor
  misc_feature: Ceres ANNOT ID no. 8634609
  misc_feature: Up-regulated in root tissues in response to salicylic acid treatment
  misc_feature: Encodes the peptide sequence at SEQ ID NO 20279
atgcagcagcgccttctcgcgctggtggcagcggcagccctgctgctggcgctgcggccggcgctggccaccgacccctacgccttcttcgactgggacgtctcctacgtcactgaggcgccgctcggcgtcaagcagcaggtgataggcatcaacggcaagttcccgggccccgtcgtgaacgtcagcaccaactggaacgtcgtcgtcaacgtgctcaacgacctcgacgagcccctcctcatcacctggaacgggatccagcaccggaagaactgctggcaggacggggtgctgggcaccaactgccccatcccgtcaggctggaactggacgtacgagttccaggtcaaggaccagatcggcagcttcttctacttcccctccaccggcctgcagcgcgccgccggcggcttcggcggcatcgtcgtcaacaaccgcgacgtcatcgccgtgcccttcggccgccctgacggcgacatcaccatcttcatcggcgactggtacaacaagaaccacacggatctgaggaagatgctggacaaggggaatgacctcgggatgcccgacggcgtgctgataaacggcaagggtccgtaccggtacaaccacagccttgtgccggccggcatcgagtacgagaccttcaatgtgcatccgggcaggacgtaccgcatccgggtacacaacgtgggcacgtcgacgagcctcaacttccggatccaggggcacaacatggtgctggtggagacggagggctcctacacctcgcagcagaactacacgaacctggacgtccacgtcggccagtcctactccttcctcgtcaccacggaccagaacgccagctccgactactacgtcgtggccagcgcccggcaggtgaacgagtccctctggcgccgcgtcaccggcgtcgcggtgctccgctactccaactccagggcccccgcctccggccccctcccggacccgccgcaggaccagaacgaccgcaccttctccatgaaccaggcgaggtccgtccggtggaacctgagcgccggcgccgcgcgccccaacccgcagggctcgttccgctactcgtccatcaacgtcacgcaggcgtacctgctgcggagcacggcgcccgtgtccatcgacggcaggcgccgcgccacgctgaacgggctctcctacgcgccgccggagacgcccctgcggctggcggacgcgtacggggtcaagggcgtgtacacgctcgacttccccgagcggccactcaacaagggcgccccgaggatcgcgcgctccgtcatcaacggcacctaccgtgggttcatggagctcatcttccagaacaacgacaccaggatgcagagctaccacatggatggatacgccttcttcgtcgtcgggatggactacggcgagtggacggaggacagcaggggaacgtacaacaagggagacggcgtggcgcggagcacgatacaggtgtacccgggcgcgtgggcggcggtgctggtgtccctggacaacgtcggcgtctggaacgtgcggtccgagaacctggactcgtggtacctggggcaagaggtctacgtcagggtcgtcaaccctgaggacaccggcaacaagaccgagatgggcatccccgacaacgccctctactgcggccagctccacaagtaccagaaggagcagacgccgcaccacaagatgggggtgtctgctgtggcgccgagctcgttgtccctggcgcgccggctggtcgcgtcggcgctgctcgtggccggatccttcgtgttggcgccgtag

SEQ ID NO: 20279 - protein, 599 aa, Sorghum bicolor
  misc_feature: Ceres ANNOT ID no. 8634609
  misc_feature: Up-regulated in root tissues in response to salicylic acid treatment
  misc_feature (30)..(553): SWISSPROT Homolog: EC 1.10.3.3 L-ascorbate oxidase
  misc_feature (159)..(314): Pfam ID: Cu-oxidase Pfam Description: Multicopper oxidase
  misc_feature (33)..(149): Pfam ID: Cu-oxidase_3 Pfam Description: Multicopper oxidase
  misc_feature (397)..(537): Pfam ID: Cu-oxidase_2 Pfam Description: Multicopper oxidase
MQQRLLALVAAAALLLALRPALATDPYAFFDWDVSYVTEAPLGVKQQVIGINGKFPGPVVNVSTNWNVVVNVLNDLDEPLLITWNGIQHRKNCWQDGVLGTNCPIPSGWNWTYEFQVKDQIGSFFYFPSTGLQRAAGGFGGIVVNNRDVIAVPFGRPDGDITIFIGDWYNKNHTDLRKMLDKGNDLGMPDGVLINGKGPYRYNHSLVPAGIEYETFNVHPGRTYRIRVHNVGTSTSLNFRIQGHNMVLVETEGSYTSQQNYTNLDVHVGQSYSFLVTTDQNASSDYYVVASARQVNESLWRRVTGVAVLRYSNSRAPASGPLPDPPQDQNDRTFSMNQARSVRWNLSAGAARPNPQGSFRYSSINVTQAYLLRSTAPVSIDGRRRATLNGLSYAPPETPLRLADAYGVKGVYTLDFPERPLNKGAPRIARSVINGTYRGFMELIFQNNDTRMQSYHMDGYAFFVVGMDYGEWTEDSRGTYNKGDGVARSTIQVYPGAWAAVLVSLDNVGVWNVRSENLDSWYLGQEVYVRVVNPEDTGNKTEMGIPDNALYCGQLHKYQKEQTPHHKMGVSAVAPSSLSLARRLVASALLVAGSFVLAP

SEQ ID NO: 20280 - DNA, 1026 bp, Sorghum bicolor
  misc_feature: Ceres ANNOT ID no. 8634737
  misc_feature: Down-regulated in shoot tissues in response to methyl jasmonate treatment
  misc_feature: Down-regulated in root tissues in response to methyl jasmonate treatment
  misc_feature: Down-regulated in shoot tissues in response to salicylic acid treatment
  misc_feature: Encodes the peptide sequence at SEQ ID NO 20281
atggggagagagaaatgttctagcagcagagataacaagaaacctgatgaggtgaagtatgaatcagatgatgatatgttgctgcaacgaaaagacaggcgcaaggtggagtttgccttcttgcgctcgttgaggatgatgctgccggtttactcaacgttggctgtttgtttcttggcctgtcatattgcccgtgaagccatcctgccaaacgacatttacaggtgggcaatggaggggaatgtcccttatgtggctgcatttaccgaagtagacaggttccttgggagctctttccaagactgccctttggatgcaaggcagctgttcaggccggtgcgagttattggagcatggcaactggaagctgcagttggatccatagcacaaaaagtaggcttgaggcttccttcagttaacttctatgcaattgctcatcgttgtttgaaggacttgttactacctatagatagaatcctcccccacgcatgccgaatttatgagtgggcaatgcctgcagaattgtggttgtctagtaatcctgctagagtccctacacgggtttgtgtgatggctatcctaattgtggccctacgacttctttataacatcaacggtcaagggatatgggagaagatttgtgaggaaggaagaaacacaagtgaatctcaccatgatacaaattcatcaactttcaggaagcttgaggctagtaacagtgaggagtttggcacaagagaactgttgtgtgctattgcagctgcctatgataaaatcaatacgacacatgctaggatcgagaagggtgagatggggaagcagcgactgcttgcgtgctacagtacctgcagagctacattacctgcaggttgtagggaggagagtggagaggttgagggcgtgagcgttggcggcggcggagagctgtcgctggcagagcaggaagacatacagggaaacagggaaggggtgctgggtgcccaagggtgtcttagacacaatcccaggctgagcctgattcattaa

SEQ ID NO: 20281 - protein, 341 aa, Sorghum bicolor
  misc_feature: Ceres ANNOT ID no. 8634737
  misc_feature: Down-regulated in shoot tissues in response to methyl jasmonate treatment
  misc_feature: Down-regulated in root tissues in response to methyl jasmonate treatment
  misc_feature: Down-regulated in shoot tissues in response to salicylic acid treatment
MGREKCSSSRDNKKPDEVKYESDDDMLLQRKDRRKVEFAFLRSLRMMLPVYSTLAVCFLACHIAREAILPNDIYRWAMEGNVPYVAAFTEVDRFLGSSFQDCPLDARQLFRPVRVIGAWQLEAAVGSIAQKVGLRLPSVNFYAIAHRCLKDLLLPIDRILPHACRIYEWAMPAELWLSSNPARVPTRVCVMAILIVALRLLYNINGQGIWEKICEEGRNTSESHHDTNSSTFRKLEASNSEEFGTRELLCAIAAAYDKINTTHARIEKGEMGKQRLLACYSTCRATLPAGCREESGEVEGVSVGGGGELSLAEQEDIQGNREGVLGAQGCLRHNPRLSLIH

SEQ ID NO: 20282 - DNA, 600 bp, Sorghum bicolor
  misc_feature: Ceres ANNOT ID no. 8634804
  misc_feature: Down-regulated in shoot tissues in response to salicylic acid treatment
  misc_feature: Encodes the peptide sequence at SEQ ID NO 20283
atggctaccgtgaggggaatccgtgctctctatgcagttgtcgcgctgctacttctcatggcccttcacacaccaggccggctggcgcaggcggccttcccataccgttccctgctccagacctgccagcccagcggctccatccccggccgttccggcaactgcaacacggagaacggctccgagtgctgcaagaacgggcagagctacaccacctacgactgctcgccgcccgtcacgggtagcaccggcgccctactcacgctcaacagcttcgccgagggcggggacggcggcggtgccgccgcctgcacgggggagttctacgacgacagcaagaaggtggtcgcgctgtcaactggctggtacaacggcggtagccggtgtagcaagcacatcgtgatccgcgcgacgagcaacgggaacaccgtgagggcgttggtcgtcgacgagtgcgactccaccgtaggctgcgacaaggaccacaactttgagccgccgtgccggaacaacatcgtcgacgggtcaccggcggtgtgggacgctctggggctcaacacggacgacggccaggcccagatcacctggtccgacgagtga

SEQ ID NO: 20283 - protein, 199 aa, Sorghum bicolor
  misc_feature: Ceres ANNOT ID no. 8634804
  misc_feature: Down-regulated in shoot tissues in response to salicylic acid treatment
MATVRGIRALYAVVALLLLMALHTPGRLAQAAFPYRSLLQTCQPSGSIPGRSGNCNTENGSECCKNGQSYTTYDCSPPVTGSTGALLTLNSFAEGGDGGGAAACTGEFYDDSKKVVALSTGWYNGGSRCSKHIVIRATSNGNTVRALVVDECDSTVGCDKDHNFEPPCRNNIVDGSPAVWDALGLNTDDGQAQITWSDE

SEQ ID NO: 20284 - DNA, 2841 bp, Sorghum bicolor
  misc_feature: Ceres ANNOT ID no. 8634973
  misc_feature: Up-regulated in shoot tissues in response to aminocyclopropane carboxylic treatment
  misc_feature: Down-regulated in shoot tissues in response to aminocyclopropane carboxylic treatment
  misc_feature: Encodes the peptide sequence at SEQ ID NO 20285
atgccctttcgaccacgcatccccctccgcctcctcctgcctcacctccagcaccgcactagtccccgcccacccagacctccacgtagaccgctctcctactctcccgcggcggcgttgtcggcggctggaacagagtccgaggaggaggcggttgtgggtagggacgcgccgctagcccctccccgcgcaggcggggcgggaggtggacagcctgggggtggctgggcacggcaggggacgctcgatgaggacagggcggagctcgagcggaagacctctatcgccgcacggttcaggcactgccatgagcttctgtggcagactaggtggcgggagatgcgcgacgggttggcccagatggtggacgaacaaggttctgattctgctccgactctatgtgatattctgtggagtggattcaaggagtgggattcaaacagcattgtgtgggacgctctagcaaatagttatgctagagctcagatgaatcatgatgctctttatgttcttagtaaaatgagcagcctaaacatgcaaatctcaataaccacctatgacagtttgttgtacagtctaagaaaggcagatgtggcactggagatttttaaagagatggagtcatgtggtattccccccagtgattattcccatagcattctcatagatggcctctgcaagcaagataaaattggagaagctttatctttccttcaagagattaggaaagaggggaaattcataccattgggaatgacctttaacactctcatgtctgcattgtgtaattgggggttcattcaggatgcaaaatcagttttctgcctgatgttgaagtatggattaaatccgagcaggcacacatattcaaccattatacatggtctatgtaaaataggttctgtaagtgaagcattcaatatctttcagagtgtgacagaagaaggaatggaacttgatattgtcacttgcaacagccttattaatggctttcgcttgcatggtcatacaagagaaattccaaaaatgattgagatgatgaggggcctaggtgtcgaacccgatattgttacttatactatacttattgctggccactgtgaaggtggtgatgttgaagaagggatgaagataagaaaggacatcttaggccaaggtatggagctgaatattgtcacatatagcgtccttatcaatgctctcttcaagaagggcctgttttatgaggtcgaaaacctacttggtgagatatgcagtgttggtctggaattggatgttattgcatattccatcctaatccatgggtactccaagctaggagaaattggaagagcacttcaagtctggaatctaatgtgctcttctcagagggtaactccaacttcagtaaaccatgtatctattcttctaggcctttgcaagaaaggattccttgatgaagcaaggtcatatttggaaactatagctagcaaatatcagccatccgatgtagtcctctacaatgtagttattgatggttatgcaaaagtgggtgatattggtaatgctgttcagctgtatgatgcgattattatggctggtatgtgcccaaccattgtaacatgcaattctcttctatatggttactgcaaatttggggatctgcatatggcagagagctattttacggctattcagttaagtgatctgctgccaacaacagttacatacaccaccttgatggatgcactctctgaagctgggaaagttcattccatgctaagtctttttaaagaaatgactggaaaaggtatcaaaccaaatgcagtaacttacagtgtagttattaaaggactttgtaagcagttcatgttccatgatgccaagaatgttcttgatgatatgtgtatagaaggttttgatgcagatccaataccttacaacacgcttatacaaggtttttgtgaaacgcaggacgccaaaaatgctttcggtgtgtatgaactaatggtatttcgtggagtgatgcccacacctgttacttataacttgcttgttaacgtgttgtgctcaaagggactagttattcatgctgaaatgcaactggagtccttcagaaaacagggtgccaagctgagaaaatttgcatacataacacttatcaaagctcaatgtgcaaaagggatgccttacaaggccattatgtggtttggcaagcttctagatgcagggtttgaggcatctattgaagacttcagtgcagcaatcaaccgactatgcaaaagacagttcaccaaagaagctttgatgctcgtaccaatcatgctatctgttggtgtttatccagatgttgaactataccgtgtattgggtacagctgtacagaagaaaaatgagttattctatttacccatattgcaagcccttgctattaaaactgttgcaatatctgccatgtttagatgggcatttagggctgttgcccactgtcaatcgctgggtcagcatgactgtgccaaagcacaagctctcgcaagtgtttgcttcaagcatggactggggaacaaatctagctgcctgttcttgaccccttccggtccaaggaggagcaggcaggaactccggcatacagtggtccttggcggcaccttcgagcgtctccatggcggccaccgctgccttctcagagtttacttggatgcagagcaaagcaggagagatgatctagaatctctcggttatgtcttatgtactttcttaggggcagagtttatctcctactttcactactgtcgttcatcgtggtttgaagacaggcctgattattcttacctgaagagactatctatgatctctttatag

SEQ ID NO: 20285 - protein, 946 aa, Sorghum bicolor
  misc_feature: Ceres ANNOT ID no. 8634973
  misc_feature: Up-regulated in shoot tissues in response to aminocyclopropane carboxylic treatment
  misc_feature: Down-regulated in shoot tissues in response to aminocyclopropane carboxylic treatment
  misc_feature (909)..(941): SWISSPROT Homolog: EC 2.7.11.1 Non-specific serine/threonine protein kinase
  misc_feature (568)..(602): Pfam ID: PPR Pfam Description: PPR repeat
  misc_feature (252)..(286): Pfam ID: PPR Pfam Description: PPR repeat
  misc_feature (287)..(321): Pfam ID: PPR Pfam Description: PPR repeat
  misc_feature (322)..(356): Pfam ID: PPR Pfam Description: PPR repeat
  misc_feature (357)..(391): Pfam ID: PPR Pfam Description: PPR repeat
  misc_feature (392)..(426): Pfam ID: PPR Pfam Description: PPR repeat
  misc_feature (498)..(532): Pfam ID: PPR Pfam Description: PPR repeat
  misc_feature (638)..(672): Pfam ID: PPR Pfam Description: PPR repeat
  misc_feature (603)..(637): Pfam ID: PPR Pfam Description: PPR repeat
  misc_feature (533)..(567): Pfam ID: PPR Pfam Description: PPR repeat
  misc_feature (427)..(461): Pfam ID: PPR Pfam Description: PPR repeat
MPFRPRIPLRLLLPHLQHRTSPRPPRPPRRPLSYSPAAALSAAGTESEEEAVVGRDAPLAPPRAGGAGGGQPGGGWARQGTLDEDRAELERKTSIAARFRHCHELLWQTRWREMRDGLAQMVDEQGSDSAPTLCDILWSGFKEWDSNSIVWDALANSYARAQMNHDALYVLSKMSSLNMQISITTYDSLLYSLRKADVALEIFKEMESCGIPPSDYSHSILIDGLCKQDKIGEALSFLQEIRKEGKFIPLGMTFNTLMSALCNWGFIQDAKSVFCLMLKYGLNPSRHTYSTIIHGLCKIGSVSEAFNIFQSVTEEGMELDIVTCNSLINGFRLHGHTREIPKMIEMMRGLGVEPDIVTYTILIAGHCEGGDVEEGMKIRKDILGQGMELNIVTYSVLINALFKKGLFYEVENLLGEICSVGLELDVIAYSILIHGYSKLGEIGRALQVWNLMCSSQRVTPTSVNHVSILLGLCKKGFLDEARSYLETIASKYQPSDVVLYNVVIDGYAKVGDIGNAVQLYDAIIMAGMCPTIVTCNSLLYGYCKFGDLHMAESYFTAIQLSDLLPTTVTYTTLMDALSEAGKVHSMLSLFKEMTGKGIKPNAVTYSVVIKGLCKQFMFHDAKNVLDDMCIEGFDADPIPYNTLIQGFCETQDAKNAFGVYELMVFRGVMPTPVTYNLLVNVLCSKGLVIHAEMQLESFRKQGAKLRKFAYITLIKAQCAKGMPYKAIMWFGKLLDAGFEASIEDFSAAINRLCKRQFTKEALMLVPIMLSVGVYPDVELYRVLGTAVQKKNELFYLPILQALAIKTVAISAMFRWAFRAVAHCQSLGQHDCAKAQALASVCFKHGLGNKSSCLFLTPSGPRRSRQELRHTVVLGGTFERLHGGHRCLLRVYLDAEQSRRDDLESLGYVLCTFLGAEFISYFHYCRSSWFEDRPDYSYLKRLSMISL

SEQ ID NO: 20286 - DNA, 999 bp, Sorghum bicolor
  misc_feature: Ceres ANNOT ID no. 8635001
  misc_feature: Down-regulated in shoot tissues in response to methyl jasmonate treatment
  misc_feature: Down-regulated in root tissues in response to methyl jasmonate treatment
  misc_feature: Down-regulated in shoot tissues in response to salicylic acid treatment
  misc_feature: Down-regulated in shoot tissues in response to aminocyclopropane carboxylic treatment
  misc_feature: Encodes the peptide sequence at SEQ ID NO 20287
atggcgaaggacccgatgcgcgtgctcgtcactggcgccgcaggacaaattggatatgctcttgttcccatgattgcgaggggagttatgcttggtgcagaccagcctgttattctgcacatgcttgacattccgccagcagctgaagcccttaacggcgttaagatggagttggttgatgctgcatttcctcttctgaagggagttgttgcaacaactgatgttgtggaagcctgcactggtgtgaatgtggccgtcatggtcggtggattccccaggaaggagggaatggaaaggaaagatgttatgtcgaaaaatgtttcaatctacaaagcccaagcatctgcccttgaagcccatgcggcccccaactgcaaggttctagtggtagccaacccagcaaacaccaatgctcttatcttgaaagaattcgctccatctattcctgagaagaacgttacttgcctgacccgtctggaccacaacagggctcttggccagatttctgagagactcagtgtccaagttagtgatgtgaagaacgttatcatctggggtaaccactcatccacccagtaccctgatgttaaccatgccacagtgaagacttccacaggggagaagcctgttcgtgagcttgttgctgatgatgagtggcttaatggcgaattcatcacaactgtccaacagcgtggtgctgcaatcatcaaagcgagaaagctctccagtgctctctcagctgctagctctgcttgtgaccacattcgtgattgggttcttggaacccctgagggaacatttgtttccatgggtgtgtactctgatggctcatacggtgttccttctggacttatttactcattcccagtaacatgcagtggtggtgaatggaaaatcgttcaaggcctcccgattgacgagttctcaaggaagaagttggacgccactgcccaagagctgtcggaagagaagacgcttgcttactcatgcctcgagtaa

SEQ ID NO: 20287 - protein, 332 aa, Sorghum bicolor
  misc_feature: Ceres ANNOT ID no. 8635001
  misc_feature: Down-regulated in shoot tissues in response to methyl jasmonate treatment
  misc_feature: Down-regulated in root tissues in response to methyl jasmonate treatment
  misc_feature: Down-regulated in shoot tissues in response to salicylic acid treatment
  misc_feature: Down-regulated in shoot tissues in response to aminocyclopropane carboxylic treatment
  misc_feature (1)..(332): SWISSPROT Homolog: EC 1.1.1.37 Malate dehydrogenase
  misc_feature (157)..(331): Pfam ID: Ldh_1_C Pfam Description: lactate/malate dehydrogenase, alpha/beta C-terminal domain
  misc_feature (6)..(155): Pfam ID: Ldh_1_N Pfam Description: lactate/malate dehydrogenase, NAD binding domain
MAKDPMRVLVTGAAGQIGYALVPMIARGVMLGADQPVILHMLDIPPAAEALNGVKMELVDAAFPLLKGVVATTDVVEACTGVNVAVMVGGFPRKEGMERKDVMSKNVSIYKAQASALEAHAAPNCKVLVVANPANTNALILKEFAPSIPEKNVTCLTRLDHNRALGQISERLSVQVSDVKNVIIWGNHSSTQYPDVNHATVKTSTGEKPVRELVADDEWLNGEFITTVQQRGAAIIKARKLSSALSAASSACDHIRDWVLGTPEGTFVSMGVYSDGSYGVPSGLIYSFPVTCSGGEWKIVQGLPIDEFSRKKLDATAQELSEEKTLAYSCLE

SEQ ID NO: 20288 - DNA, 933 bp, Sorghum bicolor
  misc_feature: Ceres ANNOT ID no. 8636073
  misc_feature: Up-regulated in root tissues in response to aminocyclopropane carboxylic treatment
  misc_feature: Up-regulated in shoot tissues in response to salicylic acid treatment
  misc_feature: Encodes the peptide sequence at SEQ ID NO 20289
atgggctactcgaagctgattgcattattagtacttgtcccggctcttgtagccgtccatgtccatgtcccaatggccagcgcagcgaactccaacctgttccgggactacatcggcgccatcttcaatggcgtcaagttcaccgacgttcccatcaaccctagagtccgattcgacttcatcatggccttcgtcatcgactacaccaccgccacggagccgcccaccccgaccaacgggcagttcaacatcttctggcagaactcggtgctcaccgcctccgcggtggccggcatcaagcagagcaacccgaacgtgagggtggccatcagcctcggcggcgccaccgtgaacgaccggccggtgtacttcaacatcacctccgtggagtcctgggtcgagaacgccgtctcctccctgaccagcatcatccacgagtacaacctggacggcatcgacatcgactacgagcagttccaggcggacccggcgaccttcgccgagtgcatcggccgcctggtgaccacgctcaagagcaacggcgtgatcaagttcgcgtccatcgcgccgtacggcaacgccgacgtgcagcgccattaccaggcactgtgggcgagctacgggagcgtcatagactacgtcaactaccagttctacgcgtacggcgccagcacgacggaggcgcagtacgtggactacttcgaccagcagctcgtcaactaccccggaggcaacatcctggccagcttcacgacggcggccaccacgacgtcggtgtccatcaacacgtcgctcagcgcttgccagacgctgcagtcgcagggcaagctctacgggatcttcatctgggccgccgatcattccaggagccaaggattcaagtacgacacacaagcacaagcgctgctcgccaacgcccctgctggctactag

SEQ ID NO: 20289 - protein, 310 aa, Sorghum bicolor
  misc_feature: Ceres ANNOT ID no. 8636073
  misc_feature: Up-regulated in root tissues in response to aminocyclopropane carboxylic treatment
  misc_feature: Up-regulated in shoot tissues in response to salicylic acid treatment
  misc_feature (33)..(305): SWISSPROT Homolog: EC 3.2.1.14 Chitinase
  misc_feature (43)..(288): Pfam ID: Glyco_hydro_18 Pfam Description: Glycosyl hydrolases family 18
MGYSKLIALLVLVPALVAVHVHVPMASAANSNLFRDYIGAIFNGVKFTDVPINPRVRFDFIMAFVIDYTTATEPPTPTNGQFNIFWQNSVLTASAVAGIKQSNPNVRVAISLGGATVNDRPVYFNITSVESWVENAVSSLTSIIHEYNLDGIDIDYEQFQADPATFAECIGRLVTTLKSNGVIKFASIAPYGNADVQRHYQALWASYGSVIDYVNYQFYAYGASTTEAQYVDYFDQQLVNYPGGNILASFTTAATTTSVSINTSLSACQTLQSQGKLYGIFIWAADHSRSQGFKYDTQAQALLANAPAGY

SEQ ID NO: 20290 - DNA, 1557 bp, Sorghum bicolor
  misc_feature: Ceres ANNOT ID no. 8636152
  misc_feature: Down-regulated in root tissues in response to salicylic acid treatment
  misc_feature: Down-regulated in shoot tissues in response to salicylic acid treatment
  misc_feature: Encodes the peptide sequence at SEQ ID NO 20291
atggaggaggcggtggaggctgtggttgccgccggagtggagccgttcccgacggtggacaagtgcgacgcctcgggcctcggcgcgcactcctccgtggtggcggaccttgacggcacgctgctccggtcccgcagcgcgttcccgtactacgcgctggtggccttcgagaccggcggcgtgccacgcctgctcctcctcctgctcctctccccgctggccgccttgctgcgcttcctggcgtcggagtccgcgtgcctgcgcgtgctggtgttcggtgccacggcgggcgcccgtgtccgcgacgtcgagtccgcggcgcgcgccgtgctccccaggttctacgccgccgacgtgcacccggcggcctggcgcgtcttctccgcgtgctcccggaggcgcgtcgtgctcacggccacgcccaggctcttcgccgagccgttcctcagggactgcctcggcgccgacgccgtcgcgggcaccgagctcgccacgtggcgcggacgcgccacgggcttggtggacgcgcgcaggggcggcgtcctcgtcggcaggagcaaggcccaggcgctgcgggagatcttggccgccgacggcggcgacgcgcccgacgtcggactcggggacagccgctccgactaccccttcatgagcatgtgcaaggaggcgtacatcgtaccgcgcgcgccggtggagccggcattgcccatggaccagctgcctcgtccggtcatcttccacgacgggcgcctggtgcgccggccgacgccgctggtggcgctggtggtggtgctgtggttccccgtggggcttgcgctggcctgcctccgcatcgcggcgggggcgctgctgcccatgccgctggtgtactacgccttctgggcgctgggcgtgcgcgtcgtggtgcggggcgcgccgccgccgccgcgcgccgagcgcgccacggggcggaggggcgtcctcttcgcctgctcgcaccggacgctgctggaccccatcttcctgtccacggcgctgggccgccccgtcgccgccgtcacctactcgctctccaggctctccgagttcctgtcgcccatccggacggtgcgcctgtcgcgggaccgcgccacggacgccgccatgatcagggacctgctggcggagggagacctggtcatctgccccgaggggaccacgtgccgggagcccttcctgctgcgcttctcggcgctcttcgccgagctcaccagcgaggtggtgcccgtcgccatggagaacaggatgagcatgttccacggcaccaccgccagggggtggaaagggatggaccccttctacttcttcatgaacccgagcccggcctacgtcgtcaccttcctcaacaagctcccgccggagctcacctgcgccggcggcaggaccagccacgaggtggccaactacatccagaggctcatcgccgccacgctctcctacgagtgcacaagcctcaccaggaaggacaagtaccgggcgcttgcaggcaacgacggagtcgtcgccaccccaaagccgccgccaacggttgctagctag

SEQ ID NO: 20291 - protein, 518 aa, Sorghum bicolor
  misc_feature: Ceres ANNOT ID no. 8636152
  misc_feature: Down-regulated in root tissues in response to salicylic acid treatment
  misc_feature: Down-regulated in shoot tissues in response to salicylic acid treatment
  misc_feature (321)..(505): SWISSPROT Homolog: EC 2.3.1.15 Glycerol-3-phosphate O-acyltransferase
  misc_feature (299)..(419): Pfam ID: Acyltransferase Pfam Description: Acyltransferase
MEEAVEAVVAAGVEPFPTVDKCDASGLGAHSSVVADLDGTLLRSRSAFPYYALVAFETGGVPRLLLLLLLSPLAALLRFLASESACLRVLVFGATAGARVRDVESAARAVLPRFYAADVHPAAWRVFSACSRRRVVLTATPRLFAEPFLRDCLGADAVAGTELATWRGRATGLVDARRGGVLVGRSKAQALREILAADGGDAPDVGLGDSRSDYPFMSMCKEAYIVPRAPVEPALPMDQLPRPVIFHDGRLVRRPTPLVALVVVLWFPVGLALACLRIAAGALLPMPLVYYAFWALGVRVVVRGAPPPPRAERATGRRGVLFACSHRTLLDPIFLSTALGRPVAAVTYSLSRLSEFLSPIRTVRLSRDRATDAAMIRDLLAEGDLVICPEGTTCREPFLLRFSALFAELTSEVVPVAMENRMSMFHGTTARGWKGMDPFYFFMNPSPAYVVTFLNKLPPELTCAGGRTSHEVANYIQRLIAATLSYECTSLTRKDKYRALAGNDGVVATPKPPPTVAS

SEQ ID NO: 20292 - DNA, 1407 bp, Sorghum bicolor
  misc_feature: Ceres ANNOT ID no. 8636744
  misc_feature: Up-regulated in shoot tissues in response to salicylic acid treatment
  misc_feature: Encodes the peptide sequence at SEQ ID NO 20293
atggctccatccagcaagcttgtcaagacgagctcactcccgaagcaccagcgcagtcttgtccagccgctccattctcccaggcacaagcgcgtctctgccttgtgcccggctgcacctgagtcgttgctccaagagttggtcaccgccgccgccgcctgcgacgcccatcatcagccaagagcaaagcgcgcctccgacgagactctcgccgtgcacgctggggagaacctcgggaagaagggcgcggacgtggttggcactggcactggcaccgagacagactcgatcgccaccccgatcgtgagcggcacgacgcactggttcaagagctccgaggacctcatcgccttcaaggaaggccggcgccacagcttcgagtacgggcgctacagcaacccgacggtgaaggtgctggaggacaagatcagcgcgctggagagagccgaggcgaccctggtgacctcctccggcatgaacgccatcaccacgacgctcctcgccctcgtcccgcccggcggccacgtggtgaccaccaccgactgctacagcgaggcgcgcgtgttcatccgtgacaagctctccaggatgggcatccgatcgacgttcatcgacctcgacgacggcatggagtcgctaagtgccgtccttgacgaggacgacgacgacgtgaccctcttctacgccgactccccgacgaacccgacgctcaagtgcgtggatatcaggcacgcggctgagctctgtcaccggaagggtgccctggtgtgcatcgacagcaccatggcgtcgcccatcaaccagaagccgctcaccctcggtgccgaccttgtcctgcactccgccaccaagtacatggccggccaccatgatgccatcgccggatgcgtcagcggttcggcggcgctcatctccagaatacgcgcttggcaccacgacatcgggggcgccatctctccgaacgcggcgtacatggtcatccgtgggctcaaaacgatggcgctccgcgtggaggcacataacagtacggcgctgcgaatggcacgcatcctagagcgccacccaaagatcgagcgggtgcactaccctgggctggagagcagcccctggcatgaggttgcgacgagtcagatgtcggggtacggaggcgttgtgagcttcgagctgaaggcggacttgcatggtaccatgagctttgtggatgcgctagaaatccccttcatcgcgacctcgctaggcgggtgcgagagcctggtgcagcagccggcggtcatgtcattctggggacagagccaggaggagaaggccaagaatggcatcaaggacaacatggtcaggttcagttttggaattgagaagtttcaggatctcagggatgatatacttcaagcgctaaacaggatttaa

SEQ ID NO: 20293 - protein, 468 aa, Sorghum bicolor
  misc_feature: Ceres ANNOT ID no. 8636744
  misc_feature: Up-regulated in shoot tissues in response to salicylic acid treatment
  misc_feature (41)..(468): SWISSPROT Homolog: EC 2.5.1.48 Cystathionine gamma-synthase
  misc_feature (68)..(466): Pfam ID: Cys_Met_Meta_PP Pfam Description: Cys/Met metabolism PLP-dependent enzyme
MAPSSKLVKTSSLPKHQRSLVQPLHSPRHKRVSALCPAAPESLLQELVTAAAACDAHHQPRAKRASDETLAVHAGENLGKKGADVVGTGTGTETDSIATPIVSGTTHWFKSSEDLIAFKEGRRHSFEYGRYSNPTVKVLEDKISALERAEATLVTSSGMNAITTTLLALVPPGGHVVTTTDCYSEARVFIRDKLSRMGIRSTFIDLDDGMESLSAVLDEDDDDVTLFYADSPTNPTLKCVDIRHAAELCHRKGALVCIDSTMASPINQKPLTLGADLVLHSATKYMAGHHDAIAGCVSGSAALISRIRAWHHDIGGAISPNAAYMVIRGLKTMALRVEAHNSTALRMARILERHPKIERVHYPGLESSPWHEVATSQMSGYGGVVSFELKADLHGTMSFVDALEIPFIATSLGGCESLVQQPAVMSFWGQSQEEKAKNGIKDNMVRFSFGIEKFQDLRDDILQALNRI

SEQ ID NO: 20294 - DNA, 933 bp, Sorghum bicolor
  misc_feature: Ceres ANNOT ID no. 8636834
  misc_feature: Down-regulated in shoot tissues in response to salicylic acid treatment
  misc_feature: Encodes the peptide sequence at SEQ ID NO 20295
atggcgagctccgcgctgagacggtctatcccgcggcgtacctcgctccgccactccgttcctccccacctgccgcccgcagctgccggcgccttccgtcgttcgttccagtctggggatggtggggagaccgtggaggaattcgatgaacggctgtttgggagcaagggcacagaagaagggtctctctatgcgaagcttgacagggctgagaatgctagtaggagatacggcatgggctctggaatgggtggtttcgctgggttgggtgataggaggagctctgggtcatccatgggtcgtttccctgggttcaatgacaggagcggctctgggtcagccatgggtggttttggtgcgcttagcgacaagagcagctcagggttcattggtttatatgattcttcgaatgatagtataaatcagacgctgggtaatgtggcacgcttccaaacagatgatgacagcagcgaagatgatcagtgggaagaggatgattttgacttcaggcctgatgtgacgtataggcgaggatcgacttattctgttcgggaccttgaccttacaagacctgcagccgcaaagaatcctcctagaccacagtttgaaacaactacagcggaggttttgaggaaggctgattttaggaacgttagattcctctcccactttcttacggaagctggaattatcatcaagagaagccagacccgtataagtgcaaaagctcagcgtaagattgcaagagagatcaaaaccgcgcgtgcatttgggctaatgccttttacaacaatgggtagaagaccattcatctttggcagaagtgcggaggagcactattcagaggaggaatatttcggctttgggaggcagagggatagtgagcctgttgaggataatggggacgaggagccaaatgtggaggttgcataa

SEQ ID NO: 20295 - protein, 310 aa, Sorghum bicolor
  misc_feature: Ceres ANNOT ID no. 8636834
  misc_feature: Down-regulated in shoot tissues in response to salicylic acid treatment
  misc_feature (207)..(260): Pfam ID: Ribosomal_S18 Pfam Description: Ribosomal protein S18
MASSALRRSIPRRTSLRHSVPPHLPPAAAGAFRRSFQSGDGGETVEEFDERLFGSKGTEEGSLYAKLDRAENASRRYGMGSGMGGFAGLGDRRSSGSSMGRFPGFNDRSGSGSAMGGFGALSDKSSSGFIGLYDSSNDSINQTLGNVARFQTDDDSSEDDQWEEDDFDFRPDVTYRRGSTYSVRDLDLTRPAAAKNPPRPQFETTTAEVLRKADFRNVRFLSHFLTEAGIIIKRSQTRISAKAQRKIAREIKTARAFGLMPFTTMGRRPFIFGRSAEEHYSEEEYFGFGRQRDSEPVEDNGDEEPNVEVA

SEQ ID NO: 20296 - DNA, 1683 bp, Sorghum bicolor
  misc_feature: Ceres ANNOT ID no. 8637584
  misc_feature: Down-regulated in root tissues in response to methyl jasmonate treatment
  misc_feature: Down-regulated in shoot tissues in response to methyl jasmonate treatment
  misc_feature: Encodes the peptide sequence at SEQ ID NO 20297
atggccgacgccccctcctcctcctccggttgcggcggcggcgcccaccacacgtcagcctcgcaatccaccgccacacacacctcaccggcatctttcgacggcggtctcctcctccgcctcctccaaaaccctccctctgcgcacccgcgagaggaattcctcgccccgccccacgtcgcagcgggggcgcaccatttcttcagtgaccctgccgtcgccgccgtggggccgctcttcgccgcatcggcgcaggcacaagggggagacttcgggtggtcttcgacctccaccacgcacttacagcagcaacccgtattcccggatccccgattcgctccaggggaacccttcgctgctcttgccggcagagtgttcggatccggggatgccgtctgggcggagaggcctcggccgggggcgccgcctccagggtttggcaaaccgtcgcatccaccacctactgcccgtgatgcacggaatgcatctggtgttgtattgagtagggaacagtacaatcctcgtcccatggatttcgttccggatcttgcagatgttcgtgatgcggttggcagaatgcctcatggacatggagagcagctttcaatgccaattactggtggatgtgatgtggctgtaggaatgatgtgtatggaacagcagcaagatcgttttttgtcacggacaccgcctgagatcaatgccaatggacagttgggcaggatgcatcttggagagcagcatacacttcctatcttaggtggcaggaggctccatggagatcagtacatgcctccagtccaggaaggcagggcaccacatagtggtcatggtcagcatgaatcctgctttaccaatcctctacaaagggagcagaggtggcagggttttagggaggacaagggctatgtttcgcggaaggtgccaaatgcgaatgcctattacacatctggtaaggcactggtgaaggagttgcaccatgtgacattacctgctggcagttcagttccagtggaaattatggagaatcaagaatgtggtttggaaggcggcaggatagggaaagtagttttggagcatggaattgatggaaaggtggtagtggaggaaagtaagtctgaattgtcatatgaaaatagtaagattagatttgctggacatgatgaacaatatgatggtgatgacagggaggatgctataattgagcagatgacacaaaatctggtgattgatggcagtggtgatgccaagggagtagtattggaaaaaactatcctgaggagtaaggatttcagatcagacttttctagagggcatcatgtatcaagccagagaataagattccagaggagaaacaggccatgtcgatatgacatagatcgatttacacctaatttcttgtcaatttttgaatctttgatgccctctgaggaggaaattgcaaagcagaagcagttgttaacatctttgagcagattgataaacatggaatggcctaatgcaaaactatacctctatggatcatgtgccaattctttcggtttctcaaatagtgatattgatctttgtctttctattgatgacaaggaaatgagcaaggttgatattatattgaaattggcagacattctcaaagctggaaatctccagaatattcaggagaactgcgtttcattatattaa

SEQ ID NO: 20297 - protein, 560 aa, Sorghum bicolor
  misc_feature: Ceres ANNOT ID no. 8637584
  misc_feature: Down-regulated in root tissues in response to methyl jasmonate treatment
  misc_feature: Down-regulated in shoot tissues in response to methyl jasmonate treatment
  misc_feature (333)..(524): SWISSPROT Homolog: EC 2.7.7.19 Polynucleotide adenylyltransferase
MADAPSSSSGCGGGAHHTSASQSTATHTSPASFDGGLLLRLLQNPPSAHPREEFLAPPHVAAGAHHFFSDPAVAAVGPLFAASAQAQGGDFGWSSTSTTHLQQQPVFPDPRFAPGEPFAALAGRVFGSGDAVWAERPRPGAPPPGFGKPSHPPPTARDARNASGVVLSREQYNPRPMDFVPDLADVRDAVGRMPHGHGEQLSMPITGGCDVAVGMMCMEQQQDRFLSRTPPEINANGQLGRMHLGEQHTLPILGGRRLHGDQYMPPVQEGRAPHSGHGQHESCFTNPLQREQRWQGFREDKGYVSRKVPNANAYYTSGKALVKELHHVTLPAGSSVPVEIMENQECGLEGGRIGKVVLEHGIDGKVVVEESKSELSYENSKIRFAGHDEQYDGDDREDAIIEQMTQNLVIDGSGDAKGVVLEKTILRSKDFRSDFSRGHHVSSQRIRFQRRNRPCRYDIDRFTPNFLSIFESLMPSEEEIAKQKQLLTSLSRLINMEWPNAKLYLYGSCANSFGFSNSDIDLCLSIDDKEMSKVDIILKLADILKAGNLQNIQENCVSLY

SEQ ID NO: 20298 - DNA, 1377 bp, Sorghum bicolor
  misc_feature: Ceres ANNOT ID no. 8638837
  misc_feature: Down-regulated in shoot tissues in response to methyl jasmonate treatment
  misc_feature: Down-regulated in root tissues in response to methyl jasmonate treatment
  misc_feature: Down-regulated in shoot tissues in response to salicylic acid treatment
  misc_feature: Encodes the peptide sequence at SEQ ID NO 20299
atgacatcgtcgagtggaagcagcagcaggaggctggagcagcatgaggcggagaaacccgcacatccacatggcctggatgcccttacgatgaagatgctggtgcgccggagctgggaggagtcgaggctgctcttgcgccttgccttcccggcgctcctgacggaggtctttcagttctccatcggcttcgtcaccaccgccttcgtcggccacctcggcgaggtggagctcgccgccgtcagcgtcgtcgagaacatcttggattcctctgcctatggagtcctgtatggcatgggcagcgcgctggagacgctgagcgggcaagccgtgggcgcggggcagccggagaagctgggcgtgtacacgcagcagtcgtggatcatcagcgtggccacggcggtggcgctggcgccggcgtacgtcctcgcggcgccgctgctgcaccgctccctgcaccagccgggcgccgtgtcgcgcgccgcggggccgtacgcgcggtgggcggtgccgaggctgctggcgcacgccctcaacatcccgctgctcatgttcttccaggcgcagagcaggatctgggccgtggcggccatctccggcgcggcgctgtgcgcgcacgccgtcctcacatacgtcgccgtcgcgcggctcgggtacggcctgcctggcgccgccgtcgccggggacgtctcccactggctcgtcgtcgccgcgcagttcgcctacatgacgacgggggaacgattccccgacgcgtggaacgggttcaccgtccgtgcgttcagcaacctcggcgctttcgtcaagctgtcgcttgggtcggccgtcatgatctgcttggagttttggtactacaccacacttctcattcttgtgggtctcctgccgcaggccaaactccaaatcgatatcatgtctgtctgcctcaacttcgagttcatgactataatggttgcactgggcttcagcacagcaatcggtgttagggtgtccaacgagctgggtgcaaacaggcctaaggaaacaaagtttgcagtgcttgtggcagtatcgacatccatcttcatgggagcaatcttcatgggcgtcgtcctcatttggaggacaagcctgcccaagctcttcagcgacagcgaggaggtgatccatggagcttccaagctggggcatctcctcgctctgactgtatgcatgagcagcatctggcctatactctcaggtgtggcagtaggagctgggtggcaagtgcctgtggcattcataaacgtcggttgctactacctagtgggcattccaatgggtatcctgtttggcttcaagcacgtttctccaaatgtctatacttctcgccattatcttcacaacaaagtgggataa

SEQ ID NO: 20299 - protein, 458 aa, Sorghum bicolor
  misc_feature: Ceres ANNOT ID no. 8638837
  misc_feature: Down-regulated in shoot tissues in response to methyl jasmonate treatment
  misc_feature: Down-regulated in root tissues in response to methyl jasmonate treatment
  misc_feature: Down-regulated in shoot tissues in response to salicylic acid treatment
  misc_feature (51)..(212): Pfam ID: MatE Pfam Description: MatE
  misc_feature (273)..(436): Pfam ID: MatE Pfam Description: MatE
MTSSSGSSSRRLEQHEAEKPAHPHGLDALTMKMLVRRSWEESRLLLRLAFPALLTEVFQFSIGFVTTAFVGHLGEVELAAVSVVENILDSSAYGVLYGMGSALETLSGQAVGAGQPEKLGVYTQQSWIISVATAVALAPAYVLAAPLLHRSLHQPGAVSRAAGPYARWAVPRLLAHALNIPLLMFFQAQSRIWAVAAISGAALCAHAVLTYVAVARLGYGLPGAAVAGDVSHWLVVAAQFAYMTTGERFPDAWNGFTVRAFSNLGAFVKLSLGSAVMICLEFWYYTTLLILVGLLPQAKLQIDIMSVCLNFEFMTIMVALGFSTAIGVRVSNELGANRPKETKFAVLVAVSTSIFMGAIFMGVVLIWRTSLPKLFSDSEEVIHGASKLGHLLALTVCMSSIWPILSGVAVGAGWQVPVAFINVGCYYLVGIPMGILFGFKHVSPNVYTSRHYLHNKVG

SEQ ID NO: 20300 - DNA, 1938 bp, Sorghum bicolor
  misc_feature: Ceres ANNOT ID no. 8638975
  misc_feature: Down-regulated in shoot tissues in response to salicylic acid treatment
  misc_feature: Encodes the peptide sequence at SEQ ID NO 20301
atgggaacaacacccctcatagccggtctttccctgcacccccttctatgcccaccgaggttagagaagaagagggaggcatgggccgctgcaaccctagctggagttggagaagaaagtgtgggctggctgcgcgcagatggaccattatttataggaagtccttcggagaagcaggtgtgcaaggatccatatcctttcaacaacattcctcaagccatggaagcagcagatgaggagatgccactgattcattacctatctccagaggatgaagcttcacaatatactagcgacggaacgcttgacgttaacgatcagcctgctttgaagcagcgcatcgggaattggagagcatgcttcattattttaggtaccgagttcacggaatccctggcatttttcgctatatcaaagaacctaatcacctatctcatgagtgagctccacgagcgcaatgtggatgccgcgagggatgtctctacctggattggcagttgcttcctcacacctcttatcggagccttcttggccgacacatattggggagcatacaagacgatagtagtcttcctcttggtctacaccgggatgctcactctgacgctttctgcatgcctcccctacgccatggatgattcgccacacaacggtggaatccgtggtgccacagcatacctagggctctaccttgttgtcctaggctccggaggcattaagccctgcacgtcatcccttggggccgagcaattcgacagcaccgacatgacggagcgggtgaccaaggcttccttcttcaactggtactacttttccatcaacattggctcactgctgtcagggactgtgatcgtctgggtgcaagaaaacattggatggggagtcggatttgccgtgccgatggtgttcatggtgtttggcctggcggcgtttgtcgccggtcggaaggtgtataggtacaagaaactgagtgggagtcctttgacaagggtagcccaggtggtggttgcagctgtgaggaactgtcatctccagttgcctgaggatacgtcagccctgcaccatgatacgttttttccagccgagcccaatttcaagactgaggctgccagacagttcagattctttgacaaggctgccataatattgccctggactggcgagaagggcacagcagcaccgtcgagcccatggagactgtgcacggtgtcccaggtggaggagctgaagatgctgctccggatgttgccggtctgggcaaccatggtgctcttcttcgccgtcacatcgcagatgtcatcgacattcatcgagcagggggcggccatggacgaccgcgttggcccattcacctttcctccggcgtccctggcaactttcgaagtaatcagcgtcatggtctgcatccccgtctacgacgccgtgctggtgccgctggcccggcgtgtcaccggcaacgaccgcggcctgtcacagctgcagcggctcggcgtcggcctcgcactgtccgtgatcgccatggtgtacgcggcgctgcttgaggcgaggcgactggtcctcgcgcaggccgacatgcctgcgatgaacatcttgtggcaggcaccggtgttcgccgtgctcggcgcggcggaagtgttcgccaccatcggcatcctcgagttcttctacgaccagtcgccggacgggatgaagagcctcggcaacgcgttcgcgcagctctccatggcggccgggagctacttcaactcggctgtgctcagcgctgtcgcggcgacgacgacggcgcgcggcgtggagcccgggtggatccccgacgacttgaacgagggtcacctggactatttcttctggatgatggctgctctgagcatggtaaacctgttgcacttcgtgcactactccatccgatacagaggcaacaacaggacagcttcttga

SEQ ID NO: 20301 - protein, 645 aa, Sorghum bicolor
  misc_feature: Ceres ANNOT ID no. 8638975
  misc_feature: Down-regulated in shoot tissues in response to salicylic acid treatment
  misc_feature (185)..(575): Pfam ID: PTR2 Pfam Description: POT family
MGTTPLIAGLSLHPLLCPPRLEKKREAWAAATLAGVGEESVGWLRADGPLFIGSPSEKQVCKDPYPFNNIPQAMEAADEEMPLIHYLSPEDEASQYTSDGTLDVNDQPALKQRIGNWRACFIILGTEFTESLAFFAISKNLITYLMSELHERNVDAARDVSTWIGSCFLTPLIGAFLADTYWGAYKTIVVFLLVYTGMLTLTLSACLPYAMDDSPHNGGIRGATAYLGLYLVVLGSGGIKPCTSSLGAEQFDSTDMTERVTKASFFNWYYFSINIGSLLSGTVIVWVQENIGWGVGFAVPMVFMVFGLAAFVAGRKVYRYKKLSGSPLTRVAQVVVAAVRNCHLQLPEDTSALHHDTFFPAEPNFKTEAARQFRFFDKAAIILPWTGEKGTAAPSSPWRLCTVSQVEELKMLLRMLPVWATMVLFFAVTSQMSSTFIEQGAAMDDRVGPFTFPPASLATFEVISVMVCIPVYDAVLVPLARRVTGNDRGLSQLQRLGVGLALSVIAMVYAALLEARRLVLAQADMPAMNILWQAPVFAVLGAAEVFATIGILEFFYDQSPDGMKSLGNAFAQLSMAAGSYFNSAVLSAVAATTTARGVEPGWIPDDLNEGHLDYFFWMMAALSMVNLLHFVHYSIRYRGNNRTAS

SEQ ID NO: 20302 - DNA, 1860 bp, Sorghum bicolor
  misc_feature: Ceres ANNOT ID no. 8639029
  misc_feature: Up-regulated in shoot tissues in response to methyl jasmonate treatment
  misc_feature: Up-regulated in root tissues in response to methyl jasmonate treatment
  misc_feature: Encodes the peptide sequence at SEQ ID NO 20303
atggtggaggcggcccccatggtcgaggcttcgcagggcaccaaggacggctccgcggcagcacgcatggcgacggggtatgcaggctctgcaccagcggaggtatttgaggtgtactgctgcaagctcacctccttcagttggaactttttttggacgccatctctgattccaccggcggaggatgaaatttctgaattcactagcgacgggacggttgatattagcaatctgcctgccaggaagcagagcactgggaattggacagcatgcttctttattttaggtgctgaattcgctgaatgtgtggccttcttcgcaatctcaaagaacttggtcacttacctcacgggtgttctccacgagagcaacgtcgatgctgcaacgactgtgtccacctggattgggaccgcattcttcacgccgctcatcggagcgttcttggctgacacattctggggacgatactggacaatagtaatcttcatctccgtgtacgtcattgggatgatgatcctgaccggttcagctcttcttccagtgatgatgggcttgtcttacaaccgcagcattcaccgcctcaccgcgtacctgggcctgtatcttgttgctctcggcaatggtggaattaagccatgcgtctgtgcactcggtgccgatcagtttgacgcggctgacccagtggagcgggtgaccaagggctccttcttcaactggtactacttctccgtcaacatcggctcccttctgtccgcgactgtggtcgtctgggtgcaggacaacgttggctggggactcgggtttgcgatcccgacggtgctcatgctgtctggcctcgtcgtgttcgtcgccggtaggaaggtttacaggtaccagagagtggaagggaggagccctctgacaagagtctcccaggtgcttgttgctgctgtcaggaactacaatttggtcttgcctgaagatagctctgccctgcatcagctgccttctccagctgaaggaaatcattgcaagattcagcatacaagtcaattcaggttccttgacaaggctgccattgtagcgccatcctccagcgacggcgagaaaggaccgacaagcccatggagactctgcacggtgtcccaggttgaggagctgaagatggtgctccggatgttccccgtgtgggtgtcgatggtgctcttcttcgcagtcaccgcccagatgtcatcgaccttcatcgagcaaggccataccatggacaaccacgtcgggccgttcaccgtgccgccggcgtccctcgccatcttcgacatcatcagcgtcatgttctgcatacccatctacgacagagtgctggtgccgatggtccggcgcgccacgggcaaggagcggggcctgtcacagctgcagcggcttggcgtcggcctcgcgctgtccgtggtcggcatcgtttacgcggcgctggtcgagggcaggcggttgtcgctcacccacgcagcgccggacaggcagccgtcgatgagcatcatgtggcaggcgccggcgttcgcggtgctcggcgcgggggaggtgttcgcggccatcggcatccttgagttcttctacgatcagtcaccggaagggatgaagagcctcggcacggcccttgcgcagctcgccgtcgcggtaggcaactacttcaactcttccgtgctcgccgccgtcgcggccgttacaacgcgcaacggaaagccagggtggatccccgacgacctgaacaaggggcacctggactatttcttctggttgatggctgttctcggcgttgtgaacctgctgcacttcctgcattgctccatcaggtacagaagcagcaacaacaacacatattcttga

SEQ ID NO: 20303 - protein, 619 aa, Sorghum bicolor
  misc_feature: Ceres ANNOT ID no. 8639029
  misc_feature: Up-regulated in shoot tissues in response to methyl jasmonate treatment
  misc_feature: Up-regulated in root tissues in response to methyl jasmonate treatment
  misc_feature (156)..(549): Pfam ID: PTR2 Pfam Description: POT family
MVEAAPMVEASQGTKDGSAAARMATGYAGSAPAEVFEVYCCKLTSFSWNFFWTPSLIPPAEDEISEFTSDGTVDISNLPARKQSTGNWTACFFILGAEFAECVAFFAISKNLVTYLTGVLHESNVDAATTVSTWIGTAFFTPLIGAFLADTFWGRYWTIVIFISVYVIGMMILTGSALLPVMMGLSYNRSIHRLTAYLGLYLVALGNGGIKPCVCALGADQFDAADPVERVTKGSFFNWYYFSVNIGSLLSATVVVWVQDNVGWGLGFAIPTVLMLSGLVVFVAGRKVYRYQRVEGRSPLTRVSQVLVAAVRNYNLVLPEDSSALHQLPSPAEGNHCKIQHTSQFRFLDKAAIVAPSSSDGEKGPTSPWRLCTVSQVEELKMVLRMFPVWVSMVLFFAVTAQMSSTFIEQGHTMDNHVGPFTVPPASLAIFDIISVMFCIPIYDRVLVPMVRRATGKERGLSQLQRLGVGLALSVVGIVYAALVEGRRLSLTHAAPDRQPSMSIMWQAPAFAVLGAGEVFAAIGILEFFYDQSPEGMKSLGTALAQLAVAVGNYFNSSVLAAVAAVTTRNGKPGWIPDDLNKGHLDYFFWLMAVLGVVNLLHFLHCSIRYRSSNNNTYS

SEQ ID NO: 20304 - DNA, 1938 bp, Sorghum bicolor; identical to SEQ ID NO: 20300
  misc_feature: Ceres ANNOT ID no. 8638977
  misc_feature: Down-regulated in shoot tissues in response to salicylic acid treatment
  misc_feature: Encodes the peptide sequence at SEQ ID NO 20305

SEQ ID NO: 20305 - protein, 645 aa, Sorghum bicolor; identical to SEQ ID NO: 20301
  misc_feature: Ceres ANNOT ID no. 8638977
  misc_feature: Down-regulated in shoot tissues in response to salicylic acid treatment
  misc_feature (185)..(575): Pfam ID: PTR2 Pfam Description: POT family

SEQ ID NO: 20306 - DNA, 1704 bp, Sorghum bicolor
  misc_feature: Ceres ANNOT ID no. 8639291
  misc_feature: Up-regulated in shoot tissues in response to methyl jasmonate treatment
  misc_feature: Up-regulated in root tissues in response to methyl jasmonate treatment
  misc_feature: Up-regulated in shoot tissues in response to salicylic acid treatment
  misc_feature: Encodes the peptide sequence at SEQ ID NO 20307
atggacgcggagaccggagatgcccggtctcccctgctgccgcatcaccttcccagccagacgcaggtttcctcagcgaatcagcactataacaagcccttcagctggaaggccccagccattattttggccttcgaattcttggagagcattgcttactctggtatagcactcaacttggtcgtgtatctcggaaccgtcctccatggaaccactgcctccaatgcagcaaccgttgatgcgtggaacggtgccacctttcttacaccggtccttggagcctttcttgctgatacatactggggaaagtacaagaccgcagctatctctataattttctacgttgttggcttgctcataattaccgcctctgctgtcataccatccctacggcctgccacatgtgaaggcggttcttgccctcctgcaacagggtttcagtattttgtgctctttggttcattgtacctcatttccattggtacggggggcgtcaagtcagctttacttcccctcggagcggatcaatacaatgatgcaaacctcgaagagagtaaaaacaaacaattgttcttcagttggttcttcatggctgtcaacctcggagtgttcatctccggcactgttcttgtctggatacagcagaatgttgcttggtctcttggatttggcatctcctcgatatgccttgttattgccgcagttgcctttttggttggaacaccgctttacagggttcaacttccaaatgggagcccactcaagagtatagtaatggtgtttgttgcctcttttaagaagagaagagtggtgcttcctgttgatagcacgctgttgtttcaaggggatgacgctgaatcaagcagcatagtgccaaacaaattagaacacactgatgaattcaggtgcttagataaggcttctgttgtggaggaccaagagatgaaggacagagatcgcacatggctactatgtactgtaacccaggtggaggaagtgaagattctgatccggatgcttccaatatggttcacctgtgtcttctattcggctgcaatgagccagactgctactactttcgttcagcaggggaacgcgatgaacactaagatcggatccttctccgtgcccgctgcctctatgaactctgccgaggtgatcttcatgcttatctgggttgtgttccaggacagcatcgtcatcccgatagccaggaggtacaccgggaacccgatgggactgacgctgctgcagcggatgggcgtcggacggttgctggcgatcccgtctctggcagcagcagcactggtggagacgtggagactgcgcagcgtgagggccgggcataacctgagcatcgggtggcagctcccgcagtttgtgatcctggcctgctccgacgtgttctgtggcattgcgcagctggagttcttctacgcggaggcgcctgcgtcgatgcgcagcctttgctcggcgttccagttcctggccatgtcgttggcgtactacgtgaacacgctggtggtctcattggtggcggccgtgaccacggcctggggcggccagggctggctccccgctgacctcaacgacggccacctggactactacttctggctgtggactgggatcagtgtggtgaactatgtcgtgtacacggcatttgcaaggcgttatacggtcaagaaggttgtccttcagtaa

SEQ ID NO: 20307 - protein, 567 aa, Sorghum bicolor
  misc_feature: Ceres ANNOT ID no. 8639291
  misc_feature: Up-regulated in shoot tissues in response to methyl jasmonate treatment
  misc_feature: Up-regulated in root tissues in response to methyl jasmonate treatment
  misc_feature: Up-regulated in shoot tissues in response to salicylic acid treatment
  misc_feature (104)..(498): Pfam ID: PTR2 Pfam Description: POT family
MDAETGDARSPLLPHHLPSQTQVSSANQHYNKPFSWKAPAIILAFEFLESIAYSGIALNLVVYLGTVLHGTTASNAATVDAWNGATFLTPVLGAFLADTYWGKYKTAAISIIFYVVGLLIITASAVIPSLRPATCEGGSCPPATGFQYFVLFGSLYLISIGTGGVKSALLPLGADQYNDANLEESKNKQLFFSWFFMAVNLGVFISGTVLVWIQQNVAWSLGFGISSICLVIAAVAFLVGTPLYRVQLPNGSPLKSIVMVFVASFKKRRVVLPVDSTLLFQGDDAESSSIVPNKLEHTDEFRCLDKASVVEDQEMKDRDRTWLLCTVTQVEEVKILIRMLPIWFTCVFYSAAMSQTATTFVQQGNAMNTKIGSFSVPAASMNSAEVIFMLIWVVFQDSIVIPIARRYTGNPMGLTLLQRMGVGRLLAIPSLAAAALVETWRLRSVRAGHNLSIGWQLPQFVILACSDVFCGIAQLEFFYAEAPASMRSLCSAFQFLAMSLAYYVNTLVVSLVAAVTTAWGGQGWLPADLNDGHLDYYFWLWTGISVVNYVVYTAFARRYTVKKVVLQ

SEQ ID NO: 20308 - DNA, 1788 bp, Sorghum bicolor
  misc_feature: Ceres ANNOT ID no. 8639350
  misc_feature: Up-regulated in shoot tissues in response to salicylic acid treatment
  misc_feature: Up-regulated in root tissues in response to salicylic acid treatment
  misc_feature: Encodes the peptide sequence at SEQ ID NO 20309
atggctgcgatgaacggaaaggcattggataaatgtggaaggaacataaatagtctcaagagaaagcgggagagccccgctgcatatgatgctgacgtattcctcacctctgaattacatcagcatcctgtcaatgattctgctgttaggtttcatgttgatcaagaccgcaaggcaaagatcgtgtgccacttcaacaagcaggttttgcagagctataagaacttcatgagtagtgcaccacctaagcgcattttgcttcgcaaaggtgctgtctggaaagacgttccagaaaagattgtcaaattggcccaagccgacttcagggcaaaaaagacgatcacagaaacaggatatcagaaccatctatttttgctcgattttgcccatatgacattcatagacacaaagacaggtcttcagaggcctattgcttggattgatgaaaatggaaagcgctacttcccggaatcatttatgcaagatcagaaattatttatcaagaaagattttggcaacggaaatcctgagtacattagtgttgagccaaatgggacacgagaaatgaatgaccagcttggagcatcagaaagttctgcagaaagctcaaactttgattcaagtactgaagatatttccagtcctaagagatctagggctgaaaagaattccatcataaaaaaatactgtgatatgggagaagctattggagaaaatgagccatgtgctttgttgcctacagcctgtaacctactgccacaccaagctaatctgggtgaggtatcacgtgctcagcgcactattgaagccgtggagaagctgttgctgcaggggatgggttcagttattgaatccaaggacattattggaatcttcaggactccattattggatgaccacagacaagtccgttaccatattcaccaaaagcaagtacaggttaccggatgtcatcgtggaaatgcaaatgtccgttatgcatggcttccttgctccaaaagcactgtgcatgaaatgatgctgaatggtgttttacaagttcataagccgcccattaattttgcagcctatggagagggcatcctccttacaccagcaaatcgttctgatgcctgtgtgaaatactctgatgttgatgaaaatggcattgtccatatgatgttgtgccgtgttataatggggaacgtagaaatagttcaccctggatctaatcagcaccgacctagtagtgaccatgttgatagtggagtagatgaccttaaaaacccacaacattacattgtgtgggatatgaatatgaataggcacatctattctgagtttgtagtcatcgtcaaattgccttctaaaaccaaagattccttcgtgtctcaagaagagtgtcagaattcatctgatctgtcactggtgttgaattctagttcacctgactgtatttcagaggagatgaacctggaggcacctccagcattgggaggtggatgtgcagcccccatgctaggagattcgatggaaaaggctccaagctcaccttggatgcctttctccatgttgtttgcagcgatctctactaaagtgtctcctgagaatatggacatggttattagttgctatgaagagtttaagagtaagaaaataagccgaggtgaactagtaaagaagctgagacatgtagttggtgatagagtgctaatatcgacgataatgcgtctccaagataagttacctccagtggagaggcgtgaggcaccggacgcatcagcggccaagatggtggcgaaaccgtga

SEQ ID NO: 20309 - protein, 595 aa, Sorghum bicolor
  misc_feature: Ceres ANNOT ID no. 8639350
  misc_feature: Up-regulated in shoot tissues in response to salicylic acid treatment
  misc_feature: Up-regulated in root tissues in response to salicylic acid treatment
  misc_feature (258)..(447): Pfam ID: PARP Pfam Description: Poly(ADP-ribose) polymerase catalytic domain
MAAMNGKALDKCGRNINSLKRKRESPAAYDADVFLTSELHQHPVNDSAVRFHVDQDRKAKIVCHFNKQVLQSYKNFMSSAPPKRILLRKGAVWKDVPEKIVKLAQADFRAKKTITETGYQNHLFLLDFAHMTFIDTKTGLQRPIAWIDENGKRYFPESFMQDQKLFIKKDFGNGNPEYISVEPNGTREMNDQLGASESSAESSNFDSSTEDISSPKRSRAEKNSIIKKYCDMGEAIGENEPCALLPTACNLLPHQANLGEVSRAQRTIEAVEKLLLQGMGSVIESKDIIGIFRTPLLDDHRQVRYHIHQKQVQVTGCHRGNANVRYAWLPCSKSTVHEMMLNGVLQVHKPPINFAAYGEGILLTPANRSDACVKYSDVDENGIVHMMLCRVIMGNVEIVHPGSNQHRPSSDHVDSGVDDLKNPQHYIVWDMNMNRHIYSEFVVIVKLPSKTKDSFVSQEECQNSSDLSLVLNSSSPDCISEEMNLEAPPALGGGCAAPMLGDSMEKAPSSPWMPFSMLFAAISTKVSPENMDMVISCYEEFKSKKISRGELVKKLRHVVGDRVLISTIMRLQDKLPPVERREAPDASAAKMVAKP

SEQ ID NO: 20310 - DNA, 735 bp, Sorghum bicolor
  misc_feature: Ceres ANNOT ID no. 8639551
  misc_feature: Up-regulated in root tissues in response to methyl jasmonate treatment
  misc_feature: Encodes the peptide sequence at SEQ ID NO 20311
atggcgacgctcgcgcggtggcatccaccactaccaccagccccactagccgctggggcagccgctcggcctcctactgcccgcccgctcgctcgacggcggatcccgcgccgagccgcgaccgtggtctccccgcgcgcgttcggcggcgacttcgatggcttcgtacggcgcgcgtggcggagcgccaacgcgggggccgagcgcctcgccttcgaggcacggcaggccgcgaagcggctggacggcaggttctcgatctcccggaggctcgcggaggcctcccgtgccgcccgcgcccgcgccgttgagatcgacgccgagctcggcatcgggcggcggtggcgctccttctccgtcgacttctcccgcaactggcccaggtatcggagggagatcaatgacttcatggaaactcccatcgggagagcattagctacaatatttttcctatggcttgcactgtcagggtggttgttcagaattttcatttttggcacgtttgtgctgccatttgctgtcccacttctccttgggcccttggctaatagggttgccattgagggaacatgcccagcatgcaaaaggcgttttgtgggttaccgcaaccaagtgattcggtgcatgaactgccaaaacattgtatggcagccaaataacagctcatctggtggcactagaagttcacgaagctcagaacctgatgtaattgatgtagaatacgaagagaagtaa

SEQ ID NO: 20311 - protein, 244 aa, Sorghum bicolor
  misc_feature: Ceres ANNOT ID no. 8639551
  misc_feature: Up-regulated in root tissues in response to methyl jasmonate treatment
MATLARWHPPLPPAPLAAGAAARPPTARPLARRRIPRRAATVVSPRAFGGDFDGFVRRAWRSANAGAERLAFEARQAAKRLDGRFSISRRLAEASRAARARAVEIDAELGIGRRWRSFSVDFSRNWPRYRREINDFMETPIGRALATIFFLWLALSGWLFRIFIFGTFVLPFAVPLLLGPLANRVAIEGTCPACKRRFVGYRNQVIRCMNCQNIVWQPNNSSSGGTRSSRSSEPDVIDVEYEEK

SEQ ID NO: 20312 - DNA, 3636 bp, Sorghum bicolor
  misc_feature: Ceres ANNOT ID no. 8639973
  misc_feature: Up-regulated in root tissues in response to methyl jasmonate treatment
  misc_feature: Up-regulated in shoot tissues in response to methyl jasmonate treatment
  misc_feature: Up-regulated in shoot tissues in response to salicylic acid treatment
  misc_feature: Encodes the peptide sequence at SEQ ID NO 20313
atggtcaaggggtcggctcaagcctgttttgattctgaaggcaaggacgcatacacgacggcggcggagaccaacctccgtaggcaactggagcaaaccctcgccgccgaaccctccagcccgctccaccagtacaaccttggcgtcttcctatgggaccgcgccgaggcagagcaggagggtgacggggaagaggcgcggaagctccgcgcggcagcgtcggagcattttctggcggcggccaagctgaaccccaacgatggcgtccccttcagattcctgggccaccactacgcccacggcggagacaatcaacgagcggccaagtgctaccagcgtgcggtgaccctcaaccctgatgatgctgaggctggggagacgctctgtgacttgctagatgttgaagggaaggagagcttggagcttgctgtgtgcaaggaggcagctggcaagtcaccgcgtgcgttctgggcttttcggagacttggctacttacaggttcatcagaggaaatggtcagaggctatacaaagccttcagaatgcaatccgaggttacccaacatgtgcagatttatgggaggcacttggtctggcataccaccgtttgggcatgttcactgcagcagtaaagtcatatggacgtgctattgaacttgatagttccagggtctttgcattgatagaaagtggaaacatccagttaatgcttggttactttagaaagggagtggagcagtttcgttctgctttggaaatggctccatgtaatcattcggcatactttggccttgcttctgcattgcttgcatgggcaaggaattgtataactattggggcctttggttgggctgctagcctcttgaaggaagcttcagaagcttccagaatttgtacttctttcactggaaacctttcctgcgtctggaaattgcacggagatgttcagctcacacttgcgagatgctttccatgggtggatgggaagatcaaaaggggcatggatgcacagatgttcaaagattcggttaaagagtggagaaatacatgtttgtcagcagcgaatggtgcaaaactctcatatcaacgtgctttgcatcttactccctgggaagctaatgttcacaatgatatggctatttgtcttgatctaatttgttccatggatgacagcaacatactcaaccccaatgtttgggagctgccagagaaaatgtcactgggtgccttgatgttggaaccagttaataaggatttttgggttactttgggttcaatgtcaagttatctggctttgaagcagcattcttttattagggcacttcatctcgatatgtcgttgtctgaagcttgggcatgccttggaaagatttacagacagtctggtgataagcaattggcaaaacaagcatttgatcgagctcgaagcattgatccttcgttggccttgccatgggctggaatgtcggcggaaaattatcaccaatctgggagcagtcctgtaaatgaatcttttgaaagctgcttgagggctgtgcagatcctacctctgccagagttccagattggtcttggaacaattgctgcccgttctagtaatcttctttcacctcaggtattgatggctgtaagacaggctgttcagcgagcacctcattacccagagtctcacaatttaaatggcttgatttctgaagtgcgattagatttccagtctgcaatcacattttacttgcaagcgagatttgctttaggcatgatgtacaattccaagtcagacaatagacaagcttttgctgatgtttcagtgaatcttgcccgtgcactatgcaaggctggttttgcaactgatgcagtgcgggagtgtgaagagctgagatctcaaggactgttgagtgttgatggattgcagatatatgctctggcattgtggaaaactggacaaagcaaggaagctctttctgtatctagaagcttggctgaaaatttaagtggtataaaggcggagagtgcaactgcagcttggggattcatatgcaccttaatgtatggaatttctgggaaggactctgcagctgccatcattcacaagcttcctggtcaactcaattataactcacagttgaaattcattgtctctgcattggatgctttgcatccaaccaagcgtctccagctgcctcagttgaatatgcctcctaagcatacagcttatgaagtgatgagtgaagtacactcgaatattgctcttgggaaggctattggtgcggactttgacaagcctctgagggttgatggtagtttgtcttacctgaaaaaagttctgcacatgtatcccgactgcagtttagtgaggaaccaacttggatccctgctgctgtggagtggagattggatggcttctcataaagcaataagggttaccactctgttgtcacatggacacgcatccagtatgggcctaagatcaccacatcatgttcaagcctgtgcaatggtttcttgctatgctacctgcccaaattacgcaaagttctctttcgcaacatgtgaacaccaatacctaagtggacctgatgcaatacaccacctgcaaaggtgggttcattgtgaaccatggaaccaagatgcacgctacctgcttgtgcttgccattttccaaaaagcacgggaagagaggtaccccaaacatatctgtgttattctgaagaagctcattatgcaagtgctgtccaatattagcaatccacatgagaaagaagctatgcagtatgaggtgttcttgctacttcttttgtcatcagaggtctgtttgcaatctttagactatgaaaattgcattgcccaagctaaagaagccctaagaaccaccccgtcgagccgtgtggatactttttttgcacacttgcaactgtgtcgggcctatgcggtacaaggggatcttttgaactccaggaatgagtacatgaaatgcttgagaaaccatacaaatactgagattggctgggtaatgctgaagcaacttgaatctgcatgttcattggagggctcttctgatgaaatagatataaatctgcgtgaatgcattaaaaggaatggtagtgactcatcgaaatgggcatcccttttcaatctggcgtgtgctcagtgctttctgtgggatggaaacttcgaaagcgctgaaaaagctcttgctcaggcatgcactcaagtagatccggatagctgcatcttgttccttaatggtgcaacctgtatggagattgcccggaagtttgtagctcctcaatttatatcccgcgcagcatccagcctcagaaaggcccagcagaaatcacatgcttcattacctctcgtgtcactgctactggctcaagccgagggcagtcttggctccaaaaccaagtgggagaaaaaccttcgcctggaatggttctcgtggcccccagaactgaggcctgcggaggtgtacttccaaatgcatctgctggcgaggcagtcggctgcagcggtttctcagcagaaccagctggtggagacgatgcagagccccgagttgtggttgcttcgggcgattcacctgaacccgtcctgccccaggtattggaaggctctgctgcagcaaatttatgtgtag

SEQ ID NO: 20313 - protein, 1211 aa, Sorghum bicolor
  misc_feature: Ceres ANNOT ID no. 8639973
  misc_feature: Up-regulated in root tissues in response to methyl jasmonate treatment
  misc_feature: Up-regulated in shoot tissues in response to methyl jasmonate treatment
  misc_feature: Up-regulated in shoot tissues in response to salicylic acid treatment
  misc_feature (190)..(223): Pfam ID: TPR_2 Pfam Description: Tetratricopeptide repeat
  misc_feature (448)..(481): Pfam ID: TPR_2 Pfam Description: Tetratricopeptide repeat
MVKGSAQACFDSEGKDAYTTAAETNLRRQLEQTLAAEPSSPLHQYNLGVFLWDRAEAEQEGDGEEARKLRAAASEHFLAAAKLNPNDGVPFRFLGHHYAHGGDNQRAAKCYQRAVTLNPDDAEAGETLCDLLDVEGKESLELAVCKEAAGKSPRAFWAFRRLGYLQVHQRKWSEAIQSLQNAIRGYPTCADLWEALGLAYHRLGMFTAAVKSYGRAIELDSSRVFALIESGNIQLMLGYFRKGVEQFRSALEMAPCNHSAYFGLASALLAWARNCITIGAFGWAASLLKEASEASRICTSFTGNLSCVWKLHGDVQLTLARCFPWVDGKIKRGMDAQMFKDSVKEWRNTCLSAANGAKLSYQRALHLTPWEANVHNDMAICLDLICSMDDSNILNPNVWELPEKMSLGALMLEPVNKDFWVTLGSMSSYLALKQHSFIRALHLDMSLSEAWACLGKIYRQSGDKQLAKQAFDRARSIDPSLALPWAGMSAENYHQSGSSPVNESFESCLRAVQILPLPEFQIGLGTIAARSSNLLSPQVLMAVRQAVQRAPHYPESHNLNGLISEVRLDFQSAITFYLQARFALGMMYNSKSDNRQAFADVSVNLARALCKAGFATDAVRECEELRSQGLLSVDGLQIYALALWKTGQSKEALSVSRSLAENLSGIKAESATAAWGFICTLMYGISGKDSAAAIIHKLPGQLNYNSQLKFIVSALDALHPTKRLQLPQLNMPPKHTAYEVMSEVHSNIALGKAIGADFDKPLRVDGSLSYLKKVLHMYPDCSLVRNQLGSLLLWSGDWMASHKAIRVTTLLSHGHASSMGLRSPHHVQACAMVSCYATCPNYAKFSFATCEHQYLSGPDAIHHLQRWVHCEPWNQDARYLLVLAIFQKAREERYPKHICVILKKLIMQVLSNISNPHEKEAMQYEVFLLLLLSSEVCLQSLDYENCIAQAKEALRTTPSSRVDTFFAHLQLCRAYAVQGDLLNSRNEYMKCLRNHTNTEIGWVMLKQLESACSLEGSSDEIDINLRECIKRNGSDSSKWASLFNLACAQCFLWDGNFESAEKALAQACTQVDPDSCILFLNGATCMEIARKFVAPQFISRAASSLRKAQQKSHASLPLVSLLLAQAEGSLGSKTKWEKNLRLEWFSWPPELRPAEVYFQMHLLARQSAAAVSQQNQLVETMQSPELWLLRAIHLNPSCPRYWKALLQQIYV

SEQ ID NO: 20314 - DNA, 687 bp, Sorghum bicolor
  misc_feature: Ceres ANNOT ID no. 8640248
  misc_feature: Up-regulated in shoot tissues in response to methyl jasmonate treatment
  misc_feature: Up-regulated in root tissues in response to methyl jasmonate treatment
  misc_feature: Up-regulated in root tissues in response to salicylic acid treatment
  misc_feature: Up-regulated in shoot tissues in response to salicylic acid treatment
  misc_feature: Encodes the peptide sequence at SEQ ID NO 20315
atggcggccaagagaggtgagctgaagctgctgggcgtgtgggacagcccgtacgtcaacagggtccaaatcgtgctcaacctcaagggcctcagctacgagtacgtcgaggaagacctcctcaacaagagcgagctccttctccagtccaacccggtgcacaagaaggtgcccgtgctcatccacgacggcaagccgatcgccgagtcgcaggtcatcgtccagtacctcgacgaggtcttcgccggcacgggcccgtcggtcctccccgccgacccctacggccgcgccaccgcccgcttctgggccgccttcgtcgacgacaaggtcgggtctccatggcacaccatcctgttcgcgcgggaggccgagaagaaggcggatgcggcgtcgcggatcatcgcggcgctggagacgctggagggcgcgttcagggactgctccggcgggaggtacgtcgactacttcggcggcgacggcgtcgggttcgtggacgtggtgctgggcagctacctggggtggttcaaggtgttcgagaagatggtcggcgtcagggtcctggacgcggcgaggacgccgctcctggccgcgtggggggagcggttcgccgccgcggaagcggcgaaggacgtcctgccggatgacgttgacaaggtgctcgagttcctgcagcagttcctggattag

SEQ ID NO: 20315 - protein, 228 aa, Sorghum bicolor
  misc_feature: Ceres ANNOT ID no. 8640248
  misc_feature: Up-regulated in shoot tissues in response to methyl jasmonate treatment
  misc_feature: Up-regulated in root tissues in response to methyl jasmonate treatment
  misc_feature: Up-regulated in root tissues in response to salicylic acid treatment
  misc_feature: Up-regulated in shoot tissues in response to salicylic acid treatment
  misc_feature (7)..(146): SWISSPROT Homolog: EC 4.4.1.5 Lactoylglutathione lyase
  misc_feature (6)..(79): Pfam ID: GST_N Pfam Description: Glutathione S-transferase, N-terminal domain
  misc_feature (101)..(206): Pfam ID: GST_C Pfam Description: Glutathione S-transferase, C-terminal domain
MAAKRGELKLLGVWDSPYVNRVQIVLNLKGLSYEYVEEDLLNKSELLLQSNPVHKKVPVLIHDGKPIAESQVIVQYLDEVFAGTGPSVLPADPYGRATARFWAAFVDDKVGSPWHTILFAREAEKKADAASRIIAALETLEGAFRDCSGGRYVDYFGGDGVGFVDVVLGSYLGWFKVFEKMVGVRVLDAARTPLLAAWGERFAAAEAAKDVLPDDVDKVLEFLQQFLD

SEQ ID NO: 20316 - DNA, 723 bp, Sorghum bicolor
  misc_feature: Ceres ANNOT ID no. 8640289
  misc_feature: Up-regulated in root tissues in response to methyl jasmonate treatment
  misc_feature: Up-regulated in shoot tissues in response to methyl jasmonate treatment
  misc_feature: Up-regulated in root tissues in response to aminocyclopropane carboxylic treatment
  misc_feature: Up-regulated in root tissues in response to salicylic acid treatment
  misc_feature: Up-regulated in shoot tissues in response to salicylic acid treatment
  misc_feature: Encodes the peptide sequence at SEQ ID NO 20317
atggccggcggaggagacgacctgaagctgatcggcttgtggtctagcccgttcgtgctccgggtgcaactcgctctcagcctcaagggcctgcgctacgagtacatcgaggaggaggctctcgtgaacaagagcgagctcctcctcaagtccaaccccgtgcacaaaaaggtacccgtgctcatccacaacgggaagcccgtctgcgagtcgcgggtcatcctgcaatacatcgacgaggcctttgccggcaccggcccgtccctcctccctgccgacccctaccaacgcgccgttgctcgcttctgggccgcctacatcgatgacacgatgcttccgatttggaacaagtcgtcgatggggaagacggaggaggaaatggctgagggaaagaagcagtcgctcgccgcgacggaggtcctagagggggcgcttagggaaagcttcaaagggaagcccttcttcggtggcgacagcaccgggtacgtggacgtcgtgctcggcggcgtgctcgcgtgggcgcgcgcgtcggaggagctctacggcaacaaccccttcgaccccgagcagactccgctcctggcggcgtggtcggagcgcttcggcgcactggaagccgtcgagccggtggtgccggaggtgagcagggtggttgagttcggcaagatgttgcaggcgcgtctagcggttgcggccgccctcggcgccggtgcaagctactga

SEQ ID NO: 20317 - protein, 240 aa, Sorghum bicolor
  misc_feature: Ceres ANNOT ID no. 8640289
  misc_feature: Up-regulated in root tissues in response to methyl jasmonate treatment
  misc_feature: Up-regulated in shoot tissues in response to methyl jasmonate treatment
  misc_feature: Up-regulated in root tissues in response to aminocyclopropane carboxylic treatment
  misc_feature: Up-regulated in root tissues in response to salicylic acid treatment
  misc_feature: Up-regulated in shoot tissues in response to salicylic acid treatment
  misc_feature (6)..(200): SWISSPROT Homolog: EC 4.4.1.5 Lactoylglutathione lyase
  misc_feature (6)..(80): Pfam ID: GST_N Pfam Description: Glutathione S-transferase, N-terminal domain
  misc_feature (102)..(205): Pfam ID: GST_C Pfam Description: Glutathione S-transferase, C-terminal domain
MAGGGDDLKLIGLWSSPFVLRVQLALSLKGLRYEYIEEEALVNKSELLLKSNPVHKKVPVLIHNGKPVCESRVILQYIDEAFAGTGPSLLPADPYQRAVARFWAAYIDDTMLPIWNKSSMGKTEEEMAEGKKQSLAATEVLEGALRESFKGKPFFGGDSTGYVDVVLGGVLAWARASEELYGNNPFDPEQTPLLAAWSERFGALEAVEPVVPEVSRVVEFGKMLQARLAVAAALGAGASY

SEQ ID NO: 20318 - DNA, 3207 bp, Sorghum bicolor
  misc_feature: Ceres ANNOT ID no. 8640389
  misc_feature: Up-regulated in root tissues in response to salicylic acid treatment
  misc_feature: Encodes the peptide sequence at SEQ ID NO 20319
atggggtcgctcacgagggcggcggaggaggacccagcagcggctgcggaagaggagtggtccgacgaggccgtcatctacgtcaacggcgtccgtcgcgtgctccccgacggcctcgctcacctcaccctgctgcagtaccttagagatattggccttcgaggaacaaagcttggatgtggtgaaggtggttgtggagcctgcactgtcatggtctcttgctatgaccgaattacaaagaaatcactgcattttgcaatcaatgcatgcttggctccactttattctgtggaaggaatgcatataatcacagttgagggaattggagatcgacagcgaggtttgcacccagttcaggaatgtttagccaaggcacatggttcacaatgtggattttgcacccctggttttgtgatgtctatgtatgcactgctgagatcgagcaaacagcctcctactgaagaccagattgaagactgccttgcaggaaatttgtgtcgttgtactggctaccgaccaattatagatgccttccgtgtgtttgccaaaacagataatttggcatacaccaattcatcttcagaaaatacaaatgaccaagctatctgcccttctactgggaagccatgttcctgcaggaatgagacagatatcaatgttaatgagtcctcattaccgtcgtctgtggaaagatattcgccttattcatacaatgaaattgatgggagtgcatacaacgagagggaactcatcttccccccagaacttcagttgaggaaagttatgccacttaaattaaatgggttcaatgagatcaaatggtataggcctcttaaactaaagcaattattacatttgaaatcttgctacctggatgcaaagcttatcattggtaactcagaagtgggagtcgaaacaaagtttaagaatgcccaatataatgtcatgatctcagttactcatattccagagcttaataccctcaaagttaaagaagatggcatacacattggttctgctgtaagacttgcacaacttcaaaatttccttaaaaagattatagcagaacgtgatttgcctgaaacttcgtcatgccaggcaatagtacgtcagttaaaatggtttgcaggtacacaaatcaggaatgttgcatctgttggtggtaacatttgtactgctagtccaatatcagacctaaatccactttggatagctgtaggtgcaaaattccagataatagatgtgaacagcaatgttagaactatccttgcaaaggatttctttcttggttaccgtaaagttgacataaaacctgaagaaatattgctttctattatcctaccatggacaaggccttttgaatatgtcaaagaatttaaacaggcacatagaagggaggatgatattgctttggttaatgctggaatgcgtgtgtatttacaagaagctgaaggaaattggataatatctgatgtttcaattgtctttggtggagtagcagcagttccacttagtgcttcaaggaccgaaaactttcttactggaaagaagttggactctgggttgctggatgatactttcaatttattgaaagaagacatatctctttcagagaatgcacctggtggaatgattgaatttcgcagatcgcttactttgagtttctttttcaaatttttcctttctgttactcatgaaatgaaagtaaaagggttgttagaagatggattgcatgcagatcatctgtcagctgtacagccttacagtaggcctgttactgttggaactcaaagttatgaattagtaaggcagggaacttctgtaggtcagccaatggttcatatgtcagctatgcttcaggtcactggtgaggctgaatacactgatgacacaccgacacctcccaatactttgcatgctgctttggtgctgagtaagaaggctcacgctcgcatattgtctattgatgattcacttgccaaatcttcccctggctttgctgggctgttcctttcaaaagacatacccggtgttaaccataccggaccagttatccatgatgaggagttttttgcatccgacattgttacttgtgttggtcagatcattggaattgttgttgctgatacccatgataatgcaaaaactgctgccaacaaagtacatatcgagtattgtgagctcccagcaattttatctatagaggaagctgtcaagaatggaagctttcatccaaataccaagaaatgccttgtaaaaggcgatgtagaacaatgtttcctgtctggtgcgtgtgacagaattgtatcaggacaagttcatgttggaggtcaagagcatttttacatggaacctcaatgcactcttgtctggccagtggattctggaaatgaaattcatatggtctcatctactcaagctccacagaagcatcagaaatatgttgctagcgttcttggtcttccacaatcaaaagttgtttgcaagactaagcgtattggtggcggatttggtggaaaagaaaccagatcagcaatatttgctgctgcagcatctgtaccctctttctgtctgagaaggccagtaaagcttgttttggacagagacgttgacatgatatcaagtggacagaggcacagtttccttgggaaatataaggtgggatttaccaatgaagggaagatactggccctagacctggaaatttataacaacggtggccattcacttgatctatcccttgcagtactggagcgtgctatgtttcattcagaaaatgtctatgacatagcaaacatcagaatcaatgggcaagtatgctttacaaacttcccaagtaacactgctttccgaggttttggtggtccacaaggcttgttgatcgcagagaattggattcaccatatagctacagaactccaacgaagtcctgaggagataaaagaacttaattttcacaatgatggagttgtgctgcattatggccagttgctccagaattgtacaataggttcagtttgggatgaactaaaatcgtcttgtaattttgtggaagctcgcaaagctgtgaatagttttaacagtaatagccgctggaggaagcgaggaattgccatgattcccacaaaatttggcatatccttcactgcgaaattcatgaatcaggtgatccaccatggccattatgaattggagtttgtggggtaa

SEQ ID NO: 20319 - protein, 1068 aa, Sorghum bicolor
  misc_feature: Ceres ANNOT ID no. 8640389
  misc_feature: Up-regulated in root tissues in response to salicylic acid treatment
  misc_feature (25)..(1055): SWISSPROT Homolog: EC 1.17.1.4 Xanthine dehydrogenase
  misc_feature (270)..(450): Pfam ID: FAD_binding_5 Pfam Description: FAD binding domain in molybdopterin dehydrogenase
  misc_feature (457)..(568): Pfam ID: CO_deh_flav_C Pfam Description: CO dehydrogenase flavoprotein C-terminal domain
  misc_feature (622)..(729): Pfam ID: Ald_Xan_dh_C Pfam Description: Aldehyde oxidase and xanthine dehydrogenase, a/b hammerhead domain
  misc_feature (104)..(180): Pfam ID: Fer2_2 Pfam Description: [2Fe-2S] binding domain
  misc_feature (737)..(1068): Pfam ID: Ald_Xan_dh_C2 Pfam Description: Aldehyde oxidase and xanthine dehydrogenase, molybdopterin binding domain
  misc_feature (26)..(96): Pfam ID: Fer2 Pfam Description: 2Fe-2S iron-sulfur cluster binding domain
MGSLTRAAEEDPAAAAEEEWSDEAVIYVNGVRRVLPDGLAHLTLLQYLRDIGLRGTKLGCGEGGCGACTVMVSCYDRITKKSLHFAINACLAPLYSVEGMHIITVEGIGDRQRGLHPVQECLAKAHGSQCGFCTPGFVMSMYALLRSSKQPPTEDQIEDCLAGNLCRCTGYRPIIDAFRVFAKTDNLAYTNSSSENTNDQAICPSTGKPCSCRNETDINVNESSLPSSVERYSPYSYNEIDGSAYNERELIFPPELQLRKVMPLKLNGFNEIKWYRPLKLKQLLHLKSCYLDAKLIIGNSEVGVETKFKNAQYNVMISVTHIPELNTLKVKEDGIHIGSAVRLAQLQNFLKKIIAERDLPETSSCQAIVRQLKWFAGTQIRNVASVGGNICTASPISDLNPLWIAVGAKFQIIDVNSNVRTILAKDFFLGYRKVDIKPEEILLSIILPWTRPFEYVKEFKQAHRREDDIALVNAGMRVYLQEAEGNWIISDVSIVFGGVAAVPLSASRTENFLTGKKLDSGLLDDTFNLLKEDISLSENAPGGMIEFRRSLTLSFFFKFFLSVTHEMKVKGLLEDGLHADHLSAVQPYSRPVTVGTQSYELVRQGTSVGQPMVHMSAMLQVTGEAEYTDDTPTPPNTLHAALVLSKKAHARILSIDDSLAKSSPGFAGLFLSKDIPGVNHTGPVIHDEEFFASDIVTCVGQIIGIVVADTHDNAKTAANKVHIEYCELPAILSIEEAVKNGSFHPNTKKCLVKGDVEQCFLSGACDRIVSGQVHVGGQEHFYMEPQCTLVWPVDSGNEIHMVSSTQAPQKHQKYVASVLGLPQSKVVCKTKRIGGGFGGKETRSAIFAAAASVPSFCLRRPVKLVLDRDVDMISSGQRHSFLGKYKVGFTNEGKILALDLEIYNNGGHSLDLSLAVLERAMFHSENVYDIANIRINGQVCFTNFPSNTAFRGFGGPQGLLIAENWIHHIATELQRSPEEIKELNFHNDGVVLHYGQLLQNCTIGSVWDELKSSCNFVEARKAVNSFNSNSRWRKRGIAMIPTKFGISFTAKFMNQVIHHGHYELEFVG

SEQ ID NO: 20320 - DNA, 2730 bp, Sorghum bicolor
  misc_feature: Ceres ANNOT ID no. 8640409
  misc_feature: Down-regulated in shoot tissues in response to aminocyclopropane carboxylic treatment
  misc_feature: Encodes the peptide sequence at SEQ ID NO 20321
atggcgccggcggcgtcgactcgccgccgcaaggacgacgacggggccgcgccggagacgacgcagagggtcttccacttcggcaagggccggagcgacggcaacaaggcgatgaaagacttgcttggcgggaagggtgcgaacctggcggagatggcgagcatcgggctgtcggtgccgccggggttcaccgtgtccacggaggcgtgccggcagtaccagctgcaggagcttggcggcggcggcggcgggcggcggcgggccatgccggcggggctgtgggacgaggtcgtcgcggcgctgcggctcctggagcgcgccatggactcgggcctgggcgacccgcggcggccgctgctgctgtccgtgcgctccggcgccgccgtctccatgcccggcatgatggacaccgtgctcaacctcggcctcaacgaccaagtcgtcgccggcctcgcccaacgctgcggctgccgcttcgcctacgactcctatcgccgcttcctcgacatgttcggcaacgtggttatgggcatacctcatgcactatttgaagaaaaacttgaagccatgaaagttgacaaaggtttgcggaatgacactgagctggatgtcaaggatctggaagaacttgtagctcaatataagaatgtctatttggtggccaaaggtgaaaattgtccctcagatccaaagaagcagttgcatttggctatcttggctgtttttgattcatgggatagtgctagggcaaaaaagtacagaagcattaatcggattactggattgaagggcactgctgtaaatgttcagtgcatggtatttggcaacatgggtatcagatcaggcaccggtgttctctttactaggaaccctagtactggagagaaaaaactttatggagaattccttgtcaatgctcagggtgaggatgtggttgctggaattagaactccacaagagcttgatgcgatgaaggagtgcatgccagagccttatgcggaacttgttgcgaactgcaaaatcttggaaagccattataaagagatgatggacattgagttcactgttcaagaaaacagactttggatgcttcagtgcagaacagggaaacgtactggcaaaggtgcagtgaagattgctgtagacatggtcaatgagggcctgattgaccatcactcagcaattaagatggtggaaccacgacacttggaccagcttcttcatccgcagtttgaggacacattgtcatatgaagataaagtcatcgctacaggcttacctgcatcaccaggcgctgctgtgggtcagattgtcttcacagccgttgatgctgaaacatggcattcacaaggaaaatctgtcgttttggtgaggactgagaccagcccggaggatgttggtggcatgcatgcagctgctggaattctcacagccagaggtggtatgacttctcatgcagcagttgtagcccgtggctggggaaaatgttgtgtggcaggatgctcaagtatccatgtcaatgatgcagagaaggtggtagtggttggagaccaggtgctttgtgaaggtgactggttgtcactgaatggatcaaccggagatgttattttgggcaagctacctctctccccaccatcacttagtgctgatctagagatattcttgtcttgggtggatgaagttaaacagataaaggtcatggtcaatgcagacactcctgcggatgcactgactggaagaaaaaatggtgctcaagggattggattgtgcagaactgaacacatgttcttctcttctgatgagaggattaaggccatgaggcagatgataatggcggatactgctgaacagaggcagaaagcattagaccttctcttgccatatcagagggtagactttgaagggatttttcgtgcaatggatggtcttccagtaactatccggctcttggatcctccactccatgagtttcttccagagggcaacattgaggacattgttcacatgttatcttgtcacaccgattctactcatgaggaaatccttgcaagaatagaaaaaatttctgaagtgaatcctatgcttggtttccgtgggtgtaggcttggtatatcgtacccagaactaacagcaatgcaagcccgtgctatctttgaagctgctattgctgtgaatgatcaaggtttccaagtttttccagagataatggtgcctcttgttggtacacctcagagtgatgtttttcaggaacttgagcagcaaatgagtgtgattcatcaggtcgctcacaaggtttttgccaattcagaagcaactattagatacaaaattgggtccatgattgaggttcctagggcggccctcatagctgatgagatagcagaactggcagagttcttctcatttgggacaaatgacctcacacagatgacatttggttacagcagggatgacgttagcaagtttctcccaacctacatatcccagggtattctccagcacgacccattcgaggtgtttgaccagaagggagttggggagctggttaagattgcaactgcgaggggccgaaggtcaaggcctgatttggaggtgggcatttgtggggaacatggtggagagccgtcttcagtagcattttttgctaaggctggactggactatgtttcttgttcgcctttcagggtcccaattgcaaggttagctgcagcacaggcagcccttgaatga

SEQ ID NO: 20321 - protein, 909 aa, Sorghum bicolor
  misc_feature: Ceres ANNOT ID no. 8640409
  misc_feature: Down-regulated in shoot tissues in response to aminocyclopropane carboxylic treatment
  misc_feature (16)..(898): SWISSPROT Homolog: EC 2.7.9.1 Pyruvate, phosphate dikinase
  misc_feature (545)..(908): Pfam ID: PEP-utilizers_C Pfam Description: PEP-utilising enzyme, TIM barrel domain
  misc_feature (23)..(392): Pfam ID: PPDK_N Pfam Description: Pyruvate phosphate dikinase, PEP/pyruvate binding domain
  misc_feature (443)..(533): Pfam ID: PEP-utilizers Pfam Description: PEP-utilising enzyme, mobile domain
MAPAASTRRRKDDDGAAPETTQRVFHFGKGRSDGNKAMKDLLGGKGANLAEMASIGLSVPPGFTVSTEACRQYQLQELGGGGGGRRRAMPAGLWDEVVAALRLLERAMDSGLGDPRRPLLLSVRSGAAVSMPGMMDTVLNLGLNDQVVAGLAQRCGCRFAYDSYRRFLDMFGNVVMGIPHALFEEKLEAMKVDKGLRNDTELDVKDLEELVAQYKNVYLVAKGENCPSDPKKQLHLAILAVFDSWDSARAKKYRSINRITGLKGTAVNVQCMVFGNMGIRSGTGVLFTRNPSTGEKKLYGEFLVNAQGEDVVAGIRTPQELDAMKECMPEPYAELVANCKILESHYKEMMDIEFTVQENRLWMLQCRTGKRTGKGAVKIAVDMVNEGLIDHHSAIKMVEPRHLDQLLHPQFEDTLSYEDKVIATGLPASPGAAVGQIVFTAVDAETWHSQGKSVVLVRTETSPEDVGGMHAAAGILTARGGMTSHAAVVARGWGKCCVAGCSSIHVNDAEKVVVVGDQVLCEGDWLSLNGSTGDVILGKLPLSPPSLSADLEIFLSWVDEVKQIKVMVNADTPADALTGRKNGAQGIGLCRTEHMFFSSDERIKAMRQMIMADTAEQRQKALDLLLPYQRVDFEGIFRAMDGLPVTIRLLDPPLHEFLPEGNIEDIVHMLSCHTDSTHEEILARIEKISEVNPMLGFRGCRLGISYPELTAMQARAIFEAAIAVNDQGFQVFPEIMVPLVGTPQSDVFQELEQQMSVIHQVAHKVFANSEATIRYKIGSMIEVPRAALIADEIAELAEFFSFGTNDLTQMTFGYSRDDVSKFLPTYISQGILQHDPFEVFDQKGVGELVKIATARGRRSRPDLEVGICGEHGGEPSSVAFFAKAGLDYVSCSPFRVPIARLAAAQAALE

SEQ ID NO: 20322 - DNA, 1467 bp, Sorghum bicolor
  misc_feature: Ceres ANNOT ID no. 8640503
  misc_feature: Up-regulated in root tissues in response to salicylic acid treatment
  misc_feature: Up-regulated in shoot tissues in response to salicylic acid treatment
  misc_feature: Encodes the peptide sequence at SEQ ID NO 20323
atggcggagatggtgaggtatgcagttgccgaggagatagccaagcaaatcgtctccggcatcctggacaagcacggacggaaaccaccgaacgacaaggagcagctggagcggctggagatggcacacatcaagctggaggccgcgctggagacctccgacaggtggcagatccgcgacgcgtccctgctccgctggcgcaagaagctcaagcgcgccgctcaggagtgcgacgacacgctgcgccggtgcaagcagcgcgccgtggccgtggacgaggacgaggacggccaagagaagcatcagcgtgtgccggtgatccgccgctcgtcctcgtccttgccgacgcggctcgtccacgccaccacgtccttcgtctcctccatcctcctcagcgcccgcaacaggaccgacgccgccgccgacgccgacgccgacgacgacgggtgcggctggagcggcggcagcgccgtacggagattcgagtggttcgcggacggcgccgccgagttcctgcggttcgtggagctgggcggcacgccgtggccgcggtacacgttcttcgaccctctcatcgcgcgcctgctcgccggcgaggaggcgaggtacaggctcgtccgaggaagccagtactacctgttctgcgtgcgtcccatcgtcctggaaggccgtggcacggaggcgaagctcatcttcttctacgaagacgacgacgcgccggagaagaacctgtgcatcggcaccatgctgcgcctttcggagagcacggacattgtcgggatcacgatccagtgcctgcagctgctggtgacgccgcatttcaagtccacggctgaagctgccaccagggagctcgctaaccttccgacgcaggacttctcctgggtgccctacggtggttctactcacagagagcactgggacagcatccacaaagacatgagccagtggttccggccggacccgctgtgtccgacgacttcgtcagaagacacgccatacctgaagcttggtctcctgttcacaccccatggatctttaggagacttgacgccgaaagccgagtcgtcggcgctggaggtgatcgacggcgaggagcagcgtggtaggcacaccaacctgagcctgcggcagatggacgagaccatgctgcccaaggcgctgcagtgtctctaccagaagacggaggcgatggcgtaccagatgctctggaaatccaagcatggcgcggcgtaccttcaggtgaggaagacgacgccacgcaagaattggaagggagataacaagaacaagaggctgctaatgcagcgatatcatcaagacccaaagctggagagatggacacatgtcctcacaaactttctgaatttgtgggtcgcgcgcgcacctgatgacaggctacggagttcgatgacgcaatggttgcagagggcaaatgagaagcaattggcagttctgcgttgttaa

SEQ ID NO: 20323 - protein, 488 aa, Sorghum bicolor
  misc_feature: Ceres ANNOT ID no. 8640503
  misc_feature: Up-regulated in root tissues in response to salicylic acid treatment
  misc_feature: Up-regulated in shoot tissues in response to salicylic acid treatment
MAEMVRYAVAEEIAKQIVSGILDKHGRKPPNDKEQLERLEMAHIKLEAALETSDRWQIRDASLLRWRKKLKRAAQECDDTLRRCKQRAVAVDEDEDGQEKHQRVPVIRRSSSSLPTRLVHATTSFVSSILLSARNRTDAAADADADDDGCGWSGGSAVRRFEWFADGAAEFLRFVELGGTPWPRYTFFDPLIARLLAGEEARYRLVRGSQYYLFCVRPIVLEGRGTEAKLIFFYEDDDAPEKNLCIGTMLRLSESTDIVGITIQCLQLLVTPHFKSTAEAATRELANLPTQDFSWVPYGGSTHREHWDSIHKDMSQWFRPDPLCPTTSSEDTPYLKLGLLFTPHGSLGDLTPKAESSALEVIDGEEQRGRHTNLSLRQMDETMLPKALQCLYQKTEAMAYQMLWKSKHGAAYLQVRKTTPRKNWKGDNKNKRLLMQRYHQDPKLERWTHVLTNFLNLWVARAPDDRLRSSMTQWLQRANEKQLAVLRC

SEQ ID NO: 20324 - DNA, 2439 bp, Sorghum bicolor
  misc_feature: Ceres ANNOT ID no. 8640549
  misc_feature: Up-regulated in root tissues in response to methyl jasmonate treatment
  misc_feature: Up-regulated in shoot tissues in response to methyl jasmonate treatment
  misc_feature: Up-regulated in shoot tissues in response to salicylic acid treatment
  misc_feature: Encodes the peptide sequence at SEQ ID NO 20325
atggcaaccttcttcatgatcctgctattactatcactgcttcccctccacttgagtgccgcgcctcgcgacactctactgctgggatcctcgctctctgtcgaggagcaccagaccgacgttctgcaatcaccggaaggcactttctcctgtggcttccacagcatctatgaaagtgccttcaccttctcgatatggtacaccaactcagtgaacaagacggtcgtctggaccgcgaaccgtgaccgccccgtgcatgccaggggcgcggtggtcaccctgcggaaggacggcaccatggttctcacggactatgatggcgcagtggtgtggcaaacagaaggagacctggtgggtgttcagtacgcgaggctcctggacactgggaacctagtcatggcgaactccagcggcatggttgtgtggcagagcttcgattcgccaacagacaccctcctgccgacccaacacatcacttcaactacgacgctggtttccaccactcatctgcatgttccaggtccctacatattccatttcacggattcatcgatactgtccctcatttatgatgatgccggtgtccatgaaatatattggccaaaccctgacaacggagagtatcagaatgataggaataggtataacagtacaaggcttgggtttatagatgatactggcagatttttttcaagtgatttcgccaaccagcagccacttgttgcctctgatgaaggtgttgggatcaaaagaaggcttactctggaccccgatggtaatctccgactctacagcttgaatgattcagatggcagatggtcggtttcatggattgcagtgtctcagccttgcaatattcatggcttgtgtggtccgaatgggatctgccactactttcctacacctacatgctcttgcccaccaggttacgtgatgagccaacctggtaattggagccaaggctgtagacctgtagtagacattgtctgtactgctaagaaagcgcaacctgtcaagttcttgcgacttccaggtaccgacttttggggatccgatcagcagcatccggacaaagtatccttgcaggcttgcaagaacatatgtaggaaggactgcacctgcaaaggctttcagtaccagcaaggaacagggacatgctatccaaaggcttccctttataatgggaaggcatacacggcacctacaatatcgacgcccatgatgtatctcaagctaccagtgggcgtgaatatttcaggtatttcagttccccaaaccaatgtgcttatttcaccaagaaagcaacatcttgactgtggccagatgagcgcatcaacgttggaactatttccagagattcacaagtccagccagggggaagcaaaatggttttacttctatgggtttgcaggttcaatttttgttcttgaagccttcttcattgcatccgcatggtgctttgttttgagatgggagttaggagcgtccgaaatacaagcagttgaggaaggctacaatgccttgaccagtaatttcagaagatacagttataaagagttggtcaaagcaacaagaaagttcaaagatgagcttggaaaaggaggctcagggattgtctacaagggagtcttggatgacaatcgagaagttgctgttaagatgctggaaaacgtaaggcaatgcgaggaggagtttcaagcagaactgcgcataattgggaggattaatcatatgaatctagtaaggatatggggggtttgctctgaaagctcacacaggatgttggtcaccgagtatattgagaatgggtcattagctcatgtcctattcaaaggccacattctgctggagtggaggcagaggtttaatattgcgttaggcgtggcaaagggtttggcttatcttcaccatgaatgtcttgagtgggtaatacactgtgatgtgaagccagagaacatactgttggatcggaatctagaacccaagattgctgactttgggttggcgaagctgctgaacagaggttcctctaaccagaatgtgtcaagagttcgaggaaccataggttacatagctccagagtggatcagcagcctccagatcacggccaaggttgacgtttatagctatggggttgtgcttcttgagctagtcttgggaagacgcgttctcgacatggctctagctgctaatgaggaggtgcataaggtgcttaggaagtatgtagccatgctagctcttatgttggataaagaggaaccctcttcaattgccgaggttgtggattgcagactgagtggccaattcaactacatgcaggtaagaacactgatcaaattggctgtctcatgcgtggatgaagacagaagcaaaaggccaacaatggaatctatagtgcaaatgctccttttagctgatgaatcgtgtagcatgtgctag

SEQ ID NO: 20325 - protein, 812 aa, Sorghum bicolor
  misc_feature: Ceres ANNOT ID no. 8640549
  misc_feature: Up-regulated in root tissues in response to methyl jasmonate treatment
  misc_feature: Up-regulated in shoot tissues in response to methyl jasmonate treatment
  misc_feature: Up-regulated in shoot tissues in response to salicylic acid treatment
  misc_feature (470)..(802): SWISSPROT Homolog: EC 2.7.11.1 Non-specific serine/threonine protein kinase
  misc_feature (525)..(804): Pfam ID: Pkinase Pfam Description: Protein kinase domain
  misc_feature (72)..(178): Pfam ID: B_lectin Pfam Description: D-mannose binding lectin
  misc_feature (203)..(318): Pfam ID: S_locus_glycop Pfam Description: S-locus glycoprotein family
  misc_feature (330)..(395): Pfam ID: PAN_2 Pfam Description: PAN-like domain
MATFFMILLLLSLLPLHLSAAPRDTLLLGSSLSVEEHQTDVLQSPEGTFSCGFHSIYESAFTFSIWYTNSVNKTVVWTANRDRPVHARGAVVTLRKDGTMVLTDYDGAVVWQTEGDLVGVQYARLLDTGNLVMANSSGMVVWQSFDSPTDTLLPTQHITSTTTLVSTTHLHVPGPYIFHFTDSSILSLIYDDAGVHEIYWPNPDNGEYQNDRNRYNSTRLGFIDDTGRFFSSDFANQQPLVASDEGVGIKRRLTLDPDGNLRLYSLNDSDGRWSVSWIAVSQPCNIHGLCGPNGICHYFPTPTCSCPPGYVMSQPGNWSQGCRPVVDIVCTAKKAQPVKFLRLPGTDFWGSDQQHPDKVSLQACKNICRKDCTCKGFQYQQGTGTCYPKASLYNGKAYTAPTISTPMMYLKLPVGVNISGISVPQTNVLISPRKQHLDCGQMSASTLELFPEIHKSSQGEAKWFYFYGFAGSIFVLEAFFIASAWCFVLRWELGASEIQAVEEGYNALTSNFRRYSYKELVKATRKFKDELGKGGSGIVYKGVLDDNREVAVKMLENVRQCEEEFQAELRIIGRINHMNLVRIWGVCSESSHRMLVTEYIENGSLAHVLFKGHILLEWRQRFNIALGVAKGLAYLHHECLEWVIHCDVKPENILLDRNLEPKIADFGLAKLLNRGSSNQNVSRVRGTIGYIAPEWISSLQITAKVDVYSYGVVLLELVLGRRVLDMALAANEEVHKVLRKYVAMLALMLDKEEPSSIAEVVDCRLSGQFNYMQVRTLIKLAVSCVDEDRSKRPTMESIVQMLLLADESCSMC

SEQ ID NO: 20326 - DNA, 1755 bp, Sorghum bicolor
  misc_feature: Ceres ANNOT ID no. 8640684
  misc_feature: Up-regulated in shoot tissues in response to salicylic acid treatment
  misc_feature: Encodes the peptide sequence at SEQ ID NO 20327
atggcggaggcggaggcggaggccgcgcccgcagcagcagccggcggcggcggcatcggggacatcctcgccaccgccgagcgggacttcctcgtccgcaactccggtgagcaggtgaagatcagcagcatcgaggcgagccctgtggccatctacttctcggcctcatggtgcccgccatgcaggaggttcacgcccaagcttattgaagtgtacaaagaactggctgaacagggcaagagcttcgaggtcatctttgcttcggctgatcagaatgaggaaggattcaatgaatactttgcaaagatgccatggttggctgtccctttttctgacaccgaaggccgtgcggcccttgatgcccggttcaaggtctctggtatcccacacctggtcatccttgatgcaaaaactggtgaagtttacactgaagatggtgttgaatttgtgagtgagtatggcgtggaggcttaccctttcacaccagataggatcaatgaactgaaggaacaggaaaaggcagaaaaggagaatcaaactattcaaagcgtgcttggcacatctactcgagactatctcatttcaaacaagggagacaaggtacccatctctgagcttgaggggaagtatgttggtctgtgctttgtggtggatggctatggaccagtcattgaattcactgattcgcttgctaagatctatgagaaactcaaagaagtgggggagaaatttgaagttgtagctgtatccttggacagtgaagagtcagcatttaatgagagttttgcaaagatgccttggcttgcaattcctcaaggtgaccagaagtgtgagaagctggttcgttactttgagcttaggtctcttcctacactagttctgattggccctgatgggaagacactgaacagcaatgttgcggacataattgatgagcatggttttgaggcatgggagggcttcccattcagtgctgagaagctggaaattcttgctgagaaggcaaaggctaaagctgcatctcagaccttggagtcccttctaatcagtggtgatttggactttgtcattggaaaaggtggagcaaaggttcctgtatcagaacttgttgggaagactgtcctcctctacttctcagcaaaatggtgtggaccatgccgtgccttcctgcccacacttgtcaaggaatacaacaagatcaaagagaagaacagtgattttgagatcgtcttcatctccagtgacagggatcagagctcattcgatgattttttctctcaaatgccatggcttgctctacccttggaagatgaaaggaaggtatccctgaagaagaccttcaaaatccgcgggatcccttcacttgtcgccatcggtcctactgggcagacagtcagcagggacgcaaaggcccagctgatgatccacggtgctgatgctttcccattcactgaggagagactcgaggagctgcagaagaagctggacgagatggcaaaggggtggcctcagaagctgaagcatgagctgcatgacgagcatgaactcgtcctgctgcgccgtggtacgtacggctgcgacgggtgtgaagagatgggcagcacatggtcctacaggtgcgatgagtgtgactttgatctgcaccccaagtgcgcgttggcggaggaaaagaagggtgaagaggaggaaggcaagtccactgaggaagcccctgctgggtatgtgtgcgaggaaggcgtgtgcaggaaggtctag

SEQ ID NO: 20327 - protein, 584 aa, Sorghum bicolor
  misc_feature: Ceres ANNOT ID no. 8640684
  misc_feature: Up-regulated in shoot tissues in response to salicylic acid treatment
  misc_feature (19)..(93): SWISSPROT Homolog: EC 5.3.4.1 Protein disulfide-isomerase
  misc_feature (335)..(467): Pfam ID: AhpC-TSA Pfam Description: AhpC/TSA family
  misc_feature (185)..(304): Pfam ID: AhpC-TSA Pfam Description: AhpC/TSA family
  misc_feature (19)..(144): Pfam ID: AhpC-TSA Pfam Description: AhpC/TSA family
  misc_feature (524)..(552): Pfam ID: C1_3 Pfam Description: C1-like domain
MAEAEAEAAPAAAAGGGGIGDILATAERDFLVRNSGEQVKISSIEASPVAIYFSASWCPPCRRFTPKLIEVYKELAEQGKSFEVIFASADQNEEGFNEYFAKMPWLAVPFSDTEGRAALDARFKVSGIPHLVILDAKTGEVYTEDGVEFVSEYGVEAYPFTPDRINELKEQEKAEKENQTIQSVLGTSTRDYLISNKGDKVPISELEGKYVGLCFVVDGYGPVIEFTDSLAKIYEKLKEVGEKFEVVAVSLDSEESAFNESFAKMPWLAIPQGDQKCEKLVRYFELRSLPTLVLIGPDGKTLNSNVADIIDEHGFEAWEGFPFSAEKLEILAEKAKAKAASQTLESLLISGDLDFVIGKGGAKVPVSELVGKTVLLYFSAKWCGPCRAFLPTLVKEYNKIKEKNSDFEIVFISSDRDQSSFDDFFSQMPWLALPLEDERKVSLKKTFKIRGIPSLVAIGPTGQTVSRDAKAQLMIHGADAFPFTEERLEELQKKLDEMAKGWPQKLKHELHDEHELVLLRRGTYGCDGCEEMGSTWSYRCDECDFDLHPKCALAEEKKGEEEEGKSTEEAPAGYVCEEGVCRKV

SEQ ID NO: 20328 - DNA, 2538 bp, Sorghum bicolor
  misc_feature: Ceres ANNOT ID no. 8640834
  misc_feature: Up-regulated in root tissues in response to methyl jasmonate treatment
  misc_feature: Up-regulated in shoot tissues in response to methyl jasmonate treatment
  misc_feature: Encodes the peptide sequence at SEQ ID NO 20329
atgatgatggcacagcagccacagacgacgcagctgctgctgcacggggtgatcgacgccaggatcctcgaggccgacctgtccgtcaccacggacggcaagctgcagccgaccaagaagactttgatgaagaagaaggtcttctcatggatcaggaagctgaccttctgcaaaggccagcaacagctggagaatgccatcggcctgggcacggacggcaagctgtacgcgacggtggacatcgacaaggcgcgcgtggggcggacgcgcatggtgccccccgtgcactcccccaagtgggacgagtccttccacatctactgcgcgcacgacgccagcaacatcatcttcaccgtcaaggccgacaacgccatcggcgccacgctcatcggccgcgcctaccttcccacggagggcgtcgtcgccggccagaaggtggacctgtggctccccatccgcgacgagaagcggcagccgctggaaggcggtgaccagatacgcgtccagctccagttcaccaacgtcgccgccgacccgaccgccgggtggggcaccggcgtcggcagcggcgcgtacggcggcgttccctacaccttcttcaagcagcgccgcggctgccgggttcggctgtacgaggacgcccacgtcgccggcgacttcgcgccgcgcgtccggctcgcggacggcagcttctacgagccgcgccggtgctgggtggacgtgttcgacgccatcaacagggcccggcggatggtgtacgtcgccgggtggtccgtgaacacggacgtcgtgctggtgcgcgacccgcgggagccgtcgtcggcgtcgtccgagaacctcggcgagctgctcatccggaaggcgaacgagggcgtcgcggtgctgatgctggtgtgggacgaccgcacctcggtggggctcggccccatcaagcgcgacgggctgatggccacgcacgaccaggacacggagagcttcttccgcgacacgcgcgtgcagtgcgtgctgtgcccgcggaaccccgacaaggaccggagctacgtgcaggacatcgagacggccaccatgttcacgcaccaccagaagacggtgatcgtcgacggcggcggcggcaggacggggccggagtcgccgccggggctcgtgagcttcctcggcggcatcgacctgtgcgacgggaggtacgacacgcaggaccacccgctgttccgcacgctgggcaccacgcacagcagggacttccaccagccaaacttccccggcgcgtccatcagcaagggcgggccgagggagccgtggcacgacatccactgccgcgtcgagggccccgcggcgtgggacgtgctggagaacttcgagcagaggtggaagaagcagggcaagggcgacaacatgctggtggcgctcaacaaggcgtgggcggagcgcgaggcggccgccggcgacgcagagtcgtggaacgtgcaggtgttccggtccatcgacggcggcgcggcggcggggttcccggagggctccgccgacgcgcccagggaggccgcggcgctggggctggtgagcggcaaggaccacgtgatcgagcgcagcatccaggacgcgtacatccacgccatccgccgggcgcgggacttcgtctacatcgagaaccagtacttcctggggagctcctacgcgtggcggcggcagaacgacggcgtgacggtggaggacatcaacgcgctgcacctcatccccaaggagctgtcgctcaagatcgtcagcaagatcgaggccggcgagcggttcgccgtctacgtggtggtgcccctctggccggagggcgtgccggagagcggctccgtgcaggccatcctcgactggcagcgccgcaccatggagatgatgtacagggacgtcacgctggccattcgcgccaaggggctccaggacgaccccagggactacctcaccttcttctgcctcggcaaccgcgaggcgccgagccccggcgagtacgtgccgccggaccacccggaccccaacaccgactacgagagggcgcagcaggccaggcgcttcatgatctacgtccatgccaagacaatgatagtggacgacgagtacatcatcgtgggatcggccaacatcaaccagcgctccatggacggcggccgcgacacggagatcgcgatgggcgcgtaccagccgggatacctggcgaccaggaaccggccggcgaggggccaggtccacggcttccgagtctccctgtggcaggagcacctggcccaggcggcggcggcggcggcgggcggagatctcctccgtccgtcgagcctggcctgcgtgcgccggatgaaccaggtggcgaagcagcactgggacatgttcgcgagcgacgcgttccggggcgacctcccgggccacctcatggcgtacccggtcagcgtgctcgacgacggcagcgtcgtggcgacgacggaatccttcccggacaccaacaacgccaaggtgctcggcaacaagtccgacatcctcccgcccatcctcaccacatga

SEQ ID NO: 20329 - protein, 845 aa, Sorghum bicolor
  misc_feature: Ceres ANNOT ID no. 8640834
  misc_feature: Up-regulated in root tissues in response to methyl jasmonate treatment
  misc_feature: Up-regulated in shoot tissues in response to methyl jasmonate treatment
  misc_feature (56)..(845): SWISSPROT Homolog: EC 3.1.4.4 Phospholipase D
  misc_feature (355)..(394): Pfam ID: PLDc Pfam Description: Phospholipase D Active site motif
  misc_feature (686)..(713): Pfam ID: PLDc Pfam Description: Phospholipase D Active site motif
MMMAQQPQTTQLLLHGVIDARILEADLSVTTDGKLQPTKKTLMKKKVFSWIRKLTFCKGQQQLENAIGLGTDGKLYATVDIDKARVGRTRMVPPVHSPKWDESFHIYCAHDASNIIFTVKADNAIGATLIGRAYLPTEGVVAGQKVDLWLPIRDEKRQPLEGGDQIRVQLQFTNVAADPTAGWGTGVGSGAYGGVPYTFFKQRRGCRVRLYEDAHVAGDFAPRVRLADGSFYEPRRCWVDVFDAINRARRMVYVAGWSVNTDVVLVRDPREPSSASSENLGELLIRKANEGVAVLMLVWDDRTSVGLGPIKRDGLMATHDQDTESFFRDTRVQCVLCPRNPDKDRSYVQDIETATMFTHHQKTVIVDGGGGRTGPESPPGLVSFLGGIDLCDGRYDTQDHPLFRTLGTTHSRDFHQPNFPGASISKGGPREPWHDIHCRVEGPAAWDVLENFEQRWKKQGKGDNMLVALNKAWAEREAAAGDAESWNVQVFRSIDGGAAAGFPEGSADAPREAAALGLVSGKDHVIERSIQDAYIHAIRRARDFVYIENQYFLGSSYAWRRQNDGVTVEDINALHLIPKELSLKIVSKIEAGERFAVYVVVPLWPEGVPESGSVQAILDWQRRTMEMMYRDVTLAIRAKGLQDDPRDYLTFFCLGNREAPSPGEYVPPDHPDPNTDYERAQQARRFMIYVHAKTMIVDDEYIIVGSANINQRSMDGGRDTEIAMGAYQPGYLATRNRPARGQVHGFRVSLWQEHLAQAAAAAAGGDLLRPSSLACVRRMNQVAKQHWDMFASDAFRGDLPGHLMAYPVSVLDDGSVVATTESFPDTNNAKVLGNKSDILPPILTT

SEQ ID NO: 20330 - DNA, 600 bp, Sorghum bicolor
  misc_feature: Ceres ANNOT ID no. 8640896
  misc_feature: Up-regulated in shoot tissues in response to methyl jasmonate treatment
  misc_feature: Up-regulated in root tissues in response to methyl jasmonate treatment
  misc_feature: Encodes the peptide sequence at SEQ ID NO 20331
atggcggcgaacaacgactgcgtcgtcagaacattcgacgccgagagatacagccttctcagtcagttcaccttcccgtggtctgtcaacagcacgtcggtgagccccgacggcaagctgctggcggttctgggcgacagcacggagtgcgtgatcgcggacccgcagtcgggcagggcgacggcgacgctgcgcgggcaccaggactactccttctcgtcggcgtggcaccccgacggccgcgtcctggcgacggggaaccaggacgggacgtgcaggctgtgggacgcgcgcagcctgtcggagccgttcgcggtgctgaaaggccggatcggcgccgtccggggcctccggttctcccccgacggcggcaggttcctggcagcggccgaggccgccgacttcgtgcacgtgtacgacgccgcggccgggtacgtcgggcgcgagcaggaggtggagctgttcggggaggtggccggcgccgcgttcagccccgacggcgaggcgctgttcgtcagcgtcgccgaccgcacctacggcggcctgctcgagttccgccgccgccgggcggacggctacctcgacacgtgtttcttctga

SEQ ID NO: 20331 - protein, 199 aa, Sorghum bicolor
  misc_feature: Ceres ANNOT ID no. 8640896
  misc_feature: Up-regulated in shoot tissues in response to methyl jasmonate treatment
  misc_feature: Up-regulated in root tissues in response to methyl jasmonate treatment
  misc_feature (37)..(180): SWISSPROT Homolog: EC 2.3.1.48 Histone acetyltransferase
  misc_feature (58)..(96): Pfam ID: WD40 Pfam Description: WD domain, G-beta repeat
MAANNDCVVRTFDAERYSLLSQFTFPWSVNSTSVSPDGKLLAVLGDSTECVIADPQSGRATATLRGHQDYSFSSAWHPDGRVLATGNQDGTCRLWDARSLSEPFAVLKGRIGAVRGLRFSPDGGRFLAAAEAADFVHVYDAAAGYVGREQEVELFGEVAGAAFSPDGEALFVSVADRTYGGLLEFRRRRADGYLDTCFF

SEQ ID NO: 20332 - DNA, 4845 bp, Sorghum bicolor
  misc_feature: Ceres ANNOT ID no. 8640872
  misc_feature: Up-regulated in shoot tissues in response to salicylic acid treatment
  misc_feature: Encodes the peptide sequence at SEQ ID NO 20333
atgccgaaggtctttggcaccggcgtcttcgagttccggcacccccgggcggccgagtacccgctccccgcggacgccgcccccgccacggccgcggcgcccgacaaggtccccgcatcaaccggcggcggctccatcacgctcctcgacatccagcgggaccgcctcacccgcgtcgccaccgagcattggggcacgcccgccgccgcgtcggccttcgacgcggaccttgtcaggaagatctatgccaccgagctccgcgtcgaggggcggggccggaagaccgtgccgctgcagcgcgtcatgatcctcgaggtcagccagtacctcgagaactacctgtggccgcacttcgacccggcgcacgcttccttcgagcacgtgatgtccatcatcctcatggtcaacgagaagtttcgggagaatgtggcggcttggacatgtttccatgaccggaaggatgcattcaaggggttcctgtggcgggttctcaagctcaaggaagaggaaagggctcttaatatggcggagaaaacaaattacctcctgttcatgataaattcatttcagagtttggaggacgagcttgtccgggaaacgatacttcagttagtaagcctaaagctgtggaatactctatcttttggacgacttcagatggaactctgccttaaccctgaattgattaagaagtggaccaaaatcaaaagaagagaggcaaaggaagcaaaaaaggctgaccaacctattgacccttctgaaatgctcgagaataaattccttaggaatctaattgaagagttcttggagattctcgattcaaaggtcatactatccaatcaagatgctggtgaagaatctgtattgaacgagtcgctcagtgggcagatcgatgattcttgtgtcctatattgtgagagatttatggaatttttgattgacatgttaagccagcttcctactagacgatttttgaggcccctagttgctgatgttgctgttgttgccaagtgccacttaagtgcactctatactcatgagaagggacgcctttttgcacagttggttgacttgctgcagttttatgaaggttttgagattaatgatcactctgggacacagctcggtgatgatgatgtcctgcaggcgcattattcccgtttccaagcttttcagctactagcatttaaacaagtgcctaagttgcgagattttgccttgtctagtattggttcactccataagcgagctgacttagcaaaaaagctacttgtcttgtcagatgtggaactgcaagatctggtttgtaacaagcttaagttaatctcagcgaaagatccatgcagtggaaggcgtgattttcttattgaagtcctagttgctttttttgagaagcggcaatcccaaaaagatgcagtaaacgcacttcctctgtatccaaatgagcagatcatgtgggatgaaagccttgttcctagcattaattactccggagaaggctgccttgccctcccaaaactcaatctccaattcctgacgcttcatgattatttgttaaggaatttcaatctgtttcgtcttgaatcaacctatgaaattcgtgaagacattcaggaagctgttcctcatctacatgcttatatcaacaatgaaggagagactgccttccgtggatggtccagaatggctgttccgattaaggaatttaagattacagaagtgaagcagccaaacattggagaagttaagccttctgctgtaactgctgatgttactttcagcatatcaagctacaggcatcagataaaatctgaatgggatgctctgaaggagcatgatgttctatttttgctgtcaatccgcccctcttttgaacctcttagccctgaagaggctgcaaaatcaactgtgccagaaaggttaggattgcaatatgtacgtggatgtgaggttattgaaattcgtgatgaggaaggaacactcatgaatgacttcacaggaaggataaagcgagaagagtggaaaccacccaaaggtgagattcgtactgtccgagttgccttagatacagcacagtaccacattgatgttactgagacagcagagaagggcgcagaaaatgtgtatggaacatttaatattctaatgagaaggaaacccaaggagaataatttcaaagcaatcttggaatctatacgtgatctaatgaacgaaacatgtgtagttccagaatggttgcataacatattcttgggctatggaaatccttcagctgcacagtggatgaatatgcctgatcttctggaagttatagatttcaaggacacttttcttgatgccagccatgttcagcaaagttttccagattaccaggttacatttatcaattctgatggtacagaaaacctgcatccaagtcccccttttaagattaggctatccaagaaaatgagggaaagcagtcatgctctacctggcaacgtgaactccaatttgactgttaagagtaataatatcgctgatggggagcctcagaaagagaaactgattgttgaaagttacattccagctgatcctgggccatatcctcaagataaacctaaacagaactcagtgaggttcacacccactcagattggtgctataatatcaggtattcaacctgggttgacaatggttgttggtcctcctggtacgggaaaaacagatacagctgtgcagatattaaatgttctatatcacaactgtccttcacaaagaacactgattataacccattccaatcaggctttgaatgacttatttgagaagataatgcagagggatgtgcctgctaggtaccttctccgccttggtcagggtgagcaagaactggccactgatcttgattttagtcgtcaaggtcgtgtcaatgctatgctggtccgacggctagagctgctcggtgaagtttctaaattggcgagatctcttcgtcttccagaagatgtgggctacacatgtgaaactgctgcatatttttggttattacatgtttatgcccgttgggaacaattcttagctgcctgtgctcaaaatcaagacaaaccctctttcgtcaaagatcgcttcccattttcagagttcttttcagatactccgcagcctatttttactggcgagtcatttgagatggatatgcatgcagcgaaaggttgtttcaaacatctttctataatattccaagagctggaagagtgtagggcttttgagctactcaagtcaacagtggagcgagcaaactatctaatgactaaacaggccaagatagttgctatgacttgtactcatgcagcattgaagaggagagactttcttcaattaggtttcaaatttgacaatttgctgatggaagaaagtgcacagatattggagatagaaacttttataccgatgctgctgcagcggcaggaagatggccatgctcgccttaaacgttgcattttaattggtgatcaccatcagttaccccctgttgtgaagaacatggcttttcagaagtacagccacatggaccagagtctctttacaaggtttgttcgacttggtgtcccttatattgagctcaatgctcaaggtcgtgcaagacctagtattgctgaactttataactggagatacagagaactgggagatctgccttatgtccgtgagcaagcaatcttccataaagctaacgctgggttctcttttgagtatcagttagttgatgttcctgattataagggaaaaggcgagtcagcaccttctccttggttctaccagaatgaaggcgaggctgagtatattgttagtgtgtatatctatatgcgcctgattggctaccctgccactaagatttcaatattaaccacctacaatggtcagaagcttcttattcgtgatgttatcaacaaaagatgcaagccatggaatattgagccccctaacaaggttaccactgtggacaagttccagggccagcaaaatgatttcattttactctctcttgtccgtacccgttttgtgggtcatcttcgtgatgtcagaagacttattgtagctatgtcccgtgctcgtctgggcctgtatgtgttctgccgtcgttcactgtttgaacaatgttatgaattgcaaccgacattccagctgctcctccaaagacctgataagctcgccctgaaccttgaggagtgcactccttttaccgagcgacctttggaggaaactggaaacattcattacattactggtactgaagacattgatcatctagtgaagttcaggctggaacatcttcgtcagatgcaatacatgcagtattatgctcctccagcaaatgaactgcctcaagcagtgccagaaaatattgctgatgcaatcccttctgaaaatgggaatgctggtagtgctctgaatgatgcaaatgagcacatggcagtggaagaaaatggtggtgcgactgacacagtgatcgataataggatggaggaagatggtgttgaggcaaaggatgacatgacacaggaagggaacaagggtgaagggagtggcgagggtcacatggctacagaggatacacaaggggaagtacaagctagcacaaatgacaagatggaggatgcagatgccacgtcgacagacaaaatggaagaagcaaatgccatgccgactgacaagatggaggaagcaaatgccacgtcgacggataagacggaggaagcaaatgccacgtcgacggacaagacggaggaagcaaatgccacgctgacagacaagatggaggaggaaaattctgatctgaaggacaagatggatgaagagtga

SEQ ID NO: 20333 - protein, 1614 aa, Sorghum bicolor
  misc_feature: Ceres ANNOT ID no. 8640872
  misc_feature: Up-regulated in shoot tissues in response to salicylic acid treatment
MPKVFGTGVFEFRHPRAAEYPLPADAAPATAAAPDKVPASTGGGSITLLDIQRDRLTRVATEHWGTPAAASAFDADLVRKIYATELRVEGRGRKTVPLQRVMILEVSQYLENYLWPHFDPAHASFEHVMSIILMVNEKFRENVAAWTCFHDRKDAFKGFLWRVLKLKEEERALNMAEKTNYLLFMINSFQSLEDELVRETILQLVSLKLWNTLSFGRLQMELCLNPELIKKWTKIKRREAKEAKKADQPIDPSEMLENKFLRNLIEEFLEILDSKVILSNQDAGEESVLNESLSGQIDDSCVLYCERFMEFLIDMLSQLPTRRFLRPLVADVAVVAKCHLSALYTHEKGRLFAQLVDLLQFYEGFEINDHSGTQLGDDDVLQAHYSRFQAFQLLAFKQVPKLRDFALSSIGSLHKRADLAKKLLVLSDVELQDLVCNKLKLISAKDPCSGRRDFLIEVLVAFFEKRQSQKDAVNALPLYPNEQIMWDESLVPSINYSGEGCLALPKLNLQFLTLHDYLLRNFNLFRLESTYEIREDIQEAVPHLHAYINNEGETAFRGWSRMAVPIKEFKITEVKQPNIGEVKPSAVTADVTFSISSYRHQIKSEWDALKEHDVLFLLSIRPSFEPLSPEEAAKSTVPERLGLQYVRGCEVIEIRDEEGTLMNDFTGRIKREEWKPPKGEIRTVRVALDTAQYHIDVTETAEKGAENVYGTFNILMRRKPKENNFKAILESIRDLMNETCVVPEWLHNIFLGYGNPSAAQWMNMPDLLEVIDFKDTFLDASHVQQSFPDYQVTFINSDGTENLHPSPPFKIRLSKKMRESSHALPGNVNSNLTVKSNNIADGEPQKEKLIVESYIPADPGPYPQDKPKQNSVRFTPTQIGAIISGIQPGLTMVVGPPGTGKTDTAVQILNVLYHNCPSQRTLIITHSNQALNDLFEKIMQRDVPARYLLRLGQGEQELATDLDFSRQGRVNAMLVRRLELLGEVSKLARSLRLPEDVGYTCETAAYFWLLHVYARWEQFLAACAQNQDKPSFVKDRFPFSEFFSDTPQPIFTGESFEMDMHAAKGCFKHLSIIFQELEECRAFELLKSTVERANYLMTKQAKIVAMTCTHAALKRRDFLQLGFKFDNLLMEESAQILEIETFIPMLLQRQEDGHARLKRCILIGDHHQLPPVVKNMAFQKYSHMDQSLFTRFVRLGVPYIELNAQGRARPSIAELYNWRYRELGDLPYVREQAIFHKANAGFSFEYQLVDVPDYKGKGESAPSPWFYQNEGEAEYIVSVYIYMRLIGYPATKISILTTYNGQKLLIRDVINKRCKPWNIEPPNKVTTVDKFQGQQNDFILLSLVRTRFVGHLRDVRRLIVAMSRARLGLYVFCRRSLFEQCYELQPTFQLLLQRPDKLALNLEECTPFTERPLEETGNIHYITGTEDIDHLVKFRLEHLRQMQYMQYYAPPANELPQAVPENIADAIPSENGNAGSALNDANEHMAVEENGGATDTVIDNRMEEDGVEAKDDMTQEGNKGEGSGEGHMATEDTQGEVQASTNDKMEDADATSTDKMEEANAMPTDKMEEANATSTDKTEEANATSTDKTEEANATLTDKMEEENSDLKDKMDEE

SEQ ID NO: 20334 - DNA, 2139 bp, Sorghum bicolor
  misc_feature: Ceres ANNOT ID no. 8640902
  misc_feature: Up-regulated in root tissues in response to methyl jasmonate treatment
  misc_feature: Up-regulated in shoot tissues in response to methyl jasmonate treatment
  misc_feature: Up-regulated in shoot tissues in response to salicylic acid treatment
  misc_feature: Encodes the peptide sequence at SEQ ID NO 20335
atggcagcaaaacaccattacaccaacatcatggatcgaacatggctgatcaaattgtgcagagaaaagataacctcaaaattgcaactgatcaaaattgcgtcccacggccttgtagctattcccctagcagacacatctaaatctatattcattttggttatagctagggatgtaagaattgatcatcaagaatacagtatggaacttatccaaggggctgatagatcgaagtggatggtgacgagcaatcatagcataaagtgcttcacaacatatgaggtagaaagaatgaccaggaactatataacaactctcggaagaggtggctttggtgaagtttatgaaggagttcttgaggaccaaagtaaggtggcagtgaaaaggtttatcaacaatgagaaagtaaatttcgcaaaagagttggctgtccatcgtgaaatcaaccacagaaacgtagtgaggctcattggctactgtttagatgaaaatgcccttatgatgatcactgagtacatcactaatggaaacctgagtgatgttcttcaccaagacaacagtcctatccctttggatgtaagacttaggatcgccattgaatgtgctgaggcgttggcatacatgcattctcacatgtatactcgtgttatccatggtgacatcaagccttctaacatactcttagatgacaatttccatgcaaagttgtcagattttggaatatcaaggctagtcaacacggataaggtactgtacacggagaatgtaatagggagcataggttatatggacccattgtttgctcaggacgggcttctcacttcgaagagtgatgtttacagctttggagttgtcctccttgaactgattgctagaaaaaaggcaacaacagtaatggacaatgtcaatattgtgcgtgcatttactaatgctcttgcaaggggggtcagaggtgctagagagatgtttgacggtgaaattgcaagcaagaatagcatgaagattgttgaagggtttgcaaagatagcaggggaatgtctagcaatggaaaggaacaaacgtcctgagatgattgatgtcgtggaacgtcttcgagtactaaagaaaacttcacatcaggatctaggagaaagagcaggcctgttctcttgggctaggaagagcaaaccagtacctgcagctggtgtgaccaccgtccctgccaagattctagttttgccggcacacctgtgccgccagttctcgtttgcagagatgaaggctgcaacaaacaattttcattggcggctcattgttggcgagggtgcatttggtagagtttaccgtggcaagatcgatggaggaaaaaccaaggtggccatcaaacgtcacagcccgaactctcggcaaggtgagcatgagtttcgtactgagatagagatgtcatcaaaggtccgccactgtaatgttgcgcaactgatcggctactgcgatgagatgggcgagatgatcctcgtctacgagtatatgccacgcggttgtctgcgcaaccacttgtaccgaacaaagcagccacctctgacctggaaccggcgtctggagatctgcattggtgcagctcgcggcctgcactgccttcatgcgtcacaggtcatctaccgcaacctgaggacggaagacattctgctggatcatgcatgggtcgccaagcttacagatcttgctctctgcaagactgctggtccatcaatggacgagatcacaagagtcattggcagtggatgcctcctcgatcatgaatatgtcaccactggtcgactaactgagaaactagacgtctattcttttggtggtgttttgttgcaggtcctatgtgctcggcctatcctagacataagtcttctaaacgaagaaggtagtacattggtagactgggcattgcactgcaagcaggagtgcaggcttgatcagattgttgacccatacctgaaggggtccattgatcaatcatctctcgaaacgtttgttgggattgctgagaaatgtctcgcttccgagggcgttcgccgtccgtcgatgggagatgtgcttctagacctggagttggccctcaggcaacaggggacgactacccacggattatctccagttgtgttgtaa

SEQ ID NO: 20335 - protein, 712 aa, Sorghum bicolor
  misc_feature: Ceres ANNOT ID no. 8640902
  misc_feature: Up-regulated in root tissues in response to methyl jasmonate treatment
  misc_feature: Up-regulated in shoot tissues in response to methyl jasmonate treatment
  misc_feature: Up-regulated in shoot tissues in response to salicylic acid treatment
  misc_feature (414)..(699): SWISSPROT Homolog: EC 2.7.11.1 Non-specific serine/threonine protein kinase
  misc_feature (93)..(320): SWISSPROT Homolog: EC 2.7.10.2 Non-specific protein-tyrosine kinase
  misc_feature (100)..(364): Pfam ID: Pkinase Pfam Description: Protein kinase domain
  misc_feature (426)..(693): Pfam ID: Pkinase Pfam Description: Protein kinase domain
MAAKHHYTNIMDRTWLIKLCREKITSKLQLIKIASHGLVAIPLADTSKSIFILVIARDVRIDHQEYSMELIQGADRSKWMVTSNHSIKCFTTYEVERMTRNYITTLGRGGFGEVYEGVLEDQSKVAVKRFINNEKVNFAKELAVHREINHRNVVRLIGYCLDENALMMITEYITNGNLSDVLHQDNSPIPLDVRLRIAIECAEALAYMHSHMYTRVIHGDIKPSNILLDDNFHAKLSDFGISRLVNTDKVLYTENVIGSIGYMDPLFAQDGLLTSKSDVYSFGVVLLELIARKKATTVMDNVNIVRAFTNALARGVRGAREMFDGEIASKNSMKIVEGFAKIAGECLAMERNKRPEMIDVVERLRVLKKTSHQDLGERAGLFSWARKSKPVPAAGVTTVPAKILVLPAHLCRQFSFAEMKAATNNFHWRLIVGEGAFGRVYRGKIDGGKTKVAIKRHSPNSRQGEHEFRTEIEMSSKVRHCNVAQLIGYCDEMGEMILVYEYMPRGCLRNHLYRTKQPPLTWNRRLEICIGAARGLHCLHASQVIYRNLRTEDILLDHAWVAKLTDLALCKTAGPSMDEITRVIGSGCLLDHEYVTTGRLTEKLDVYSFGGVLLQVLCARPILDISLLNEEGSTLVDWALHCKQECRLDQIVDPYLKGSIDQSSLETFVGIAEKCLASEGVRRPSMGDVLLDLELALRQQGTTTHGLSPVVL

SEQ ID NO: 20336 - DNA, 5106 bp, Sorghum bicolor
  misc_feature: Ceres ANNOT ID no. 8640904
  misc_feature: Down-regulated in shoot tissues in response to salicylic acid treatment
  misc_feature: Encodes the peptide sequence at SEQ ID NO 20337
atggaacttatccaagaagctgatagatctaaatggatggtgcacagtaatcatagcataagatgttttacacaaggtgacatagaaagaatgagcaacaactatagaactagtctcggaagaggtgccttcggagaagtatatgaaggtgttcttgaggatggaagcatggttgcagtgaaaaggttgataggcagtgtgaaagaacagtttgctaaagagcttatcattcatcgtgaaatcaaccacaagaatgttgtgaggctcattggttactgtgtagaggaaaatgtccttgtgctggtcatggagtatattgctaatggaaatctgaatgatgttcttcacgatgacagccgtcctatcccattggatataagacttagaatcgccattgagtgtgcggaagctttggcatacatgcattctcacatgtatactcaggttatccacggtgacatcaagcctggtaacatactcttagatagcaactttcatgcaaaattgtcagactttggaatatcaagagtggtcaacacagacaaaacattgtacacaaataatgtaattgggagcataggttacatggaccctttgttttctttggatggtcgtcttactgttaagtatgatgtttatagctttggagctgtccttgttgaactgatcactaggaaaaaggcagtagttgagaacgtcaacaatgtttacgcatttagtaatgctcttacaaggggggtcagaggtgtgagagagatgttagatgttgacattgcaagaaagaataacatgaaggttcttgaaggagtcgcaaagctagcaggtgaatgcctaaggatggacagggacaaacgtcctgggatgattgttgtggcggaacgtcttcgggtgctacagaaatcttcatatcaggatcagggacggcagcgagtagatctgttctcttgggcatggaagagcattccagcacctgcagctttagtgaacatccaggctaatattctgccgtcagacatgtgccgccagttctcttttgcagagatgaagtctgcaacaaacaattttgataattcactccttgttggcaagggtggatctggtagagtttactgtggccagattaatggacgaaaaaccaatgtggctatcaagtgtatgtacaccgacaccgtagttaatgaattttatactgagattgagatgatgtcaaagcaccgacaccgtaatctagtgccactgattggttactgcattgaagaggatgcgatgatactggtctacgactacatggctagcggaagtctgcatggccacctccatggggagcagaagctgccactttcctggaagcagcgcatagagatctgcattggtgcaggtcatggtctgcgctaccttcacgaacaacagatcatttatcttaacctgaagatgaaaaatatcctgctggatgaggaatgggttgccaagattaccgatctttctctttcccggactgggacatcagtcaagacacgtgtagctggaactcatggctacatcgatcctgagtaccttataaccggtaggcctactgagaaatcagacgtctattcatttggggttgtgttattggagaccctctctgctcagcgtccttattattcaattcgtcaagatgaacaagggcatagcttgtcaagttggacattgcgatgcaaggaggaggggaatcttgatcagattgttgacccttgcctgatgggaataattaatctgtggtctcttaacaagttcgtcgaaattgctctcaaatgtgttgctcttaaaggcattgatcgtccgtcgatgggagatgtgatttcagacctggagcacgcccttcagtggcaggagagtgcagatgcaagcgaatcctcaattttgccatcacgtctgtgccgccagttctggtttgcagaaatggaggccgtgacaaactactttgataagtcactccttattgatagtggttcatttgatcgagtttaccatagccagattgatggggtggcaataaccttggtggatgttacacatgtgtacagtgtatgtgccttccatggcctgatagagattacatcgaagcttgtccatgatcatcttgtgccactgattggttattgcgatgagcaggagatgatgctcctggtctatgagtacgtggctggtggaaatctaagtgagcacctttatgggaccaggaaaccaccccttaactggattcagcgcatggagatctgcgttggtgttgctcgtggcctgtgctaccttcacggatggcagctcacccacggggcagtgaggacatcaaacatcctactggatgaggaatgtcttgctaagattaccaatctagcactgccgcccaatcttttggataaccaggcatccaaagtccatgaaactgatggttacatcgatccagaatacttgcacaccggtgtgcatactgagaaatcagatgtctattgttttggccttgtgctactcgaagtcctctttggtcgccctgttatcaagcaccaacgtcttgaggaacaaattgcgtggttgttaatccgaggagttcaacagcagacattggactaccttgatcagaatgttgacccattcctaaggggaaaaattaatccacagtttctgaagaaatttttccgtactgccgctaagtgccttgctgagaaaggcattcaccgcccatcgatgcgagatgtaatgtcagacctgcagtatgcccatttctcccttaagttgggttggatcacagatgatagcggttgcatgtcagacgatgccatggatgaggggaggagtaagtcaactttgttacacgaaaacattgggttcttgttttttcacccttgtttctgtgagcttgtgtatctgtatgtgtcccttcggcaggagactggcctcttccagagccgatgtgaggaatgtcttgctaagattaccaagccgcccaatttttttgataaccaggcgaccgaagtccgtgaaactgatggttacatcgatccagaatacttgcacaccggtctgcgtactgagaaatcagatgtctattgttttggccttgtgctactcgaagtcctctttggtcgccctgttatcaagcaccaacgtcttgaggaacaagttgcgtggttgcctactcccaggtccatccgtaacggtgcgaccttcaactgttcggtggaggaggtggacggcatggccgcgtcgccacgcttgcgcacagcttctcgaccggcccacactcgcttgggatgggagcacgtgggctgtggcgactgccaagtgatcggcggcggccgaggtgttgcgattgcggaatcctccagcaacaaagtgatggaacttatccaagaagctgatagatctaagtggatgatgcacagtaatcatagcataagatgctttactggaggtgacatagaaagaatgaccaacagctatagaacttgtcttggaagaggtgccttcggagaagtatatgaagggattcttgaggacgacagcatggttgcagtgaaaaggttgatcggaaatatgaaagaaaactttgctaaagagtttatcgtccatcgtgaaatcaaccacaagaatgtagtgaggctcattggttattgtgtagaggaaaatgcccttattttggtcatggagtatatcgctaatggaaatctgaatgatgttcttcacgatgataaccgtcccatccctttggatataagacttagaattgccattgagtgtgcggaagctttggcatacatgcattctcacatgtatactcaggttatccatggcgacatcaagcctggtaacatactcttagatagaaactttcatgcaaaattgtcggacttcggaatatcaagagtggccaacacagataagacactatacacaaagaatgtaattgggagcataggttacatggaccctttgttttctttggatggtcgtatcactgttaagtatgacgtttatagctttggagctgttctcgttgaactgatcactaggaaaaaggcagtagttgataacgtcaacaatgtttatgcatttaataatgctcttacaagtgggatccggggtgtgagagagatgttcgatgttgacattgcaagcaagaataacttgaaggttcttgaaggagttgcaaagctagcaggtgaatgcctaaggatggacagggaaaaacgtcctgagatgattgatgtggtggaacgtcttcgggtgctacagaaatcttcaaatcaggatcagcgacggcgacgtgtagatatgttctcttgggtaaggaagagcaatccagcacctcctccttcagatgtgtatcgccggttctcgtttgcagagataaaggctgcaacaaacaactttgatgaatcactccttgttgaggaaggtgaatctggtagagtttactgtggccaggttaatggacgaaaaaccaatgtggctatcaaatatctacagaacggactcaatgaattgtatgcggagataaagttcttgccaaggcaccgaatccgccatcgtcatcttgtggccatgatcggttactgcattgaagaggatgaaatgataatgatactggtgtacgactacatggctcgtggaagtctgcgtgaccacctccatgggatccagaagacgcccctttcctggaagcgccgtacagagatatgcattggtgcagctcgtggcttgcactaccttcatgaactaccgttcatccatcgtaatgtgacctcagaaaaaatcctgctggttgaggaatgggttgccaagattactgtacttccactttccaatactctgacattatcagttgagcatggaacttatggttatgccgctcctgagtacgtgaggaacagttatcttactgagaaatcagatgtctattcatttggtgttgtgttactggaggtcctctgtgctcagcctgcatggaaatgggatgagtattttccaaccgaacaattagtgttgacaaattgggcattgtgtcaagggcgttcttgcccagcgacggcggccctcggctacgtagctcgtagccttggtccgtga

SEQ ID NO: 20337 - protein, 1701 aa, Sorghum bicolor
  misc_feature: Ceres ANNOT ID no. 8640904
  misc_feature: Down-regulated in shoot tissues in response to salicylic acid treatment
  misc_feature (341)..(625): SWISSPROT Homolog: EC 2.7.11.1 Non-specific serine/threonine protein kinase
  misc_feature (39)..(224): SWISSPROT Homolog: EC 2.7.10.2 Non-specific protein-tyrosine kinase
  misc_feature (1162)..(1435): SWISSPROT Homolog: EC 2.7.12.1 Dual-specificity kinase
  misc_feature (35)..(295): Pfam ID: Pkinase Pfam Description: Protein kinase domain
  misc_feature (355)..(617): Pfam ID: Pkinase Pfam Description: Protein kinase domain
  misc_feature (1160)..(1420): Pfam ID: Pkinase Pfam Description: Protein kinase domain
  misc_feature (1470)..(1695): Pfam ID: Pkinase Pfam Description: Protein kinase domain
  misc_feature (655)..(916): Pfam ID: Pkinase_Tyr Pfam Description: Protein tyrosine kinase
MELIQEADRSKWMVHSNHSIRCFTQGDIERMSNNYRTSLGRGAFGEVYEGVLEDGSMVAVKRLIGSVKEQFAKELIIHREINHKNVVRLIGYCVEENVLVLVMEYIANGNLNDVLHDDSRPIPLDIRLRIAIECAEALAYMHSHMYTQVIHGDIKPGNILLDSNFHAKLSDFGISRVVNTDKTLYTNNVIGSIGYMDPLFSLDGRLTVKYDVYSFGAVLVELITRKKAVVENVNNVYAFSNALTRGVRGVREMLDVDIARKNNMKVLEGVAKLAGECLRMDRDKRPGMIVVAERLRVLQKSSYQDQGRQRVDLFSWAWKSIPAPAALVNIQANILPSDMCRQFSFAEMKSATNNFDNSLLVGKGGSGRVYCGQINGRKTNVAIKCMYTDTVVNEFYTEIEMMSKHRHRNLVPLIGYCIEEDAMILVYDYMASGSLHGHLHGEQKLPLSWKQRIEICIGAGHGLRYLHEQQIIYLNLKMKNILLDEEWVAKITDLSLSRTGTSVKTRVAGTHGYIDPEYLITGRPTEKSDVYSFGVVLLETLSAQRPYYSIRQDEQGHSLSSWTLRCKEEGNLDQIVDPCLMGIINLWSLNKFVEIALKCVALKGIDRPSMGDVISDLEHALQWQESADASESSILPSRLCRQFWFAEMEAVTNYFDKSLLIDSGSFDRVYHSQIDGVAITLVDVTHVYSVCAFHGLIEITSKLVHDHLVPLIGYCDEQEMMLLVYEYVAGGNLSEHLYGTRKPPLNWIQRMEICVGVARGLCYLHGWQLTHGAVRTSNILLDEECLAKITNLALPPNLLDNQASKVHETDGYIDPEYLHTGVHTEKSDVYCFGLVLLEVLFGRPVIKHQRLEEQIAWLLIRGVQQQTLDYLDQNVDPFLRGKINPQFLKKFFRTAAKCLAEKGIHRPSMRDVMSDLQYAHFSLKLGWITDDSGCMSDDAMDEGRSKSTLLHENIGFLFFHPCFCELVYLYVSLRQETGLFQSRCEECLAKITKPPNFFDNQATEVRETDGYIDPEYLHTGLRTEKSDVYCFGLVLLEVLFGRPVIKHQRLEEQVAWLPTPRSIRNGATFNCSVEEVDGMAASPRLRTASRPAHTRLGWEHVGCGDCQVIGGGRGVAIAESSSNKVMELIQEADRSKWMMHSNHSIRCFTGGDIERMTNSYRTCLGRGAFGEVYEGILEDDSMVAVKRLIGNMKENFAKEFIVHREINHKNVVRLIGYCVEENALILVMEYIANGNLNDVLHDDNRPIPLDIRLRIAIECAEALAYMHSHMYTQVIHGDIKPGNILLDRNFHAKLSDFGISRVANTDKTLYTKNVIGSIGYMDPLFSLDGRITVKYDVYSFGAVLVELITRKKAVVDNVNNVYAFNNALTSGIRGVREMFDVDIASKNNLKVLEGVAKLAGECLRMDREKRPEMIDVVERLRVLQKSSNQDQRRRRVDMFSWVRKSNPAPPPSDVYRRFSFAEIKAATNNFDESLLVEEGESGRVYCGQVNGRKTNVAIKYLQNGLNELYAEIKFLPRHRIRHRHLVAMIGYCIEEDEMIMILVYDYMARGSLRDHLHGIQKTPLSWKRRTEICIGAARGLHYLHELPFIHRNVTSEKILLVEEWVAKITVLPLSNTLTLSVEHGTYGYAAPEYVRNSYLTEKSDVYSFGVVLLEVLCAQPAWKWDEYFPTEQLVLTNWALCQGRSCPATAALGYVARSLGP

SEQ ID NO: 20338 - DNA, 1605 bp, Sorghum bicolor
  misc_feature: Ceres ANNOT ID no. 8640977
  misc_feature: Up-regulated in root tissues in response to salicylic acid treatment
  misc_feature: Encodes the peptide sequence at SEQ ID NO 20339
atggtggtggccgtggccttgcagctggcggcgctcctggcgctgctgctcgcgctgtggcgtctggcgtggcggccgcacgccgtggcgcggtcgttcgcgaggcagggcgtcggtggcccgccctacacgttcctggcagggtccttgccggaggcgaagcggctgctgatggccggccggagaggcgtgccgcccctcgacgccgcctgccacgacatcatgcccgtcctcctgccgcagttccacagatgggtcgcagactatgggagaacgtttctgttctggatcgggccgattcccgctctcttgtctacggatctacagctgattaagcaagtgctgacagacaggacgggcctgtatcagaaggacttcatgatccccgtgctcaagttcctcttcggcaacggtgtcatactgataaacggagacgattggaagcggcaccgtaaagtggttcttcctgcgttcaaccatgagacgatcaagagcatgtcggcggtgacggcagaggtaacgaagcagatgatgcggcaatggcgggagcagattattattcagggaagcggcgacaaggaatcggccgagatagacatgatccacgccttcaacgacctgaccgcaaaggtcaacggccgcgtcgccttcggcacgagccaccgggatgtcgaggaggtcatcgtcttgatgcgggagatgcagaagctcgccactgccgccacgctggatgctccaatactctggtatctgccaactcggcggaacctgcaagtccgacgtctgaacaaacagctgagaagcaagatcatatccatcatgcaggcgcggctggccgccgacggagctaagaagtgtggtgggcgcggcggcgccggcgggggcgacctactcgggctgttgctagaggcgtggacgccgcagcagcagcagcagcatggcaacaacggcgagacgctgacaaccgacgaggtgatcgacgagtgcaagaccttcttcgccgcggggcaggaaaccacggccacgctcctgacctgggccatgttcctgctcgccgtgcacccggagtggcagcacaaagtcagggaggaggtcgtccgggaattctcctgcaccagcgacggcgacggcgacgaggtcccccacgccgatgttctcgccaagctcaagctgctatacatggtgttgctggagacatcgcgcctgtaccctcccatcgtgtacatacagcggagggctgcatcggacgccgtccttggaggcatcaaggtgccccagggcacggtcatctcgatccccatcgccatgctgcaccgggacaagcaggtctggggcctcgacgccgacgagttcaaccccatgaggttcgagcatggcctcacaaaggccgccaaggatcccaaggcgctgctggctttctccctggggccgagagtgtgcactggccagagcttcggcatcgtggaagtacaggttgtcatggcgatgatcctcaggaggttctccttctccctctccccagagtatgttcacaagcccaagtatctcctgtccttgacacccaagcttgggatgcctctcatcgtcaggattgtggacggctga

SEQ ID NO: 20339 - protein, 534 aa, Sorghum bicolor
  misc_feature: Ceres ANNOT ID no. 8640977
  misc_feature: Up-regulated in root tissues in response to salicylic acid treatment
  misc_feature (72)..(530): SWISSPROT Homolog: EC 1.3.3.9 Secologanin synthase
  misc_feature (58)..(528): Pfam ID: p450 Pfam Description: Cytochrome P450
MVVAVALQLAALLALLLALWRLAWRPHAVARSFARQGVGGPPYTFLAGSLPEAKRLLMAGRRGVPPLDAACHDIMPVLLPQFHRWVADYGRTFLFWIGPIPALLSTDLQLIKQVLTDRTGLYQKDFMIPVLKFLFGNGVILINGDDWKRHRKVVLPAFNHETIKSMSAVTAEVTKQMMRQWREQIIIQGSGDKESAEIDMIHAFNDLTAKVNGRVAFGTSHRDVEEVIVLMREMQKLATAATLDAPILWYLPTRRNLQVRRLNKQLRSKIISIMQARLAADGAKKCGGRGGAGGGDLLGLLLEAWTPQQQQQHGNNGETLTTDEVIDECKTFFAAGQETTATLLTWAMFLLAVHPEWQHKVREEVVREFSCTSDGDGDEVPHADVLAKLKLLYMVLLETSRLYPPIVYIQRRAASDAVLGGIKVPQGTVISIPIAMLHRDKQVWGLDADEFNPMRFEHGLTKAAKDPKALLAFSLGPRVCTGQSFGIVEVQVVMAMILRRFSFSLSPEYVHKPKYLLSLTPKLGMPLIVRIVDG

SEQ ID NO: 20340 - DNA, 2892 bp, Sorghum bicolor
  misc_feature: Ceres ANNOT ID no. 8640972
  misc_feature: Down-regulated in root tissues in response to salicylic acid treatment
  misc_feature: Encodes the peptide sequence at SEQ ID NO 20341
atgggcaacagcacgtcccgggtcgtcggctgcttcgcgccgcccgacaaggccggcggcggcgtcgacctcgacttcctcgagccgctcgacgaagggctcggccactctttctgctacgtccgcccgggcgccgtcgccgactcgcccgcgatcacgccctccaactccgagcgctacacgctcgattccagcgtcatggactcggagacccgcagcggctccttccgccacgagcccgccgccgccgacgacctggccgccgccgccgccgggctgcagcgcccctgcaggagcttcggcgagaccaccttccggaccatctcgggggcctccgtcagcgccaacgcgtcctccgcaaggacgggcaacctcaccgtctccctcctcgccggtgacgtgcaggagcccgccgccgcgttcgagagcaccgcctccttcgctgccgtgcccttgcagccggtgccgcgggggtcggggccgctcaacaccttcctgtcgggcccgctggagaggggattcgcgtccggcccgctcgacaaaggctccggcttcatgtctgggccattggacaagggagccttcatgtcaggtcccatcgacggtggcagcagaagcaacttctcggcacctctttcctatggccggaggaaggctcgtctggggctgcttgtacataggattagcagacccatgaaaaccgcattgtcaagaactttcagcaggagctcacacaatccaggctgggttcagaagtttctgatgcatcctatggctcaactgccctgggcaagggacgcaaagtccagatcagaaggctcgcagaatgggttggaacctgggatacctgaacccgagtataatgtgaccaggaaccttcagtgggctcatggaaaggcaggggaagatagggttcatgttgttctatccgaagagcaaggatggctgttcattggaatctatgatggttttagcggccctgatgcacctgactttctaatgagcaatctatacaaggccattgataaagaactggaaggactgctctgggtttacgaagacagctctgaaaggtgtgaccatgtatctaatcttgaagagggtgaatcagcttctgcttctgtggatgctcctcatgatgataatggccagttccagagtgacaatgggaaacaagaacagcttggtaattttggaaaacaaaatgtctcacctggaaagggttgtgatgaaagtgtcttgcaagttcaaccaaactgtaccagctgtgaagagaaagatttggctgcacaggattcaagtagtcagaagttgggcagggatgagatagttgaggaaatggctggagctgatctgggaaatgatctccaaagtagagaatctcacaactcgaacagcggtctttctggtacagatctaaacaccagctgtacctgtgcaacagaaaccagtgcctattgtgatcaacatgccaagttcttgaaagaaaacagaaagagcaagcgtcttttcgagcttcttgagatggaattgctacaagattataacaaaaggttatctaaggcgtcactagaggaaaggaaaataccgagcttgcatgttgcacaggcaggcactgcagaagggagctcaagaaacgcagctgagatctccaggtgttcattggcagcaactggagaatgtttcgatgattctgaagatcttggaagttcaagacatgctgatagtgtacttggcacagatcttaaagagtgtacagggtgttcaatatctacatcttcatcagagcacaagcaagttacgagaagatttgtattcggatcaaagttgaggaagatgtacaaaaagcaaaaaatgttgcagaagaagtttttcccatggaactatgattggcacagagatcagcctcatgttgatgaaagtgttataaaatcttcagaagtgactaggagatgtaagtcaggaccagtagagcatgatgctgtattgagggcaatgtcacgggcacttgaaacaacagaggaagcgtacatggaaattgtggagaaggagcttgatagacatccagagcttgcattaatgggttcgtgtgtccttgtaatgttgatgaaggaccaggatgtatatgtcatgaatcttggggatagccgagctatcttggcgcaggacaatgatcagtacaatagctcaagtttcttgaaaggagatttaagacatcgaaacaggtcaagggagtcacttgtccgtgtcgaacttgataggatatcggaagagtcgccgatgcataatcctaacagccacctgaacagcaatacaaaagctaaggaactctcaatatgtagattaaaaatgagagcggtccaactgtcaactgaccatagcacgagtattgaggaggaagtcttgaggattaaagtagaacatcctgatgatccccaagctgtctttaatgatagagtgaagggacagctgaaggttactagagcatttggtgctggttttctaaagaagccaaaatttaacgaggcactacttgagatgttccgcattgactatgttggaacatcaccatatatcagctgcaaccctgctgtacttcaccatcgactctgcgcaaatgatcggtttcttgtactgtcgtcagatggattgtatcaatatttcagcaatgatgaggtagtttcgcatgtgttatggttcatggagaatgtaccagagggagacccagcgcaataccttgtagctgaacttctttgtcgtgcagccaagaagaatggaatgaattttcacgagttactggatatcccccagggtgatcgtcggaaataccatgatgatgtttctgttatggtaatctcacttgaaggaagaatttggcgatcttctggatga

SEQ ID NO: 20341 - protein, 963 aa, Sorghum bicolor
  misc_feature: Ceres ANNOT ID no. 8640972
  misc_feature: Down-regulated in root tissues in response to salicylic acid treatment
  misc_feature (625)..(963): SWISSPROT Homolog: EC 3.1.3.16 Phosphoprotein phosphatase
  misc_feature (605)..(926): Pfam ID: PP2C Pfam Description: Protein phosphatase 2C
MGNSTSRVVGCFAPPDKAGGGVDLDFLEPLDEGLGHSFCYVRPGAVADSPAITPSNSERYTLDSSVMDSETRSGSFRHEPAAADDLAAAAAGLQRPCRSFGETTFRTISGASVSANASSARTGNLTVSLLAGDVQEPAAAFESTASFAAVPLQPVPRGSGPLNTFLSGPLERGFASGPLDKGSGFMSGPLDKGAFMSGPIDGGSRSNFSAPLSYGRRKARLGLLVHRISRPMKTALSRTFSRSSHNPGWVQKFLMHPMAQLPWARDAKSRSEGSQNGLEPGIPEPEYNVTRNLQWAHGKAGEDRVHVVLSEEQGWLFIGIYDGFSGPDAPDFLMSNLYKAIDKELEGLLWVYEDSSERCDHVSNLEEGESASASVDAPHDDNGQFQSDNGKQEQLGNFGKQNVSPGKGCDESVLQVQPNCTSCEEKDLAAQDSSSQKLGRDEIVEEMAGADLGNDLQSRESHNSNSGLSGTDLNTSCTCATETSAYCDQHAKFLKENRKSKRLFELLEMELLQDYNKRLSKASLEERKIPSLHVAQAGTAEGSSRNAAEISRCSLAATGECFDDSEDLGSSRHADSVLGTDLKECTGCSISTSSSEHKQVTRRFVFGSKLRKMYKKQKMLQKKFFPWNYDWHRDQPHVDESVIKSSEVTRRCKSGPVEHDAVLRAMSRALETTEEAYMEIVEKELDRHPELALMGSCVLVMLMKDQDVYVMNLGDSRAILAQDNDQYNSSSFLKGDLRHRNRSRESLVRVELDRISEESPMHNPNSHLNSNTKAKELSICRLKMRAVQLSTDHSTSIEEEVLRIKVEHPDDPQAVFNDRVKGQLKVTRAFGAGFLKKPKFNEALLEMFRIDYVGTSPYISCNPAVLHHRLCANDRFLVLSSDGLYQYFSNDEVVSHVLWFMENVPEGDPAQYLVAELLCRAAKKNGMNFHELLDIPQGDRRKYHDDVSVMVISLEGRIWRSSG

SEQ ID NO: 20342 - DNA, 1629 bp, Sorghum bicolor
  misc_feature: Ceres ANNOT ID no. 8640985
  misc_feature: Up-regulated in shoot tissues in response to salicylic acid treatment
  misc_feature: Up-regulated in root tissues in response to salicylic acid treatment
  misc_feature: Encodes the peptide sequence at SEQ ID NO 20343
atggagtggtgtgccctatccacgccgccgtgccctatcgacgacgtgttctgcagctcctcccctcccgttccaacttccaaggcctcacttctccccacagcgcgcgaggcgatcaaaccgtcaccgtccgcggcccggccatggcgtcgtccgtgctgctggtggcctcggcgacggcgctcctggcgctgggactacgccgtggtgcgcctcctgtggcggccccgcgccgtggccggcatgttcagggcgcagggggtccgcgggccgccctacaggtttctcaggggcaacaaccacgacgtcaggaggatgagggcggagggcgatgcgcttcggctggacgtccgcgaccacaactatctccccagggtgatgcctcacttcctcacctggaagcaacagtacggagggcccttcctgtactggttcggtccacagccccgaatctgcctcctcgattacgagtcggtaaggcaggttctttttaacaagtcaggccatttcttcaagatcgatgcgcacccgactatcctggcattgctcggcaaagggctggttttggtggaaggcaccgactgggtacggcaccggagggtagtcaacccagctttcgctatggacaagctcaagacgatgacgacgacgatggtcagctgtgctgagccattgatcaaggagtgggaacgactggcatccagcaatgaaagcagggaagtggaagtggaattcagcaaactgtttcaggacttgacggcagacattatatcacatactggttttggaagcagttataagcagggcaaagaggttttccatacgcagaggcagctcctggcactcgccgtggcaactctcctcaacgtgcaactaccaggactcaagcaaccccggttggcatccaatggaggtggatatggagacgatctgctcggtctcatgcttgaggcttgcctcacaacagaacaaggagagaaaggagatgagttgaccctgaccctgaccatggatgagatcatagacgagtgcaagacgttcttctttgccggccatgagaccacatcccgtttgcttacctggacaatgttcttgctcagtgtgtatccagaatggcaggaacggctaagagaggaggtcctgagagaacgtggaaaggaaaatcctactgcagacatgcttaacaaatttaaagagatgacgatggtgctccttgagacactgagactgtatactcctgttatggtcatgctaagaaagcctatctccgatataagattgggaagcctcagcatacctaaaggcaatggaattgccatacctattccatttctccaccgagacaaagaggtttggggtgacaatgccaatgattttgatccactgaggtttgagaatgggatcacaaatgcagcaaagaccccacaggctcttctgtcattctcaataggaccaagatcatgcatcggtcagaacttcgcaatgttagaagcaaagtcagtaatggccatgatcctgaagaaattctccttcacactttcctcaagttatgtgcatgcacctgcagatcatataacgcttcagcctaagttcggtcttcccatagttttgaggccactggatgtatga

SEQ ID NO: 20343 - protein, 542 aa, Sorghum bicolor
  misc_feature: Ceres ANNOT ID no. 8640985
  misc_feature: Up-regulated in shoot tissues in response to salicylic acid treatment
  misc_feature: Up-regulated in root tissues in response to salicylic acid treatment
  misc_feature (323)..(541): SWISSPROT Homolog: EC 1.3.3.9 Secologanin synthase
  misc_feature (88)..(536): Pfam ID: p450 Pfam Description: Cytochrome P450
MEWCALSTPPCPIDDVFCSSSPPVPTSKASLLPTAREAIKPSPSAARPWRRPCCWWPRRRRSWRWDYAVVRLLWRPRAVAGMFRAQGVRGPPYRFLRGNNHDVRRMRAEGDALRLDVRDHNYLPRVMPHFLTWKQQYGGPFLYWFGPQPRICLLDYESVRQVLFNKSGHFFKIDAHPTILALLGKGLVLVEGTDWVRHRRVVNPAFAMDKLKTMTTTMVSCAEPLIKEWERLASSNESREVEVEFSKLFQDLTADIISHTGFGSSYKQGKEVFHTQRQLLALAVATLLNVQLPGLKQPRLASNGGGYGDDLLGLMLEACLTTEQGEKGDELTLTLTMDEIIDECKTFFFAGHETTSRLLTWTMFLLSVYPEWQERLREEVLRERGKENPTADMLNKFKEMTMVLLETLRLYTPVMVMLRKPISDIRLGSLSIPKGNGIAIPIPFLHRDKEVWGDNANDFDPLRFENGITNAAKTPQALLSFSIGPRSCIGQNFAMLEAKSVMAMILKKFSFTLSSSYVHAPADHITLQPKFGLPIVLRPLDV

SEQ ID NO: 20344 - DNA, 3975 bp, Sorghum bicolor
  misc_feature: Ceres ANNOT ID no. 8641186
  misc_feature: Up-regulated in shoot tissues in response to methyl jasmonate treatment
  misc_feature: Encodes the peptide sequence at SEQ ID NO 20345
atgcagtcgctgcgaggagcgcggcgggagggcgcgggttcctgttcctcccggggcggcagggtggcgggcgagaccgaggagctggaggagggggaggcccgctccgacgacgacggcgaggccttcgtcgaccccaacgtcgacctctcctacattgtgagtacccccgcctcccaagcctggcgccctcctccctcgttaattcagcggcgggcttcctgtgctgctgaattcggtgcgggagggggggcaattcacttcgtgagcgctctgaggtccgcacatttcagcgtcctagtactcggggatgaaaaacttcaacatgttctaggacattttcagaaggaattcgaaggagaagtttctgtagagaaccttgggtcgaaatttggtggatatggttcatttttacccacatatcagcggtctcccctgttcactcaatccgaaagcccacacattgcagcgaacattagcacgtcaggatcaccttaccaaccatctgctgagagaatggatcaaaacccgtctactgtagctgtggagcccatttcccgaactaacggttctggagcaccttcagctagtgatttactcaagaaaaaatgcccaagcacagacattgaggaatcggttgcaggttctgattctttgtacagttcatctagtagtggtgactcaaagtcagtcaaacttcagaccaaagtttgtctcaataatgatctgccgagagaaaatgcagttatctatagtggcctgggccttgagatttcttcaccttcatccatggaggagagtcctgatgggcttgggggactatctcctgatgtgccatatgaatcacctcggactatcctacaggtcatgacatactttccagttcctggaggcttcttgttgtcacctctacatggtaatttgcttcaattaagaaataataaagttgctccagagctaaagaattgggaaacacatttagatatggaaaatgtatctagagcgttggaaggacgttcacagtcttctcatccacctggacctatcagaggcaatgtggctaagcagatgaagccttgcagtaagaaaaaggtgtccatggatacaaagactagaaaatacaaaggtgatgctagtgcaatcatgaacaaggaagttaacatccaagtgcctgccagccaaaaagagaagatgatgaatacaaataacgagaatgggtttgaagttggttctgcaaggaaggagatcccagccagtgtaaagcacggacagttgtatatgcagccgaccagcagtgtagcaactatgaatgcagatcctgttgctgcaccagttgtgatcgaggaacactgggtgcgctgtgacatatgccagaaattgcgtcttctaccctatggaacaaacccttctatgcttccaaataagtggaaatgtaccatgcttcactggctgcctgggatgaataggtgtgacatcagtgaggatgagacaacagaggctctgaatgcattgtttgccattccagcgactgctgcaactttttcttcgggtggtcctcatactgcaggtgcaggtacaggtacagcaacatccagtgcctataatataagtggacagtttgagaggagtaggaaaaggaaaaatgctccaagcaatggaaaagatctggctgggagttcttaccgcacaccattgttgactccttccatgagcaaccaacaggaccctatcagagatgaaagaactactgatgacatgcactacagttccaagacagattctgtgagcaaacatggtcccaggccagtgagtaaatcagctgatcttgtttctgaaaagctgaagcctaagcacaggaatcacagtagctactcagatgaaggaggtattatggaaaggaacaaggctcatccaaaggtaaagactaaaatagggattgatcaagatgaacagaaaacatataagagaactaaaatggaggattggcatcaaattgacagaggccaggaccacaagtgtgattcagatggtatggaagttcctgatgaacccaaagctttgcttgcaaaggcaaaaacaatgaagggttcaaatgaaactggtgacatttctttacgcaaggaagatattgcttcagggtgtgattcattggaaaacatcaagaatgttaattcttttggtataccctttcacagtgagaagaaagaacatccttctgatgtagacatattagatttgtcttgcaagaagaatgtagtgaagaaattggaggagattcagcttaactctttacatcgtataagcaacaggtccaagaagaacttgaaggaaaagaagtctaatacatttaagtctaaagagatggcatccaaggcagatagtagacatggaaaagttctgcatgcggatgttgtgttgtcttctgtggggcacctaaattatgaactaggtgctgacaagtttgttactgggaaagaaagtcctgccaagcaagctttggacttgactgaagcccctggaaggtatgtatcctatctgcagtcttctacagctgtgacctcaagctcttctaagatttcaagctccagaagaaacacaaactcacaagaagcaaaggactctccagttaaatcagcctcttcatcgccaccgagaaattttaacattaaaatgatttccagtaccagaaaagatggaatagtggatggttccttgggcaacacacacaacttagtaaggtaccaaaacagtgaagtcattgcattaaataatggtcagaaaactgaaaactttgagggggttcaggttgcaggtagaggagaccaccaactgtgttctggtgataagaaggacttcgatatggagggccgttcacagcatccttttgacagaagggctacaactttgaacactgagtcttgtcccattcagcatggaagtaagaacattgaaattcgccaaggtagtggaactgctcagcggatgggcatgtcatttgaaaaagaaaaatctcaccttagaatcgataatcaagatattcagaaccctgttaatgaagttgtcaattttcctttgaaagaaggtaaacaaaaggtctaccctacttcagtaaaatctgattcattgaaaatgaaagcaaagttagtgaggttcaatgttgaaactggagtgcaacatggcactgttaagcaagcgacttcaaatactttgaagacaagtccaatgaggaaggatggtagtatgattacatttgctctcaaggaagctagagatctaaagcataaggcgaatgatttgaagaataaaggacaagaacttgaaagtacaggtctgtactttgaggcggctttgaaatttctgcatgtcgcttttcttctagaaacacctagttttgacatttcaagaccaggtgatggagctaagtcaatgaagatgtactctgaaactgcaaaattatgcaatttttgtgctcatgaatatgaacggtgcaaaaaaatggctgctgctgctttagcgtataagtgtgtagaagttgcttacctcaaggctgcatactacaaacaccgtagtgcaagcaaagatcaacaggaactgcaggcagctgtacagatagcccgaggtgaatcaccatcatctgctaccccagatattgataatttaaatagccatggattatcaaaggcctcttcattgaagggtggcaattcaccccatgtgccaggcaatcatttgcatctagctgttcacaaccaagctcacttgttgagattactttcctacacaaatgatgtgaacttggcattcaatgcaactcaaaaggcagagtttgtgattgcatctgctgctgggagtaaggaaaggggtggtgttgatgatggccttgctttggtaaaaacggtcttggatcttaacttcaacaatgtgaatgaactagtaagacttgttcgggtttcaatggaatcaataagcagctga

SEQ ID NO: 20345 - protein, 1324 aa, Sorghum bicolor
  misc_feature: Ceres ANNOT ID no. 8641186
  misc_feature: Up-regulated in shoot tissues in response to methyl jasmonate treatment
  misc_feature (449)..(497): Pfam ID: zf-CW Pfam Description: CW-type Zinc Finger
MQSLRGARREGAGSCSSRGGRVAGETEELEEGEARSDDDGEAFVDPNVDLSYIVSTPASQAWRPPPSLIQRRASCAAEFGAGGGAIHFVSALRSAHFSVLVLGDEKLQHVLGHFQKEFEGEVSVENLGSKFGGYGSFLPTYQRSPLFTQSESPHIAANISTSGSPYQPSAERMDQNPSTVAVEPISRTNGSGAPSASDLLKKKCPSTDIEESVAGSDSLYSSSSSGDSKSVKLQTKVCLNNDLPRENAVIYSGLGLEISSPSSMEESPDGLGGLSPDVPYESPRTILQVMTYFPVPGGFLLSPLHGNLLQLRNNKVAPELKNWETHLDMENVSRALEGRSQSSHPPGPIRGNVAKQMKPCSKKKVSMDTKTRKYKGDASAIMNKEVNIQVPASQKEKMMNTNNENGFEVGSARKEIPASVKHGQLYMQPTSSVATMNADPVAAPVVIEEHWVRCDICQKLRLLPYGTNPSMLPNKWKCTMLHWLPGMNRCDISEDETTEALNALFAIPATAATFSSGGPHTAGAGTGTATSSAYNISGQFERSRKRKNAPSNGKDLAGSSYRTPLLTPSMSNQQDPIRDERTTDDMHYSSKTDSVSKHGPRPVSKSADLVSEKLKPKHRNHSSYSDEGGIMERNKAHPKVKTKIGIDQDEQKTYKRTKMEDWHQIDRGQDHKCDSDGMEVPDEPKALLAKAKTMKGSNETGDISLRKEDIASGCDSLENIKNVNSFGIPFHSEKKEHPSDVDILDLSCKKNVVKKLEEIQLNSLHRISNRSKKNLKEKKSNTFKSKEMASKADSRHGKVLHADVVLSSVGHLNYELGADKFVTGKESPAKQALDLTEAPGRYVSYLQSSTAVTSSSSKISSSRRNTNSQEAKDSPVKSASSSPPRNFNIKMISSTRKDGIVDGSLGNTHNLVRYQNSEVIALNNGQKTENFEGVQVAGRGDHQLCSGDKKDFDMEGRSQHPFDRRATTLNTESCPIQHGSKNIEIRQGSGTAQRMGMSFEKEKSHLRIDNQDIQNPVNEVVNFPLKEGKQKVYPTSVKSDSLKMKAKLVRFNVETGVQHGTVKQATSNTLKTSPMRKDGSMITFALKEARDLKHKANDLKNKGQELESTGLYFEAALKFLHVAFLLETPSFDISRPGDGAKSMKMYSETAKLCNFCAHEYERCKKMAAAALAYKCVEVAYLKAAYYKHRSASKDQQELQAAVQIARGESPSSATPDIDNLNSHGLSKASSLKGGNSPHVPGNHLHLAVHNQAHLLRLLSYTNDVNLAFNATQKAEFVIASAAGSKERGGVDDGLALVKTVLDLNFNNVNELVRLVRVSMESISS

SEQ ID NO: 20346 - DNA, 3135 bp, Sorghum bicolor
  misc_feature: Ceres ANNOT ID no. 8641213
  misc_feature: Up-regulated in shoot tissues in response to salicylic acid treatment
  misc_feature: Encodes the peptide sequence at SEQ ID NO 20347
atggcgaaggttgggtgcgcggaggcggataccgtgaagccatcggtggcgccggcagcagccggcgccgttgtgggtctgcccaacacggctgggctgcaggcgctgaccggcgccatggacaagctggaggccctcttgaggtccaaggaggctcagtccaatcaggcagggcataaacggggcactaataatgataaagatgtatccgcgataaagagagccatggatttgtccgaggatttatcggcgaagataaagaaaaccaaggataaggtggctgggatattgaataagccacaggctgcaggcaccagcaagcgtcaggagccctggtgcagactaatttcacaatattccatgcaccctaccctttctatttatggtgcgcttttcactattggtcatggagcgcatcatgatttcagactgggcgagtcatccactgcctcacctgtttgtagactgaagcaggctaagcgaggtgcactccttgaagtctttgaatccaaagttgttcgtgtaaatgggaaatctttggacaaggctgccaaggttaccttgaatggaggagatgaaattatattccgttcaccaatatttgagcaacttcatcaggagaaatctagcactccagtgttatcctccacttgcagtgtacagcaggggcaacgctcacatttcaaagatattcaggatcttttgtcatcaaaagggcgcaaagtctcaaccttttactttggaagaggtccatcagcagacccacttatgcttaattcatgtaaaactatggagggtcgatgccagtttagctctgaagataatatttcatctggtcggtgtcagctagtaaaggaggatttgatcaatgcaacggttgatgcgagtgacatctctgagtcatttgatagttgcccatattatctaagtgagcataccaaatgtgctctcatgtcatcagcatatgtacatttacactgcaagaactacttcaagtttacaaaagatatatcttctcttagtcaacgagtgctgctatctggcccaacaggaactgatatctatcaagaatatctggtgaaggcacttgcaaagtattttggtgctagattgctcactgtagattcttccatgctgtttggtgggcaaacttccaaggagtcagagtcctacaaaaagggtgatagagtgaggtatattggttcattacagtcgacaggcattatccttgatggacagagccctccagattttggttcacagggtgaaatatttcttccttttgaagaaaatagatcatcgaaggttggtgtaaggtttgataaaaaaattctgggaggaaatgatcttggaggcaattgtgaagttgatcatggtttgttctgtccagttgattcattatgccccgacattccaggatgggaggttacatccaaacatccctttgatgtgatagttgagttcatctctgaagaaattcggcaaggtcctttaatcctttttcttaaggacacagagaaaatttgtgggaataatgattcctatcatggtctgaagagcaagttaaaacattttccagctggtgcttttataattggatctcaaatccagcctgacaatcgcaaagagaaggcaaatggtagttctccttttctttcgaagttcccgtacagccaagctatacttgacctcgcattacaggacattgatgggggaaatgataataataaagaaacttcaaaagcaatgaagcatttgatcaaacttttcccgaataaagtgacactcgaggcaccacaagatgaaacggagctttcgcggtggaaccagatgttaaaccgagatattgaagtccttaaaggaaatgcaaacatttcaaaattacgctcttttctaacaagggttggtctggaatgcactgaccttgaggcaatattggtcaaggatcgcattcttacaaatgagtgcattgataaaattattggttttgctttgagccatcaacttaagaactgtacaaatccagacccctctttgagcagtgtgcagtttgctctatccagtgaaagccttaagcatggtgttgacatgttggaaagtatccagtctggctcgaagagtagcaccaaaaggaaatcactgaaggatattgttacggaaaacgaatttgaaaagaggcttcttgctgatgttatccctccacatgaaattggtgttacctttgaggacattggagctttagaaagtgtcaaagatactctgaaggagttagtgatgcttcctttgcaaagacctgaacttttcaaccgaggacaacttatgaagccatgtaaaggaattttactttttggcccacctggtacgggaaagacaatgcttgctaaggctgtggcaactgaggctggtgctaatttcataaacatatcaatgtcaagcatctcttcgaagtggcttggtgaaggagaaaaatttgtgaaagctgtgttttcgctggcaagtaaaattgctccaagtgtaatttttgtggacgaggttgatggcatgctgggaaggcgggagaaccctggagaacatgaagccatgcgtaagatgaaaaatgagtttatggtgaactgggatggtctaagaaccaaggagaaagaacgtgtattagtacttgctgcaactaacaggccatttgatcttgatgaggctgttgttaggcggcttccaaggaggttgatggtgaatttgccagatgcatcaaataggagaaaaattcttagtgtaatactagccaaggaagatttggcagatgacgttgatctagaagctatagctaacttgacagaagggtactctggtagtgatctcaagaacctgtgtgttactgctgctcatcgtcctattagggagattcttgaaaaggagaagaaggagagagcttcagcagaagcagaaaatagatcgttgcctctgtcacacactagcaatgatgtccgcgcattaagattaggtgatttcatacatgcacacgaacaggtgtgtgcaagtgtttcctcagattccagtaacatgaacgagcttgtgcaatggaatgatctctatggagaaggcgggtcgaggaaaaagacaacgctaagctacttcatgtag

SEQ ID NO: 20347 - protein, 1044 aa, Sorghum bicolor
  misc_feature: Ceres ANNOT ID no. 8641213
  misc_feature: Up-regulated in shoot tissues in response to salicylic acid treatment
  misc_feature (699)..(1030): SWISSPROT Homolog: EC 3.6.4.3 Microtubule-severing ATPase
  misc_feature (779)..(964): Pfam ID: AAA Pfam Description: ATPase family associated with various cellular activities (AAA)
MAKVGCAEADTVKPSVAPAAAGAVVGLPNTAGLQALTGAMDKLEALLRSKEAQSNQAGHKRGTNNDKDVSAIKRAMDLSEDLSAKIKKTKDKVAGILNKPQAAGTSKRQEPWCRLISQYSMHPTLSIYGALFTIGHGAHHDFRLGESSTASPVCRLKQAKRGALLEVFESKVVRVNGKSLDKAAKVTLNGGDEIIFRSPIFEQLHQEKSSTPVLSSTCSVQQGQRSHFKDIQDLLSSKGRKVSTFYFGRGPSADPLMLNSCKTMEGRCQFSSEDNISSGRCQLVKEDLINATVDASDISESFDSCPYYLSEHTKCALMSSAYVHLHCKNYFKFTKDISSLSQRVLLSGPTGTDIYQEYLVKALAKYFGARLLTVDSSMLFGGQTSKESESYKKGDRVRYIGSLQSTGIILDGQSPPDFGSQGEIFLPFEENRSSKVGVRFDKKILGGNDLGGNCEVDHGLFCPVDSLCPDIPGWEVTSKHPFDVIVEFISEEIRQGPLILFLKDTEKICGNNDSYHGLKSKLKHFPAGAFIIGSQIQPDNRKEKANGSSPFLSKFPYSQAILDLALQDIDGGNDNNKETSKAMKHLIKLFPNKVTLEAPQDETELSRWNQMLNRDIEVLKGNANISKLRSFLTRVGLECTDLEAILVKDRILTNECIDKIIGFALSHQLKNCTNPDPSLSSVQFALSSESLKHGVDMLESIQSGSKSSTKRKSLKDIVTENEFEKRLLADVIPPHEIGVTFEDIGALESVKDTLKELVMLPLQRPELFNRGQLMKPCKGILLFGPPGTGKTMLAKAVATEAGANFINISMSSISSKWLGEGEKFVKAVFSLASKIAPSVIFVDEVDGMLGRRENPGEHEAMRKMKNEFMVNWDGLRTKEKERVLVLAATNRPFDLDEAVVRRLPRRLMVNLPDASNRRKILSVILAKEDLADDVDLEAIANLTEGYSGSDLKNLCVTAAHRPIREILEKEKKERASAEAENRSLPLSHTSNDVRALRLGDFIHAHEQVCASVSSDSSNMNELVQWNDLYGEGGSRKKTTLSYFM

SEQ ID NO: 20348 - DNA, 2574 bp, Sorghum bicolor
  misc_feature: Ceres ANNOT ID no. 8641247
  misc_feature: Up-regulated in root tissues in response to methyl jasmonate treatment
  misc_feature: Encodes the peptide sequence at SEQ ID NO 20349
atgccgaaaaaggccgccatgcggcgcggcaagccgcccgccccgggccaagggaagaggcggcgccacgggccgcagctctcaaaggcgatgcgtcgggagctcgacgcgatggggcctggcgctgcccgcggctccgacgatgaggaggggtctgacggggtggccgaggacgtgtacgagtacgaggaaggggtgcccgaggaggaggccggcaagaacggccgctacgacgccgtggccaagtacgagtacaatttcgacagcgacgcctccgatgcggatgaggatgtgccttcggacgaaggcgaggatatggaagaagatgacaatgacgacggtgatgatgaggacaggcagataagaatacttcaggagacgaccggaatgcccagagaagccttcgatggaaagaagaggaaacagccattggagctgcctctgcagcatggtgatggagatggacctgtcacaattcatgatctcttggataatgtccaggggaaacctgggtatagcaagatccgtaagaggctgcagcagcaggagaaaaagccgatggtcgtggtagccccacttccgaaagtagagagggacaagattgagcgcagtgtgacgtttcagaaatccaagaatgagctaacaaagtgggaaggagttgtgaagagtaacagggaggctcctgtactatactttgaaaatgataccaacttgggtgtgaacactgttgcagcaattgctagcgaatttaaaccaaggactgagtttgagaagaggattgctcaaattacgcaaagcacagaaataatagaagcacacaagaaggatggcgccaaaatcctggaacttaacaagattgatgtggaagatgtgagagaacgccaaaaccgccttgctaagatgcgcagccttctatttcgtcatgagatgaaagcaaagcgtgtgaagaagatcaagtccaggacatatcaccggatgttaaagaaggacaaattgaaggcagcatcagcagatttcgaggcagatcctgaagctgtcaaagatcatgctaggaaacaagaatttaaacgggcagaggaaaggatgacattaaagcacaagaatacatcacaatgggcaaagcgaataatcaagcgtggattgtctgttcaagatgaaggaacccgagctgctattgcagcacagctccaacaaaatactcttctgactagaaaaatgaattccatgaaagatgattctagtagtgaagaaagttcagatgacgatgaagacgagagtgactcagaagcaaagatcttaaacagagggaaagaaaagattcttaaagctcttgaagaagacaatgagataccaaattctggagttttttcattgcctttcatggagcgtgctatgaaaaagcgtgaggaagctacgtatgaggaagcacgacaggctcttgaagaatacgatgattccttgcagaaactggaggagaataacactaaacagaatgacgactcaattaaggtgtcaggtaaaagaacatttgggcctgtcaaaaatacacacgaagaggtaaagaagagaaaattacaagatactgaaaacagcagtgatagtgagtatgattctgagcctgcccaacatttgagcaataatgaagtaactatgaaacatgatgatatccaatttgggaatgcgctactggatgatgaaccacagaatgatatgtacagaagctttaatgatatcataaaaaatcctggtcctaagacaacttttgaagttggaatgttagctggtgattcatggaagaaggtcaaaagtaataaaggaaatgaccagagcaatggcaatggcattaccaataaatccaaattaccagttccttctattgtagacccaaagcctaagcaacaggatcacagttctgattcagattctgaggaagagatggttgagggcttcttgactgtctctgacagaaaggagaactatgaacttccatctcaagaggatctcatacgtcaggcttttgctggtgatgatgttgaagctgaatttgagaaagacaaaatggatgttttaaatgaggagaatcctgaacctgaaaagcctgctcttgttcctggctggggccagtggacagacatccaacagaaaaaaggacttccctcatggatgataaaagaacatgaagttgctaaaagaaatagacaagaagccttgaagaggaggaaggactcaaagcttaaacacgtcattatttctgaacatgtagataagaaggttgaaaagtatttagcaaggaatttgcctttccctttcacttcaaaagatgcgtatgagcagagcatccgaatgcctattgggcctgatttcaacccagcaatatcggtttctgctctcaatcgacctgcgatagttaagaagcccggtattatcatcaaaccaatacaatatgaggaggttaatccccatgagaagcctgatgaaccaaaacgagtcattcagagagcaaccccaaaccagaaagcaaagaaagcctttgccaaacaaggaaagggggcaacttcacaaaagagaaagtga

SEQ ID NO: 20349 - protein, 857 aa, Sorghum bicolor
  misc_feature: Ceres ANNOT ID no. 8641247
  misc_feature: Up-regulated in root tissues in response to methyl jasmonate treatment
  misc_feature (99)..(817): Pfam ID: Utp14 Pfam Description: Utp14 protein
MPKKAAMRRGKPPAPGQGKRRRHGPQLSKAMRRELDAMGPGAARGSDDEEGSDGVAEDVYEYEEGVPEEEAGKNGRYDAVAKYEYNFDSDASDADEDVPSDEGEDMEEDDNDDGDDEDRQIRILQETTGMPREAFDGKKRKQPLELPLQHGDGDGPVTIHDLLDNVQGKPGYSKIRKRLQQQEKKPMVVVAPLPKVERDKIERSVTFQKSKNELTKWEGVVKSNREAPVLYFENDTNLGVNTVAAIASEFKPRTEFEKRIAQITQSTEIIEAHKKDGAKILELNKIDVEDVRERQNRLAKMRSLLFRHEMKAKRVKKIKSRTYHRMLKKDKLKAASADFEADPEAVKDHARKQEFKRAEERMTLKHKNTSQWAKRIIKRGLSVQDEGTRAAIAAQLQQNTLLTRKMNSMKDDSSSEESSDDDEDESDSEAKILNRGKEKILKALEEDNEIPNSGVFSLPFMERAMKKREEATYEEARQALEEYDDSLQKLEENNTKQNDDSIKVSGKRTFGPVKNTHEEVKKRKLQDTENSSDSEYDSEPAQHLSNNEVTMKHDDIQFGNALLDDEPQNDMYRSFNDIIKNPGPKTTFEVGMLAGDSWKKVKSNKGNDQSNGNGITNKSKLPVPSIVDPKPKQQDHSSDSDSEEEMVEGFLTVSDRKENYELPSQEDLIRQAFAGDDVEAEFEKDKMDVLNEENPEPEKPALVPGWGQWTDIQQKKGLPSWMIKEHEVAKRNRQEALKRRKDSKLKHVIISEHVDKKVEKYLARNLPFPFTSKDAYEQSIRMPIGPDFNPAISVSALNRPAIVKKPGIIIKPIQYEEVNPHEKPDEPKRVIQRATPNQKAKKAFAKQGKGATSQKRK

SEQ ID NO: 20350 - DNA, 1602 bp, Sorghum bicolor
  misc_feature: Ceres ANNOT ID no. 8641304
  misc_feature: Up-regulated in root tissues in response to methyl jasmonate treatment
  misc_feature: Up-regulated in shoot tissues in response to salicylic acid treatment
  misc_feature: Up-regulated in root tissues in response to salicylic acid treatment
  misc_feature: Encodes the peptide sequence at SEQ ID NO 20351
atggatcgcgctgtgatggcgccgccgctgctcgtcctcctgctgctcctcctctcgcggtgttcggcggcggcgccacggcacggcgccgagggctggtgggaggagggcgagggggaatggaggccggccgaggaggaagagcagggcaagcagggcaaggggagggggctgttcgtgctggaccggctggagaaggtggtcgagtcggagggcgggcaggtgcgcgtggtgcgcggccagccgtggccgccggccgccgccttcgcgtgccgcgacgggctcatgcacatcggcttcatcaccatggagcccaagacgctgttcgtgccgcagtacctcgactccagcatcactctcttcgtgcagcggggggaagtgaaggttgggtatattcacaaggatgagctcgtggagaggaagctcaagatgggcgacgtgctccacatcgacgccggatccaccttctacttggtcaacaccggcaaagggcagaggctacagatcatatgcagcatcgacgcctccgatagccttggcttctttggacctccttatcaggccttctacctcggcggcgcagggcacccggcgtcggtcatcgccggtttcggaccgaagacgcttacccatgccttcaacgccacctacgacgagttggcaagtatcctgctggcaaaaaccggcggccccatcgtgcactacaccgcggacgtggagcccgagggcggtggcggcgaagaggagcgtgggcagggcgggaacgacgtgctggacaggggaacgcggtgcgagggtgctcgtgctggtgctggcgctggcgcgtggaggccggtcggcaggggagacgaaggcgacgagtgcggcagcgatgacgacgcacggcggccgacgtggtcgtggaggaagctggtgaacaggttcatcggaggaggggcgggcggcggcgacaccgcggagacgaacaagaagggcaagaagaaggggggcgcgacggagccgtacaacctctacgacagcgagcccgggttccggaacagctacggctggaccgtctccgtcgacaagcaccagtacgagcccctcaagcaccccgacatcggcgtctacctcgtaaacctcaccgcggggtcgctgctggcgccgcacgtgaaccctcgggcgacggagtacggcgtggtgctgggcggggaaggcacgatccaggtggtgttcccgaacgggtcgctggcgatgagcgaggtggtgcggcccggcgacgtgttctggatcccgcgctacttccccttctgccaggtggcgtcgcggggcgggcccttcgagttcttcggcttcaccacctcggcgcgccgcaaccggccgcagttcctggtgggcgcctcctcggtgctccgcaccctgctggggccggagatcgccgccgcgttcggcgctcgcgaggaggagttcagtaagctggtgcgcgcgcagagggaggccctgataatgccgtcgttccacgcgtcagggaaggaggaggaggaggagaagcatgggaagaagaaggggaggagggagagggaggaggcaccagtgccgctggtcgtcgagcaggtggtgtag

SEQ ID NO: 20351 - protein, 533 aa, Sorghum bicolor
  misc_feature: Ceres ANNOT ID no. 8641304
  misc_feature: Up-regulated in root tissues in response to methyl jasmonate treatment
  misc_feature: Up-regulated in shoot tissues in response to salicylic acid treatment
  misc_feature: Up-regulated in root tissues in response to salicylic acid treatment
  misc_feature (367)..(426): SWISSPROT Homolog: EC 1.2.3.4 Oxalate oxidase
  misc_feature (335)..(484): Pfam ID: Cupin_1 Pfam Description: Cupin
  misc_feature (59)..(197): Pfam ID: Cupin_1 Pfam Description: Cupin
MDRAVMAPPLLVLLLLLLSRCSAAAPRHGAEGWWEEGEGEWRPAEEEEQGKQGKGRGLFVLDRLEKVVESEGGQVRVVRGQPWPPAAAFACRDGLMHIGFITMEPKTLFVPQYLDSSITLFVQRGEVKVGYIHKDELVERKLKMGDVLHIDAGSTFYLVNTGKGQRLQIICSIDASDSLGFFGPPYQAFYLGGAGHPASVIAGFGPKTLTHAFNATYDELASILLAKTGGPIVHYTADVEPEGGGGEEERGQGGNDVLDRGTRCEGARAGAGAGAWRPVGRGDEGDECGSDDDARRPTWSWRKLVNRFIGGGAGGGDTAETNKKGKKKGGATEPYNLYDSEPGFRNSYGWTVSVDKHQYEPLKHPDIGVYLVNLTAGSLLAPHVNPRATEYGVVLGGEGTIQVVFPNGSLAMSEVVRPGDVFWIPRYFPFCQVASRGGPFEFFGFTTSARRNRPQFLVGASSVLRTLLGPEIAAAFGAREEEFSKLVRAQREALIMPSFHASGKEEEEEKHGKKKGRREREEAPVPLVVEQVV

SEQ ID NO: 20352 - DNA, 3105 bp, Sorghum bicolor
  misc_feature: Ceres ANNOT ID no. 8641302
  misc_feature: Down-regulated in shoot tissues in response to salicylic acid treatment
  misc_feature: Encodes the peptide sequence at SEQ ID NO 20353
atggcggcggcggtgtctcgtgacgacgagctggtgatcaagtcaccaaacgaccagcggtcttatcgcctcctccgccttgccaacggcctctgtgccctcctcgtccacgaccctgagatctacgccgacggttacccacctcaggcctccaagccacttgaagacgaggagatggaggaagtggacgaagaagacgaggatggcgacgacgacagcgaagagtacagtgacgaggagggtgaggacgacgatggggaggatggggaggaggacgaggatgagggcgagtcgaagaggaggaaggagaagggtggcgccgagccaatcgttaagaaggctgctgctgcaatgtgtgttggaatgggcagtttcgctgaccctgagaaggcacagggcttagcacattttctagagcacatgctttttatggggagttctgaatttccagatgaaaacgagtatgacagttacctgtccaaacatggcggtgcatctaatgctttcactgaaaccgagtacacatgctaccattttgaggtcaaacgggagcatctgaagggagccttagacagattttctcaattcttcgtgtcaccccttgttaaggctgaagcaatggaccgtgagatattagcagtggactcagagtttaatcaagttctgcaaagcgattcctgccgcctttaccaactgcagtcccatacctgttctcaaagacaccctttgaacagatttacctggggaaacaagaaaagtttagttgacgcaatgggcagtggaatcaatctaagagaagagattttacatatgtacatgagaaactaccatggaggagcaatgagattggttataattggaggagaaccccttgacattctagaaggctggacaatggagttatttagcaaggttaaagctggccctcgtttggatataggtccaaagactgacattccattttggaagtcagggaaactctacaagttggaggctgttagagatgtgcacagcctttgcttgtcatggacacttccttgcttgcacaaggagtacatgaagaaaccagaagattatttggctcatctccttggtcatgagggcaagggaagtttactttatttcttgaaagctaaaggctgggcgagctcattgagtgctggtgttggtagtggaggatcacaacggtcatcatatgcttatatctttgaaatgtctatccgccttactgattccggtctgaaaaatgtatttgaggtcattggtgccgtataccaatacataaagttgcttaagcagtctgagccacaagaatggatattcaaggaacttcaggacattggacacatggagttcagattcgcagaagagcaacctccagatgattatgcagttgatcttgcagaaaatatgctattttattctgaaaaacacattgtttgtggagagtatatttatgaggactgggatccagaattagtgaagcatgcattgagcttcttcaatccagataacatgagagttgacgtgctcagtaaatcatttgataagcagtcccaagctatccaatgtgagccatggtttggttcacagtacattgaggaggacatcccatcatctttgatagaaagttggaaaaatcctgttcaagtagatgctaatttacatttgcctaggaagaatgaatttataccaggggacttcactctgcgaaatgccaactctcctggatcctcaagcgatgctaacccttgctgcatcgtggatgagccattcataaaactctggtacaagatggacatgacatttaatgtccctcgtgccaacacttacttttttatttctgtcaaggatggctgtagtagcctcgaaaactctgtcctgacagagctctttgcacaccttctcaaagatgaacttaatgaggtcctttatcaggcttatgtggctaaactggagacttcaatatgtgctgttgctagcaaacttgagataaagctttatggttacaatgataagcttcccatcctgctgtccaagatcttgtctactcttcgttccttttctccaaaaacagataggtttgaggtcatcaaggaagatttggaaagagcttacaagaacactaacatgaagcctatgagccattccacctacttgaggctacaagtcttgcgtgaaatattctgggacgttgatacaaaacttgaagttcttatgaagctgacatttactgatctagtagcatttgtaccgaagatcctttcccagttgcacgttgagggactttgtcatggtaacttgtcagaagacgaggcagttaatatatcaaaaatatttctcaacactctgtctgctccgacactgccggaggaagcaaggcattcagaaagagtaatgtgcatccctaatggtgcaaattttgttagaagtgtgcgcgtgaaaaatgatcttgaagaaaattctgttgttgaggtctatttcccaattgagcaagatgttggaaaggaggcaacaaggctcagagctattacagatctttttagcaacattattgaagaaccatgctttgatcagctaagaaccaaagagcaacttggttatactgtggactctagtccaaggatgacttaccggatgctggcctattgttttcaagttatgtcctccaaatatagccctatttatctgcaaagtcggattgacaacttcattgatggtctatctgatctgctggacgggctcaatgaagagacttttgagcaccatagaagtggtttaatagctgataaactggaaaaggaaccttccctcagctaccaaactaatgattattggtctcagattgctgataaaaggtacatgtttgatatggcaaaactggaagctgaagagcttaagacagttcacaaggctgatgttatagcttggtacaacacatacataagatcatcagctccgaagagaagacgactagcaattcatgtgtatggttgcaactcggatattactgaggctgctaaactccaggagcaatcttggattataattgatgacattgaatcattgaaggcttcgtctcaattttattcaagcctctgctga

SEQ ID NO: 20353 - protein, 1034 aa, Sorghum bicolor
  misc_feature: Ceres ANNOT ID no. 8641302
  misc_feature: Down-regulated in shoot tissues in response to salicylic acid treatment
  misc_feature (107)..(1002): SWISSPROT Homolog: EC 3.4.24.56 Insulysin
  misc_feature (107)..(240): Pfam ID: Peptidase_M16 Pfam Description: Insulinase (Peptidase family M16)
  misc_feature (263)..(448): Pfam ID: Peptidase_M16_C Pfam Description: Peptidase M16 inactive domain
  misc_feature (741)..(927): Pfam ID: Peptidase_M16_C Pfam Description: Peptidase M16 inactive domain
MAAAVSRDDELVIKSPNDQRSYRLLRLANGLCALLVHDPEIYADGYPPQASKPLEDEEMEEVDEEDEDGDDDSEEYSDEEGEDDDGEDGEEDEDEGESKRRKEKGGAEPIVKKAAAAMCVGMGSFADPEKAQGLAHFLEHMLFMGSSEFPDENEYDSYLSKHGGASNAFTETEYTCYHFEVKREHLKGALDRFSQFFVSPLVKAEAMDREILAVDSEFNQVLQSDSCRLYQLQSHTCSQRHPLNRFTWGNKKSLVDAMGSGINLREEILHMYMRNYHGGAMRLVIIGGEPLDILEGWTMELFSKVKAGPRLDIGPKTDIPFWKSGKLYKLEAVRDVHSLCLSWTLPCLHKEYMKKPEDYLAHLLGHEGKGSLLYFLKAKGWASSLSAGVGSGGSQRSSYAYIFEMSIRLTDSGLKNVFEVIGAVYQYIKLLKQSEPQEWIFKELQDIGHMEFRFAEEQPPDDYAVDLAENMLFYSEKHIVCGEYIYEDWDPELVKHALSFFNPDNMRVDVLSKSFDKQSQAIQCEPWFGSQYIEEDIPSSLIESWKNPVQVDANLHLPRKNEFIPGDFTLRNANSPGSSSDANPCCIVDEPFIKLWYKMDMTFNVPRANTYFFISVKDGCSSLENSVLTELFAHLLKDELNEVLYQAYVAKLETSICAVASKLEIKLYGYNDKLPILLSKILSTLRSFSPKTDRFEVIKEDLERAYKNTNMKPMSHSTYLRLQVLREIFWDVDTKLEVLMKLTFTDLVAFVPKILSQLHVEGLCHGNLSEDEAVNISKIFLNTLSAPTLPEEARHSERVMCIPNGANFVRSVRVKNDLEENSVVEVYFPIEQDVGKEATRLRAITDLFSNIIEEPCFDQLRTKEQLGYTVDSSPRMTYRMLAYCFQVMSSKYSPIYLQSRIDNFIDGLSDLLDGLNEETFEHHRSGLIADKLEKEPSLSYQTNDYWSQIADKRYMFDMAKLEAEELKTVHKADVIAWYNTYIRSSAPKRRRLAIHVYGCNSDITEAAKLQEQSWIIIDDIESLKASSQFYSSLC

SEQ ID NO: 20354 - DNA, 1887 bp, Sorghum bicolor
  misc_feature: Ceres ANNOT ID no. 8641308
  misc_feature: Up-regulated in shoot tissues in response to methyl jasmonate treatment
  misc_feature: Up-regulated in shoot tissues in response to salicylic acid treatment
  misc_feature: Encodes the peptide sequence at SEQ ID NO 20355
atgagggggcaggcgtggctggcgctgctgctcgtggtggcgctggccttggcggacgcggcggcggggaggttcgtggtggagaagaacagcatccaggtgacgtcccccgacgagctcaagggcaagtacgagtgcgccatcggcaacttcggggtgccgcagtacgggggcaccctgcacggatgggtcgagtaccccaagtccaaccggaaggcgtgccagagcttcgaccagttcgacatctcgttcaagcccaagcaggctgggggacgacccaccttcgtcctcgtcgaccgcggagaatgcttcttcacaaccaaggcatggaatgcacaaaacgctggagctgctgcagttcttgtcgtggatgacaagtcagaacctctaatcacaatggacaacccagaagaaggcaaagagcacctagaaaacatcactattccctcagtgcttataacaaagaaattgggggaaagccttaagaaatctgtggaaaatggtgatatgcttagcgttcttctggactggagagaatcccttccccatcccgatgagcgtgtagagtatgagttctggacaaacagtaatgatgaatgtggtcctaaatgcgatatgcaaatggactttgtgaggagctttagaggaactgcacaaattcttgagaaaaagggttacactcagtttactcctcattatatcacatggtattgtccagaagcttttgtcagtagcaagcaatgcaaatcacagtgcatcaatcatgggagatattgtgcaccagaccctgagcaggattttagccaagggtatgatggaagagatgttgtggttcaaaatctgcatcaaatttgtgtattcaagattgctaatgagactggaaagccatggctgtggtgggattatgtgcatgattttgcacttaggtgcccaatgaaggataagaaatacaaccatgactgtgccagcgatgttatcaagtcacttggattggaaatggagaagataaacaagtgtattggcgaccctgaagccgatgtggaaaatgaaattttaaaggcggaacaagatgcccaaattggtcatggtaataggggagatgtcacaatactaccaacccttgtcatcaacaacaggcaatacagaggtacgctggacaaagttgctgtcatgaaagcgatctgttcaggattcgaggagacaactgagcctgctgtttgtttgagcgaagaggttcaaacaaatgagtgtttggagaacaatgggggttgctggctggacacagctaataatgttactgcatgcaaggataccttccgtgggcgtgtttgtgagtgccctattgtgagaggtgtaaaatttgttggtgatggatatacccattgtgaagcttctggtattggtaggtgtgagatcaataatggagggtgctggcaggaaactaaagatgggaagacaatctctgcctgctcaaacgaagtatctgaaggttgtaaatgtccagtgggtttcaagggtgatggagaaaaaagttgtgaagacattgatgaatgcaaagacaaactttactgtcagtgcaagggttgcagctgcaagaatacatggggaagctatgagtgcagctgtggtgatgacaatatgctatacatgagggagcatgacacttgcatcagcaaaaagggtactaccagtactgttggctggagcttcctctgggttattttctttggacttgtttttgccggggttggagcatacgctgtgtacaaatacaggctgaggagttacatggattcggagatccgtgccatcatggctcagtacatgcctctggataaccaagaaggggcaaaccagcatcaggtcgtgcacgcgaatgatatttga

SEQ ID NO: 20355 - protein, 628 aa, Sorghum bicolor
  misc_feature: Ceres ANNOT ID no. 8641308
  misc_feature: Up-regulated in shoot tissues in response to methyl jasmonate treatment
  misc_feature: Up-regulated in shoot tissues in response to salicylic acid treatment
  misc_feature (55)..(165): Pfam ID: PA Pfam Description: PA domain
MRGQAWLALLLVVALALADAAAGRFVVEKNSIQVTSPDELKGKYECAIGNFGVPQYGGTLHGWVEYPKSNRKACQSFDQFDISFKPKQAGGRPTFVLVDRGECFFTTKAWNAQNAGAAAVLVVDDKSEPLITMDNPEEGKEHLENITIPSVLITKKLGESLKKSVENGDMLSVLLDWRESLPHPDERVEYEFWTNSNDECGPKCDMQMDFVRSFRGTAQILEKKGYTQFTPHYITWYCPEAFVSSKQCKSQCINHGRYCAPDPEQDFSQGYDGRDVVVQNLHQICVFKIANETGKPWLWWDYVHDFALRCPMKDKKYNHDCASDVIKSLGLEMEKINKCIGDPEADVENEILKAEQDAQIGHGNRGDVTILPTLVINNRQYRGTLDKVAVMKAICSGFEETTEPAVCLSEEVQTNECLENNGGCWLDTANNVTACKDTFRGRVCECPIVRGVKFVGDGYTHCEASGIGRCEINNGGCWQETKDGKTISACSNEVSEGCKCPVGFKGDGEKSCEDIDECKDKLYCQCKGCSCKNTWGSYECSCGDDNMLYMREHDTCISKKGTTSTVGWSFLWVIFFGLVFAGVGAYAVYKYRLRSYMDSEIRAIMAQYMPLDNQEGANQHQVVHANDI

SEQ ID NO: 20356 - DNA, 1827 bp, Sorghum bicolor
  misc_feature: Ceres ANNOT ID no. 8641321
  misc_feature: Up-regulated in shoot tissues in response to aminocyclopropane carboxylic treatment
  misc_feature: Encodes the peptide sequence at SEQ ID NO 20357
atggcaaacacagaaggttttcgccttgtgagatgcccaaagtgtctgaacattctcccagaaccgcccaaagttacagtctacaagtgcggcggatgcggcaccacccttcgagctaaaatccgtgccagcaatggccaacatgtggctgcaaaacaagtccgccaggactccgacagttattcggttgcaaccgccgtgagcaatggggtgcctcctcaaaacaaagaccaaggctccattggtgctgtcacagagaatttttccttcaatgctgacgctccaagcaccgagcatgacagcaatggaacaaggagcagtgaaaatggtgatgatatgctggctgggcagaatgctgtggtggttgaggatactgagaacaaggacaatcaaaaccacaccgttgaacaacctatggagaattcagagacttaccgagtaagtggacatgatgatactgaatgccacttgaacccctctgaaaacaaaccgatttcttctgagataagcaaagcagccgtcagtatgcaagatcctgagcagaaggaagcaggcgaatccgaacatgcggcaaacaagaagagttatcttgtgagggtgctgtctcggtcttgtgatcttcggtcatcaataaactcgattgatttccactctgcacggacttcgcttcaatccaaaagcttcagggctagtgagccccttcagtcgaagatcatgaacacaatggatgaactgaagggtgacctttctgaattgttcaataaacctgctgcagactgcaagccaaaggcacacaaccctccacgcccttccaaacaagatggccacatgactcgtgcagccaccacaaccagcgcacctcttgcagcataccatcctgctgccaagtattctggctatgtgtctcgcctaagcaggtctggccaggttcctcttcctcctcgtggactgccgtcgctgagatatcgccggcacagggtttattcattccatcatcacagcatgcaaacggaaatgagaccttgccgtcatgagtgctgccatagctgccagccaccctgctacagatcctgcaaccaagaatcttcagcgatgcacaggccaccgatcatggagatcaggcgtcgtcctcctcccagaaatcactgcctgccagtgctacgtggcgctccgttcgtcatctgctccaactgcgtcagtctggtccagctgcccaccgacttcgccgtccctagcagagggacacgccgggtgcagtgcggctcctgctccgaagtcctctcctactcctacagggaccccgccaggaagaggctgcagtcaccatttgggggcgatgagtacagcactgatgagtacgagattcaccaccaggctgccgctgccggcggcggcttcgagcaagcagatccggtgtcctactccgaagagtacgggctctcgttcggcgtcagccactcgactagcaccgaggacgggcagccgctgtacgtgtcgaggaactcgtccttcaacaccgtcgacgaaaggatgatgggcaaagacggcaagcttcaccggcttatggggtactcgtcggcgagcgagctgctgcggcggcattcgcccgacctgttcgagagcttcgacaggcgcacgcccaccatcgaaagaacgcacgtcgtcgacaggaagggtaaaggcgtctgcgtggcagaaaacgatgccggcgagcgagacggtggtgcggtggtgaagagatcgaaggcgaggagtggtggcttgccgctccatgggatcctgaagaaggggatccatggcctggaatcactcaagctcaggtcgtag

SEQ ID NO: 20357 - protein, 608 aa, Sorghum bicolor
  misc_feature: Ceres ANNOT ID no. 8641321
  misc_feature: Up-regulated in shoot tissues in response to aminocyclopropane carboxylic treatment
MANTEGFRLVRCPKCLNILPEPPKVTVYKCGGCGTTLRAKIRASNGQHVAAKQVRQDSDSYSVATAVSNGVPPQNKDQGSIGAVTENFSFNADAPSTEHDSNGTRSSENGDDMLAGQNAVVVEDTENKDNQNHTVEQPMENSETYRVSGHDDTECHLNPSENKPISSEISKAAVSMQDPEQKEAGESEHAANKKSYLVRVLSRSCDLRSSINSIDFHSARTSLQSKSFRASEPLQSKIMNTMDELKGDLSELFNKPAADCKPKAHNPPRPSKQDGHMTRAATTTSAPLAAYHPAAKYSGYVSRLSRSGQVPLPPRGLPSLRYRRHRVYSFHHHSMQTEMRPCRHECCHSCQPPCYRSCNQESSAMHRPPIMEIRRRPPPRNHCLPVLRGAPFVICSNCVSLVQLPTDFAVPSRGTRRVQCGSCSEVLSYSYRDPARKRLQSPFGGDEYSTDEYEIHHQAAAAGGGFEQADPVSYSEEYGLSFGVSHSTSTEDGQPLYVSRNSSFNTVDERMMGKDGKLHRLMGYSSASELLRRHSPDLFESFDRRTPTIERTHVVDRKGKGVCVAENDAGERDGGAVVKRSKARSGGLPLHGILKKGIHGLESLKLRS

SEQ ID NO: 20358 - DNA, 3369 bp, Sorghum bicolor
  misc_feature: Ceres ANNOT ID no. 8641389
  misc_feature: Up-regulated in root tissues in response to salicylic acid treatment
  misc_feature: Up-regulated in shoot tissues in response to salicylic acid treatment
  misc_feature: Encodes the peptide sequence at SEQ ID NO 20359
atggccgacgaccacgggtcgtcgcggcacatgtcggcgtcgcagaaggagctgggcgacgaggacgcccgcgtggtgcgcgtgggcgaccccgcgcgcaccaacgagcgcctcgacctcgcgggcaacgccgtgcgcaccgccaagtactcgccgctcaccttcctgccgcggaacctcttcgagcagttccaccgcctcgcctacgtctacttcctcgccatcgccgtgctcaaccagctgccccagctcgccgtcttcgggcggggcgcctccgtcatgccgctcgccttcgtcctcctcgtcaccgccgtcaaggacgcgtacgaggactggcgacgccaccgctccgaccgcgccgagaacggacgcctcgccgaggtcctctcccctgacgcgcacgggggcggcgcccagttcgtccccaccgagtggaagcacgtccgcgtcggcgacgtcgtgcgcgtcgtgtccgacgagtcgctcccggcggacatggtcctcctcgccaccagcgaacccaccggcgtcgcctacgtgcagacgctaaaccttgacggcgagtccaacctcaagacccgctacgccaagcaagagacgctgtccacgccgcccgagcgcctcgccggggccgtcatccgcagcgagcgcccgaaccgcaacatctacggcttccaggccaacctcgagctcgaaggggagacccgccggataccgctaggtccgtccaacatcgtgcttcggggctgcgagctcaagaacacggcatgggccgtcggcgttgtggtgtacgcggggcgggagaccaaggccatgctcaacaacgccggcgcgcccaagaagcgcagccgcctcgagacgcacatgaaccgcgagacgctcttcctctctgccatcctcgtcgtgctctgctccatcgtcgccgcgctctccggcgtctggctgcacacccacgagttggggctcgagctcgcgcagttcttccacaagaaggactacctgcgcctcgacaaggacaatgactaccgcgactacaattactacggcatcgcggcccaaatcgtgttcatctacctcatggcggtcatcgtgttccagatcatgatacccatctcgctctacatctccatggagctggtcaggctggggcaggcctatttcatgatccgagacacgaggctgtacgacgagtcctccaattcgaggttccagtgccgggctctcaacatcaacgaggacctaggccagattaagtgcatattctccgataagaccggcacgctcacacagaataagatggagttccggtgcgcgagcgttgacggtatcgattacagtgacatcgcacggcagcggcctcctgagggtgagcggatttgggcgccaaaaatatcggtgaacaccgatagggagctggtgaagttgatcagggatggggctgataccgagcaagggacgcagactcgggagttctttctcgccctggcaacgtgcaacaccattgttcccatgatcgccgatggtccagaccctaagaagaaggtgattgattaccaaggcgagtcaccggatgagcaggcattggtctctgctgccgcggcatatggctttgtgctagtcgaacgaacatcaggtcacattgtgatcgacgtccttggtgagaagctgagatacgatgtccttggtcttcatgagtttgacagcgatcgcaagaggatgtctgttataattggctgccctgataagtctgtcaagctgtttgtaaaaggtgcagatagttcgatgtttggagtcattgacaaaactgtgaattcagatgttgtccaagcaacagagaagcatctccattcatattcatcactaggtctgcgaacacttgtcattggtatgcgggaacttagccaagaagagtttcaggagtggcaaatggcttatgaaaaggctagcaccgcactactaggaagaggaaaccaactccgcaatgtggctgccaacatcgagacgaacttgcgtctattgggtgccactggaattgatgacaagctgcaggatggagtacctgaagcaattgagaaactgagggaagcagggattaaggtttgggtgttaacaggtgacaagcaagaaactgccatctccatcggctattcgtgcaagcttttgacaagggacatgacacagattgtaattaacagtcgctcaagagactcatgcaggaagagtctagaagatgcaatcgccatggttaacaaataccaatcattctcgacagacccccaacttagggtgccccttgctttgattattgatggtaatagccttgtctacattttcgatacggattgggaagaaaagctttttgaaatcgctatagcttgcgacgtcgtcctatgctgtcgtgtagctccccttcagaaggctggtattgttgatctcataaagaagcgaacaagtgacatgactctagctattggagatggtgctaatgatgtatccatgattcaaatggctgacgttggcattggcatcagtgggcaagagggaaggcaagctgtaatggcctcagattttgccatggggcaattcagatttttggttcctctattgttggtccatggccattggaactaccagaggatggcctacatgatcctatataacttctacagaaatgctacttttgtctttgtgctattctggtatgtgctttacactggtttcaccctaacaacagcaataactgagtggagcagtgtgctatactctgtgatatatactgctgtccctactattgttgttgccattctcgacaaggatctcagccggcggacattgctgaagtatccccaactctatggcccagggcagcgtgaggagaattacaacctgaggctattcatattcatcatgatagactccgtctggcagagccttgcgtgtttcttcatcccctaccttgcatacaggaagagtataattgatggttccagcctcggagatctatggacactatctgttgttattcttgtcaacattcatctggcaatggatgtcatcagatggaattggattacgcatgcagcaatatggggtagcattgctgcaacatggatttgcgtcatgatcatagattccataccaaccatgcctggtttctgggcaatctataaggtgatgggaactgggttgttctgggcactgctgcttgcggtaactgttgttggtatgattcctcattttgccgcaaaggctttcagtgagtacttcatccccagtgacattcagattgcaagagaaatggagaagttgcaagatttccatgatgtaactcatccagaagttcaaatgagtacagtcagtagagcttag

SEQ ID NO: 20359 - protein, 1122 aa, Sorghum bicolor
  misc_feature: Ceres ANNOT ID no. 8641389
  misc_feature: Up-regulated in root tissues in response to salicylic acid treatment
  misc_feature: Up-regulated in shoot tissues in response to salicylic acid treatment
  misc_feature (5)..(1119): SWISSPROT Homolog: EC 3.6.3.1 Phospholipid-translocating ATPase
  misc_feature (417)..(847): Pfam ID: Hydrolase Pfam Description: haloacid dehalogenase-like hydrolase
MADDHGSSRHMSASQKELGDEDARVVRVGDPARTNERLDLAGNAVRTAKYSPLTFLPRNLFEQFHRLAYVYFLAIAVLNQLPQLAVFGRGASVMPLAFVLLVTAVKDAYEDWRRHRSDRAENGRLAEVLSPDAHGGGAQFVPTEWKHVRVGDVVRVVSDESLPADMVLLATSEPTGVAYVQTLNLDGESNLKTRYAKQETLSTPPERLAGAVIRSERPNRNIYGFQANLELEGETRRIPLGPSNIVLRGCELKNTAWAVGVVVYAGRETKAMLNNAGAPKKRSRLETHMNRETLFLSAILVVLCSIVAALSGVWLHTHELGLELAQFFHKKDYLRLDKDNDYRDYNYYGIAAQIVFIYLMAVIVFQIMIPISLYISMELVRLGQAYFMIRDTRLYDESSNSRFQCRALNINEDLGQIKCIFSDKTGTLTQNKMEFRCASVDGIDYSDIARQRPPEGERIWAPKISVNTDRELVKLIRDGADTEQGTQTREFFLALATCNTIVPMIADGPDPKKKVIDYQGESPDEQALVSAAAAYGFVLVERTSGHIVIDVLGEKLRYDVLGLHEFDSDRKRMSVIIGCPDKSVKLFVKGADSSMFGVIDKTVNSDVVQATEKHLHSYSSLGLRTLVIGMRELSQEEFQEWQMAYEKASTALLGRGNQLRNVAANIETNLRLLGATGIDDKLQDGVPEAIEKLREAGIKVWVLTGDKQETAISIGYSCKLLTRDMTQIVINSRSRDSCRKSLEDAIAMVNKYQSFSTDPQLRVPLALIIDGNSLVYIFDTDWEEKLFEIAIACDVVLCCRVAPLQKAGIVDLIKKRTSDMTLAIGDGANDVSMIQMADVGIGISGQEGRQAVMASDFAMGQFRFLVPLLLVHGHWNYQRMAYMILYNFYRNATFVFVLFWYVLYTGFTLTTAITEWSSVLYSVIYTAVPTIVVAILDKDLSRRTLLKYPQLYGPGQREENYNLRLFIFIMIDSVWQSLACFFIPYLAYRKSIIDGSSLGDLWTLSVVILVNIHLAMDVIRWNWITHAAIWGSIAATWICVMIIDSIPTMPGFWAIYKVMGTGLFWALLLAVTVVGMIPHFAAKAFSEYFIPSDIQIAREMEKLQDFHDVTHPEVQMSTVSRA

SEQ ID NO: 20360 - DNA, 1002 bp, Sorghum bicolor
  misc_feature: Ceres ANNOT ID no. 8641407
  misc_feature: Up-regulated in shoot tissues in response to methyl jasmonate treatment
  misc_feature: Encodes the peptide sequence at SEQ ID NO 20361
atgggatctgttgcctccgccgccgtgccacctcctcctcaatcagcgccgccccaggtgggcgcgccgccttatgggcccgggctcgccgggatcctcccgccgaggccggagggggaggagaagaaggaggagaaggtggactacctcaacctcccctgccccgtgccattcgaggagatccagcgcgaggccctcatgtctttgaagcctgaactttttgaaggattgaggtttgacttcacaaaagggttgaatcaaaagttctctcttagccacagcgtttttatgggctccttagaagttcctgcccaggcagctgaaactattaaagttcctactgcgcattatgaatttggtgccaattttttagatccaaagttaatgctcattggaagggtgatgacagatggaaggcttaatgctcgtgtgaaatgtgatttgacagacaatctgacgctgaaagtaaatgcacagcttacccaagaggcacattactcacaaggaatgtttaactttgactacaagggaagtgactatcgagcacaattccaaattgggaacaatgcattctatggtgcaaattatattcagagtgttactccgaacctatcaatgggaactgaaatgttctggcttggtcaccaaaggaagtctggaattggttttgcctctcgctataacacggacaaaatggtgggcactctgcaagtcgcaagcactggaatagttgccttaagttatgtccagaagatttccgagaaggtttccctcgcgtctgatttcatgtataaccatatgtcaagagatgtaactgccagctttggttatgattacttgcttaggcagtgccgtctaagaggcaaaattgactcaaatggtgttgttgccgcatacttggaggagaggttgaacatgggtgtcaacttccttctatctgctgagattgaccattgtaagaagaactacaagtttggttttggaatgaccgtaggagagtaa

SEQ ID NO: 20361 - protein, 333 aa, Sorghum bicolor
  misc_feature: Ceres ANNOT ID no. 8641407
  misc_feature: Up-regulated in shoot tissues in response to methyl jasmonate treatment
  misc_feature (54)..(326): Pfam ID: Porin_3 Pfam Description: Eukaryotic porin
MGSVASAAVPPPPQSAPPQVGAPPYGPGLAGILPPRPEGEEKKEEKVDYLNLPCPVPFEEIQREALMSLKPELFEGLRFDFTKGLNQKFSLSHSVFMGSLEVPAQAAETIKVPTAHYEFGANFLDPKLMLIGRVMTDGRLNARVKCDLTDNLTLKVNAQLTQEAHYSQGMFNFDYKGSDYRAQFQIGNNAFYGANYIQSVTPNLSMGTEMFWLGHQRKSGIGFASRYNTDKMVGTLQVASTGIVALSYVQKISEKVSLASDFMYNHMSRDVTASFGYDYLLRQCRLRGKIDSNGVVAAYLEERLNMGVNFLLSAEIDHCKKNYKFGFGMTVGE

SEQ ID NO: 20362 - DNA, 1164 bp, Sorghum bicolor
  misc_feature: Ceres ANNOT ID no. 8641421
  misc_feature: Up-regulated in shoot tissues in response to salicylic acid treatment
  misc_feature: Encodes the peptide sequence at SEQ ID NO 20363
atggagctctggagcaagctgcggaacctggatgcctacccgaaagtgaacgaggacttttacagccgcaccctctccggcggcctcatcaccatcctctcctccctcgccatcctcctcctcttcttctccgagatccggctttatctatattctgctacggaaagtaagctcactgttgatacctcgagaggagaaagactacatatcaattttgatgttacgttcccggcccttccttgttctctagttgctgttgatacgatggatgtcagtggagagcaacattatgatatacgacatgacataacaaagaaaagaattgatcatcttggcaatgtaattgaatcaagaaaagacagagttggtgcccctaagattgaaagaccgttacagaagcatggaggtaggcttgaccacaacgaggtttactgtggatcttgttatggtgctgaggagacggatgatcagtgttgcaactcctgtgaagaagttcgtgatgtgtaccggaagaaagggtgggctatcaacaacgtagaattaattgatcagtgcaagagagagggctatgtacaaaggttgaaagatgaaacaggggaaggttgtaccatccatggatttgtaaatgtgaataaagtagctggcaactttcactttgcccccgggaaaagcttggaccagtcattcaacttcctgcaagacctgttgaacatccaaccagaaacttacaatataagtcacaagataaacaagttgtcctttggggaagagttcccaggtgtcgtcaatcctcttgatggagttgagtggatacaggataactccaatgggttaacggggatgtaccagtattttgtgaaggttgttccaacaatctacacagatatcagggggcgcaagatttactcaaatcagttttctgtgacagagcactttagagaggcaattggctatcctaggcctccacctggtgtatatttcttctatgaattttcaccaattaaggttgattttactgaagaaaatacatcgcttcttcacttcctgacaaacatatgtgctattgttggaggtattttcactgttgctggcatcatagattctttcgtgtaccatggtcatcgtgccatcaagaaaaagatggagcttggaaagcttggataa

SEQ ID NO: 20363 - protein, 387 aa, Sorghum bicolor
  misc_feature: Ceres ANNOT ID no. 8641421
  misc_feature: Up-regulated in shoot tissues in response to salicylic acid treatment
MELWSKLRNLDAYPKVNEDFYSRTLSGGLITILSSLAILLLFFSEIRLYLYSATESKLTVDTSRGERLHINFDVTFPALPCSLVAVDTMDVSGEQHYDIRHDITKKRIDHLGNVIESRKDRVGAPKIERPLQKHGGRLDHNEVYCGSCYGAEETDDQCCNSCEEVRDVYRKKGWAINNVELIDQCKREGYVQRLKDETGEGCTIHGFVNVNKVAGNFHFAPGKSLDQSFNFLQDLLNIQPETYNISHKINKLSFGEEFPGVVNPLDGVEWIQDNSNGLTGMYQYFVKVVPTIYTDIRGRKIYSNQFSVTEHFREAIGYPRPPPGVYFFYEFSPIKVDFTEENTSLLHFLTNICAIVGGIFTVAGIIDSFVYHGHRAIKKKMELGKLG

SEQ ID NO: 20364 - DNA, 1143 bp, Sorghum bicolor
  misc_feature: Ceres ANNOT ID no. 8641423
  misc_feature: Up-regulated in shoot tissues in response to methyl jasmonate treatment
  misc_feature: Down-regulated in root tissues in response to methyl jasmonate treatment
  misc_feature: Up-regulated in shoot tissues in response to salicylic acid treatment
  misc_feature: Encodes the peptide sequence at SEQ ID NO 20365
atgcagtccaagcaccggatcttcgcggaggacctgctcctcgcggcggagggcgaggaccacttcgaccgggtgccggactccctggtgctcctcatcttcaacaagctcgccgacgcgcgctccctcgggcgctgctccgcggtgtcgcgccgcttcaacgcgctcgtcccgctcgtcgacgacgcctgcctccgcatcgaccgcgtcatccccgccgacgccgccgacggcggcgacgcgctgggcggcctcgcgggcgggccgcgcccgcgcgccgtgctgtcgcacctactcaaggccatgctgcaggccgtgctcaagcccttcgcgcactgcgacgccaagtccgcggcgcacaagcacgcgctgctgcagcaggggcagcagcagcaccactcgccggcgcaggtgctcaagaacttcagcagcatccgcaacctccgcatggagctccccgtgtccgacgtcggcaccgacgacggcgtcgtcctcaagtggaaggccgtgttcggcagcacgctgcagagctgcgtcatcctcggcggcaccaaggtggaacgggctgccagtggcagtgccaacgcctccgccgctcctcccccagctccccacgccgacgctggcgacgccgcggccgcgggcggccctgacgacagcggcagcatcccggagtccttctacaccaacggcgggctgaagctgcgcgtggtgtggaccatcagctccctcatcgccgcggccaccaggcactacctcctccgcgagatcgtcaaggagcaccccaccctggagcaggtggcgctcacggacgccaacgggcagggcacgctcagcatggggcgcgaccagctcagggagttcagggacaagccgctcgccgcggccgccgccgccaaccgcacgcaggtgcccgcctgcaacatgaagctccgctacgcgccgctgctcgagctctctgacggcaccaggatccacggcgccacgctcgtggtcatcaagcccgtcggcgacgccgcgggcgtcggcggcaggaaggagctcgacgagttcgtcgccggcgccttcgacgggcccttcagggaggccgtggccgcgctcagcaagcgccgcacctacctgctcgagatgaatggcttctag

SEQ ID NO: 20365 - protein, 380 aa, Sorghum bicolor
  misc_feature: Ceres ANNOT ID no. 8641423
  misc_feature: Up-regulated in shoot tissues in response to methyl jasmonate treatment
  misc_feature: Down-regulated in root tissues in response to methyl jasmonate treatment
  misc_feature: Up-regulated in shoot tissues in response to salicylic acid treatment
MQSKHRIFAEDLLLAAEGEDHFDRVPDSLVLLIFNKLADARSLGRCSAVSRRFNALVPLVDDACLRIDRVIPADAADGGDALGGLAGGPRPRAVLSHLLKAMLQAVLKPFAHCDAKSAAHKHALLQQGQQQHHSPAQVLKNFSSIRNLRMELPVSDVGTDDGVVLKWKAVFGSTLQSCVILGGTKVERAASGSANASAAPPPAPHADAGDAAAAGGPDDSGSIPESFYTNGGLKLRVVWTISSLIAAATRHYLLREIVKEHPTLEQVALTDANGQGTLSMGRDQLREFRDKPLAAAAAANRTQVPACNMKLRYAPLLELSDGTRIHGATLVVIKPVGDAAGVGGRKELDEFVAGAFDGPFREAVAALSKRRTYLLEMNGF

SEQ ID NO: 20366 - DNA, 1746 bp, Sorghum bicolor
  misc_feature: Ceres ANNOT ID no. 8641539
  misc_feature: Up-regulated in root tissues in response to methyl jasmonate treatment
  misc_feature: Up-regulated in shoot tissues in response to salicylic acid treatment
  misc_feature: Encodes the peptide sequence at SEQ ID NO 20367
atgggctccatgggaggaccggcgagcgggtccgcggcgcctgagcgggacatcgacgatctgccgcggaacgacgccaactacacggcgctcacgccgctctggttcctcgagcgcgcggcgctggcgcagccgggcagggcgtccgtcgtgcacggccccgtgcgctacacctgggccgacacctatcgccgctgccgccgcctcgcatccgccctcgcgcgccgatccgtcggccacggaagcacggttgctgtgatagcccctaatgtcccagctgtctatgaaggtcactttggtgtcccaatgtcaggagctgttgtgaactgcgtcaatattcggttaaacgctgagacaatagcattcctccttgaacactctgtggcagaagttgttatggtagaccaagaattcttcaccctagctgaagaatcactaaagataattgccaagaagaagacatcggctttcaggcctccaatcttgatcgtcatcggtgacccaacctgtgatccaaagtctctacagtatgctctaggaaagggtgctatagagtatgaagagtttctgaaaactggtgacccagagttcaattggaagccaccaaaggatgaatggcagagcatcgccctaggctacacttctgggactacttccagcccaaaaggcgtcgtgttgcatcaccgtggtgcttatctcatggcactcagtgttgccattgtgtggggaatgcctgaaggggctgtctatttgtggactctgcccatgttccattgtaatggttggtgctatacttgggcgctggcagccttctgtggaacaagcatatgtcttcgccaggtgagcacaaaggctatatacgaaggcattaccaagcaaggagtgacacacttctgtgccgcacctgtcgtcctcaacaacctgatcaacgctccggcaagcgagacattcctgccgctgccccacgtcgtcaatgtcaatgtggccggagccgccccgacgccgtccttgctggctgcactgtccatccgcggcttccgcgtgacgcacacgtacggcctgtcagagacctacggcccctcgacggtgtgcgcgtggaagcccgagtgggacgagctgccgctggaggagcggtcccgcctgcactgccggcaggggatcaggtacatcgcgatggagggcctggacgtcgtggacccgaagacgatggcgcccgtcccggccgacggcaagtcgtacggcgagatcgtgctgcggggcaacgccgtgatgaaggggtacctcaagaaccccaaggcaaacgcggaggcgttcgcgggcgggtggtaccattcgggcgacctcggcgtgaagcaccccgacgggtacgtggaggtgagggaccggatgaaggacgtgatcatctcgggaggggagaacatcagcagcctggaggtggagaaggtggtgtgcacgcacccggcggtgctcgaggcctcggtggtcgccagggccgacgagcggtggggcgagtcgccgtgcgcgttcgtgacgctcaaggacggagcagccgatgggtcggacgaggcggcgctggccaacgacatcatgcgattctgccgggagaggatgccggggtactgggtgcccaagtcggtgatcttcgggccgctgcccaagacggccacggggaagatcaagaagcacgagctgagggccaaggccaaagagctcggccctgtgattgtgaagaagagcaggatgtga

SEQ ID NO: 20367 - protein, 581 aa, Sorghum bicolor
  misc_feature: Ceres ANNOT ID no. 8641539
  misc_feature: Up-regulated in root tissues in response to methyl jasmonate treatment
  misc_feature: Up-regulated in shoot tissues in response to salicylic acid treatment
  misc_feature (207)..(571): SWISSPROT Homolog: EC 6.2.1.26 o-succinylbenzoate--CoA ligase
  misc_feature (58)..(494): Pfam ID: AMP-binding Pfam Description: AMP-binding enzyme
MGSMGGPASGSAAPERDIDDLPRNDANYTALTPLWFLERAALAQPGRASVVHGPVRYTWADTYRRCRRLASALARRSVGHGSTVAVIAPNVPAVYEGHFGVPMSGAVVNCVNIRLNAETIAFLLEHSVAEVVMVDQEFFTLAEESLKIIAKKKTSAFRPPILIVIGDPTCDPKSLQYALGKGAIEYEEFLKTGDPEFNWKPPKDEWQSIALGYTSGTTSSPKGVVLHHRGAYLMALSVAIVWGMPEGAVYLWTLPMFHCNGWCYTWALAAFCGTSICLRQVSTKAIYEGITKQGVTHFCAAPVVLNNLINAPASETFLPLPHVVNVNVAGAAPTPSLLAALSIRGFRVTHTYGLSETYGPSTVCAWKPEWDELPLEERSRLHCRQGIRYIAMEGLDVVDPKTMAPVPADGKSYGEIVLRGNAVMKGYLKNPKANAEAFAGGWYHSGDLGVKHPDGYVEVRDRMKDVIISGGENISSLEVEKVVCTHPAVLEASVVARADERWGESPCAFVTLKDGAADGSDEAALANDIMRFCRERMPGYWVPKSVIFGPLPKTATGKIKKHELRAKAKELGPVIVKKSRM

SEQ ID NO: 20368 - DNA, 1533 bp, Sorghum bicolor
  misc_feature: Ceres ANNOT ID no. 8641668
  misc_feature: Up-regulated in root tissues in response to methyl jasmonate treatment
  misc_feature: Down-regulated in shoot tissues in response to salicylic acid treatment
  misc_feature: Encodes the peptide sequence at SEQ ID NO 20369
atggagccgcggcggcggcggccaccgaggctgccgctccatgtgctcttcttggttgccgctgcttggccgctcgggagctcagggactggaagctttggagttggtgctgagagcaatggagcttcgtctagttttaggaattcaaggagactgcagcagattggagacagaaacgaagatggcctatttcatctcccacatccacggactctcacgcacaagagcagatctcatagaagagttccagcaccagcaccagcaccagcatctgctccagcaccatcaccatccatgtcgtcaccagaaggctcaccgtctccatcaccacatggttcacaatcaatgccacgtcaatcaacttcgcatcgtcatccatccgtggcccctccacatttggtcaggcctgagcctaggcaagatgaaaatgatccaatagttgatactccacctcattctcgtcataagaattcctggacaacctatggtttagttgcagcggggattgctgttttccttttggtatcagcagctagtattctctgcttccgagctaagaaaatgggaactgtgaggccatgggcgacaggtctaagtggacaattgcagaaagcttttgtaactggtgtaccttcgctgaaacgatcagagttggaaacggcatgcgaggatttcagcaatataattggctctacctctacctgcatgctgtacaagggaactttatctagtggagttgaaattgcagtggcttcaagcttggtaacatctgcaaaggattggtcgaaagaaaatgaatcacagtacaggaaaaagatcacgagcttgtccaaagtaagtcacaaaaattttatgaacttgcttggctactgtgaggaagagcatccctttaccagggtgatggtatttgaatatgctccaaatgggacactttttgagcatctccatgtcagggaagcagagaagcttgactggatggcacggctcaggatatccatgggcattgcttactgtcttgagcacatgcatcagctgaaaacaccacttgtgctgaggaactttgactcaactacagtataccttactgatgacttcgctgcaaaagtctcagatcttgaattttggaatgatgcaaagggatataattcaaccaacaatgaactggctttctccctggacctggagaacattgtgcacaagtacggcatggtgttgctggagatattgacaggaaaagttccttgttctgaggatgatgggccactggaaaactgggcgtctcgctattttgaaggtgagatgcgtcttgaggagttgattgactctagcatcggtttcttccccgaagacactgcacgtgccctttgtgaggttgtaagatcctgcattgatcgggatccaaagaagagaccgcagatgcaagaggttgcagctcggatgagagagatcaccgcgttggggcctgatggggcgactccgaaggtgtcaccgctctggtgggctgagcttgagatcatgtcttctgagagctga

SEQ ID NO: 20369 - protein, 510 aa, Sorghum bicolor
  misc_feature: Ceres ANNOT ID no. 8641668
  misc_feature: Up-regulated in root tissues in response to methyl jasmonate treatment
  misc_feature: Down-regulated in shoot tissues in response to salicylic acid treatment
  misc_feature (181)..(412): SWISSPROT Homolog: EC 2.7.11.1 Non-specific serine/threonine protein kinase
  misc_feature (224)..(480): Pfam ID: Pkinase_Tyr Pfam Description: Protein tyrosine kinase
MEPRRRRPPRLPLHVLFLVAAAWPLGSSGTGSFGVGAESNGASSSFRNSRRLQQIGDRNEDGLFHLPHPRTLTHKSRSHRRVPAPAPAPASAPAPSPSMSSPEGSPSPSPHGSQSMPRQSTSHRHPSVAPPHLVRPEPRQDENDPIVDTPPHSRHKNSWTTYGLVAAGIAVFLLVSAASILCFRAKKMGTVRPWATGLSGQLQKAFVTGVPSLKRSELETACEDFSNIIGSTSTCMLYKGTLSSGVEIAVASSLVTSAKDWSKENESQYRKKITSLSKVSHKNFMNLLGYCEEEHPFTRVMVFEYAPNGTLFEHLHVREAEKLDWMARLRISMGIAYCLEHMHQLKTPLVLRNFDSTTVYLTDDFAAKVSDLEFWNDAKGYNSTNNELAFSLDLENIVHKYGMVLLEILTGKVPCSEDDGPLENWASRYFEGEMRLEELIDSSIGFFPEDTARALCEVVRSCIDRDPKKRPQMQEVAARMREITALGPDGATPKVSPLWWAELEIMSSES

SEQ ID NO: 20370 - DNA, 2901 bp, Sorghum bicolor
  misc_feature: Ceres ANNOT ID no. 8641669
  misc_feature: Up-regulated in shoot tissues in response to methyl jasmonate treatment
  misc_feature: Up-regulated in root tissues in response to methyl jasmonate treatment
  misc_feature: Encodes the peptide sequence at SEQ ID NO 20371
atgaccaataacttcctcacgacgataaagagcctgaagctgatcgagggttgcaaggccgctcaattatacgccttaagctccgtcggagcctccacgtccggctcggcggattccggcgtgagcagcatcggcaagccccatcccccgcctcctccaaaggccatctcgatgcggtccggatcgctctactacccgcacgcggcgccgtccacgtcgggggccttcgtaccagagccgcacctgccgtgcggcctcccggtggccgacgcgctcgagccggccctggacgcgtgcctgcgacccgtcgaccacgtcggcgcgctcgccgcgtcgtaccggcgggtctcggccgccacgtccggggccgacgacgacctctgcgacgcgtacctggagcagcacgcgctgttccagtcgatcggcgacgcgcggctgatccggcgggcgctgcgtgctgcgcgcgtccacgcggacaacccgcaccggcgcgccgtgctcgccgcgtggctccggtaccagcgccgcgaggacgagctcgacccggcgccgccgccgctcgcgccctgcaccgcgacgacaccgctgctcgagtgcccccgcgccgcggtcttcgccagcgtgtcccacagcgtggacccggtctgcccgtgccgccgcccgccgcctcctcccgtcacccctccaccgcaccgcctcaggcgcagcacgtcggccgccgcctccgagatgagcgaggaggaggagccggagaccaatgacctgtggttcatcatcggcgaggaggaggtggcgtgcgaccgctcgtgcattgcggcgctctctaagccgctcaacacactcctctacggcgggttcgccgaggcgcaccgcgaccggatcgacttctcccgcgacggcatcacgccgcgcggcatgcgcgcggtctccgcctacagccgccacggccgcgtggacgacttcccgcccgacatcatctcccagctcctcgcgttcgccaacaagttctgctgcgagggcctgaaggcggcctgcgacaaccagctcgcagccatggtgcggggcctcgacaacgcccgatccctcatcgacatcggcctcgaggaggcctcccacctcctcgtggcctcctgcctccaggcgttcctgcgggagctccccaagtcgctcacctacccggacatcgcgcgcctgctctgcagcccggaggggcgagagcgccttgacatttccggtaacgcgtccttcgcgctctactacttcctctcttacgtcgccatggagcaggacatgaggtccaacaccacggtgatgctgttggagaggctgaatgaattcgcggagcagccatggcagaagcagctggcgctgcaccagctcgggtgcgtgatgctgcagcgcggcgagtttgaggaggcgcaggagtggtttgaggccgccgttgccgagggccatgtctactcgctcgccggagaggcgcgcgccaagtacaagcgcgggcacaagtacgctgcgtacaagctgatgaacagtgtcgtcggcgactacgacgaacccgccgggtggatgtaccaagagcgctccctgtactgtgtcggcaaggagaagctggctgatctgcaggcggcgacggagctggacccgacgatgacattcccgtacaagtatcgtgcttgcgcgttgttggaggaggacaatgccgagtccgcggtcgcagagatcagcaaggtcgtcggtttcaagatggcgaccgattgcctggagctccgggcgtggttctaccttgcgcttgagcaatgcgagctggctgtgcaggatgtcagggcgatactgacgttggatccaacttacatgatgttccatgggagaatgcatggggaacagctgattgagctcctccgaggacaggtgcggcagtgggatatggcagattgctggatggagctgtacgatcggtggtcggcggtggatgacatcggctctctggcggttgtccagcagatgctcgctagggaaccgggaaacagcagcttgcggtttcgacagtcacttctcctgctaaggctaaattgtcagaaagctgccatgcgtagtttgcgatatgctcggaacagttcactccatgagcatgagaggcttgtctatgaagggtggattctgtatgacagtggacatcgggacgaagcattagccaaggctgagcagtcgattggacttcaaagatcattcgaagccttcttcctgaaggcgtatgctttaggagattctagcctcgacacagaatcttcgctctccgttgtacagcttctggaacatgctaacagttgtgcttctgacaaccttcggaaggggcaagcatacaacaacatggggagcatctacgtggactgtgacatgctggatgaggctgccgagtgctacggcatagcactgaacataaagcacacacgggcgcatcagggtctagctcgagtccattacttgaaaaataggaaaaaggttgcatatgaggagatgacgaagctcgtgcagatagctagcaacagcgcatcggcgtatgaaaaacggtcagaatatggtgagcgcgacgctgcaaggaacgacctgaacacagcgacgcttcttgatcctacaaggacatatccttacagatacagagcagctgttttgatggacgagggcaaggaagaggaggcgatcgcggagctgtcaggagccatagctttcaagccggacgtccagctgctccacctccgcgcggccttcttcgactccatgggcgacaccgagagcgccctgcgggactgcgaggccgcgctctgcctagacccgacccacggcgacacgctggagctgtacagcaaagcctcctccaccaaggccgacgaaccccagagctag

SEQ ID NO: 20371 - protein, 966 aa, Sorghum bicolor
  misc_feature: Ceres ANNOT ID no. 8641669
  misc_feature: Up-regulated in shoot tissues in response to methyl jasmonate treatment
  misc_feature: Up-regulated in root tissues in response to methyl jasmonate treatment
MTNNFLTTIKSLKLIEGCKAAQLYALSSVGASTSGSADSGVSSIGKPHPPPPPKAISMRSGSLYYPHAAPSTSGAFVPEPHLPCGLPVADALEPALDACLRPVDHVGALAASYRRVSAATSGADDDLCDAYLEQHALFQSIGDARLIRRALRAARVHADNPHRRAVLAAWLRYQRREDELDPAPPPLAPCTATTPLLECPRAAVFASVSHSVDPVCPCRRPPPPPVTPPPHRLRRSTSAAASEMSEEEEPETNDLWFIIGEEEVACDRSCIAALSKPLNTLLYGGFAEAHRDRIDFSRDGITPRGMRAVSAYSRHGRVDDFPPDIISQLLAFANKFCCEGLKAACDNQLAAMVRGLDNARSLIDIGLEEASHLLVASCLQAFLRELPKSLTYPDIARLLCSPEGRERLDISGNASFALYYFLSYVAMEQDMRSNTTVMLLERLNEFAEQPWQKQLALHQLGCVMLQRGEFEEAQEWFEAAVAEGHVYSLAGEARAKYKRGHKYAAYKLMNSVVGDYDEPAGWMYQERSLYCVGKEKLADLQAATELDPTMTFPYKYRACALLEEDNAESAVAEISKVVGFKMATDCLELRAWFYLALEQCELAVQDVRAILTLDPTYMMFHGRMHGEQLIELLRGQVRQWDMADCWMELYDRWSAVDDIGSLAVVQQMLAREPGNSSLRFRQSLLLLRLNCQKAAMRSLRYARNSSLHEHERLVYEGWILYDSGHRDEALAKAEQSIGLQRSFEAFFLKAYALGDSSLDTESSLSVVQLLEHANSCASDNLRKGQAYNNMGSIYVDCDMLDEAAECYGIALNIKHTRAHQGLARVHYLKNRKKVAYEEMTKLVQIASNSASAYEKRSEYGERDAARNDLNTATLLDPTRTYPYRYRAAVLMDEGKEEEAIAELSGAIAFKPDVQLLHLRAAFFDSMGDTESALRDCEAALCLDPTHGDTLELYSKASSTKADEPQS

SEQ ID NO: 20372 - DNA, 2994 bp, Sorghum bicolor
  misc_feature: Ceres ANNOT ID no. 8641792
  misc_feature: Up-regulated in shoot tissues in response to methyl jasmonate treatment
  misc_feature: Up-regulated in root tissues in response to methyl jasmonate treatment
  misc_feature: Encodes the peptide sequence at SEQ ID NO 20373
atggcgagcattgcgcgcggcagatcgcgacggagacagggcgacgggtcgtcggaccggaatgcggcgcactccaccgttcctaaccccgatcaccaaggggttgtgtcctctacgaaacaagcaacttaccctgggatgctctctgattctgagtttgctgacgtaaacaggcaaagtaaatcaagaaaagccagtgctgtaccaatgaaagtactgatagacgaagaattttcaaatgatgtcaatgctaggcacatttcaccaggtgctgtaggaaggctcatgggtcttgattcgttgccctcatctggaatccataatcagcataggcatacccaaagtcatgcaccaaagacttcacctggtagttttcatgctcgaaatggtttacatgaagacattccacacaggagtagtgcagataccattgatgtttttgaagttatggaggccgcaaaaacaaagaagcaccggagtccaagatctaaaattggaaatacaacttccatatctgacaaggttgatagtgctgatatagatttcataaggcagaaatttatggatgctaagcgtctttctactgatgaatcccttcaaatgtcagaagaatttaacgagacacttgatgcactggtatctaacagggatcttttgttggaatttcttcaaaaatttgatcctgctgtcagaagggacctgcacaatcatggttctccatcctctgctgcaaactgcatcacgatattgaagccatctcgaagaaatcattttattgacatgcacaatatttatccacaagagaaaggtaccgagagcatcttcaacgagcaaaaggaagtgaaacattctttgaggaagccatgttctaatgtgcccttgcaatcccgagaagaagactcttgttcattaaggcagaaactgtcaaggtccagtcaccaggaaaatgctggaaaacgaggctgccctactcggattgttgtcttgaagccaaattttgacaaacctcatgatatcgaagaaacacttcctctacatcataaacccccccattctgattatagaagccacaaagaatgtccagaggttggtagatggactccgtatactgaagattacatgtgtcaggtgccccttggagattctgaaacattaaatcgtatggggaaggggtctagagaaattgctagggagatcaccaaacaaatgagagctgctaggggtgggagtaggaaacatgctgtcaaaccggagatcagaactcctgcttcagatgaaagatcacagttcctgccatctgttactaaactcaagactccagaggcaattcatagatattctgagccatgtgatgcttgggcttcttccagcctaaactcttcaccaacatattcgactgaaacatcagtaagcaaggaagcaaagaaacacctctctaacagatggaagaagacccatcagtgtcagcatcaagaaactgatagtgacagcttcagcacgcttggggatatgctttctctctctgatcagaatgcatcaaaggttgctacccataaaatgacatccaggaaatgtccaaaggcaggagtgcagagtgatagaatgcaaagctcatgtggcatcagcagcaatgatggttggagagacacagctactagtaaattgacaaggtccaagtctcttccatcatccttcatccgcggagttcaaaagtcaaacaacagaaaaagaactggtagtgttacgtacaatgagttctcgatgcttaaagatgttcttaaggttggaccccactattctgaacatgcatgtcgtagcaggcaaagacaatctctaagtagagattctacaattcatggtgatgaatctgatctgatgtccacagataatgaggaaaaaatggcagttgaacgtgagatacatgtaaattatgaggaaccaattaaaggtgctgctgtgacagaaacatctgggcagccacaacatccaaatcttgaccatgaactagatgcagtaggtatactggataccagttctgcactccctgtcagtaatacaagacctctttctcctgctggacagaaccagcaaatgcttaagatgaccacaacagcactagataactgccttcttgtgcctagtctcaatgatctgatggctaagcatgagcaagttgagtaccatgaagctgatgattacccggccacttatgatccccaggtaggatcagattctcgtgaggagattaatcatcacctgggggatgacaatcgaaccctctgtattccacctaatgaatccgaatcgccagcaaactccaataaagatgaccagcaaagtccagtgtctgttcttgaatcttccatggacgcagaagatagggagactacagacactggagatgagaacgagctttttatattgagtgatgatgagacagcacgtcaatcacttcctgaaatggaggaatcccattcttttaggaatatggaagaaagggatttctcctatgtgtttgatatgcttgttgctttgggcattgatgcgcccaatgaggatgagctgcttgacaactgctacttactggagtgtcctgcaggccttgatttatttgatgatcttgaaaagaagtacaccagcctcattttatggccacaacatgagaggaagctcttgttcgatatcacaaatgctgttcttggggacatgattacctccttaatgaacagttgctcaaagggattgaaggtgaggtggtcacctggatggaatcaggaagagtttgctgagcttgtgtggcaaagggtggtgcacgtacagcaggaaatagagtttaatcaggaagccctactcttgagtgtagagtgggttggttctgaagatggcaccaatctggttgggtgtgatatcgggagtatgttgcaagatgatctcctagaggaaattgtagctgactttctgggggcaactaaatccgccaggctccgtggctag

SEQ ID NO: 20373 - protein, 997 aa, Sorghum bicolor
  misc_feature: Ceres ANNOT ID no. 8641792
  misc_feature: Up-regulated in shoot tissues in response to methyl jasmonate treatment
  misc_feature: Up-regulated in root tissues in response to methyl jasmonate treatment
MASIARGRSRRRQGDGSSDRNAAHSTVPNPDHQGVVSSTKQATYPGMLSDSEFADVNRQSKSRKASAVPMKVLIDEEFSNDVNARHISPGAVGRLMGLDSLPSSGIHNQHRHTQSHAPKTSPGSFHARNGLHEDIPHRSSADTIDVFEVMEAAKTKKHRSPRSKIGNTTSISDKVDSADIDFIRQKFMDAKRLSTDESLQMSEEFNETLDALVSNRDLLLEFLQKFDPAVRRDLHNHGSPSSAANCITILKPSRRNHFIDMHNIYPQEKGTESIFNEQKEVKHSLRKPCSNVPLQSREEDSCSLRQKLSRSSHQENAGKRGCPTRIVVLKPNFDKPHDIEETLPLHHKPPHSDYRSHKECPEVGRWTPYTEDYMCQVPLGDSETLNRMGKGSREIAREITKQMRAARGGSRKHAVKPEIRTPASDERSQFLPSVTKLKTPEAIHRYSEPCDAWASSSLNSSPTYSTETSVSKEAKKHLSNRWKKTHQCQHQETDSDSFSTLGDMLSLSDQNASKVATHKMTSRKCPKAGVQSDRMQSSCGISSNDGWRDTATSKLTRSKSLPSSFIRGVQKSNNRKRTGSVTYNEFSMLKDVLKVGPHYSEHACRSRQRQSLSRDSTIHGDESDLMSTDNEEKMAVEREIHVNYEEPIKGAAVTETSGQPQHPNLDHELDAVGILDTSSALPVSNTRPLSPAGQNQQMLKMTTTALDNCLLVPSLNDLMAKHEQVEYHEADDYPATYDPQVGSDSREEINHHLGDDNRTLCIPPNESESPANSNKDDQQSPVSVLESSMDAEDRETTDTGDENELFILSDDETARQSLPEMEESHSFRNMEERDFSYVFDMLVALGIDAPNEDELLDNCYLLECPAGLDLFDDLEKKYTSLILWPQHERKLLFDITNAVLGDMITSLMNSCSKGLKVRWSPGWNQEEFAELVWQRVVHVQQEIEFNQEALLLSVEWVGSEDGTNLVGCDIGSMLQDDLLEEIVADFLGATKSARLRG

SEQ ID NO: 20374 - DNA, 804 bp, Sorghum bicolor
  misc_feature: Ceres ANNOT ID no. 8641848
  misc_feature: Up-regulated in shoot tissues in response to salicylic acid treatment
  misc_feature: Encodes the peptide sequence at SEQ ID NO 20375
atgaagtttagcacaatgcgctgctgcgtgctgcttgtctccttggctctgctcccgctgggcatggccgcggactccatcggcagctactgctcaggaagccgctacgcgggcagcaacaaggccgtgaccagcatcaactccgtcctcgccgacctcgtcgccacggcctccaccggaggcggctacgccacgtccaccgccggcaagggcaacaacatcatctacggcctcgcgcaatgccgcggcgacgtctccgccagcgactgcgcggcctgccttgccgacgccgccaagcagctccccagcacttgcagctacagttccgacgccagaatatggtatgactactgcttcatgcggtacgagaacgccgacttcttcgggcaggcggacacgggcgcgggcgtgatcctggtgaacgtgcaggccatggacaacccgaaggcgttcgagaaggcggtgggaaaagtgatcggcaaggcgacggcgcaggcgtcggcggcgggcagcgcggggctcgggcgggacaaggatcagtacacgccgttcgtgtccatctacgggctggcgcagtgcacgcgggacctcgcgccgctgacgtgcgcgcagtgcctgtccacggcggtgtccaggttcggcgactactgcggcgcgcagcaggggtgccagatcaactacagcagctgcagggtgcgctacgagatctaccccttctacttcccgctcgccggcaacggcggcgccggcggccgcgccaccaccgatatgacgaagaacaccaagatcatcgtgcatccttga

SEQ ID NO: 20375 - protein, 267 aa, Sorghum bicolor
  misc_feature: Ceres ANNOT ID no. 8641848
  misc_feature: Up-regulated in shoot tissues in response to salicylic acid treatment
MKFSTMRCCVLLVSLALLPLGMAADSIGSYCSGSRYAGSNKAVTSINSVLADLVATASTGGGYATSTAGKGNNIIYGLAQCRGDVSASDCAACLADAAKQLPSTCSYSSDARIWYDYCFMRYENADFFGQADTGAGVILVNVQAMDNPKAFEKAVGKVIGKATAQASAAGSAGLGRDKDQYTPFVSIYGLAQCTRDLAPLTCAQCLSTAVSRFGDYCGAQQGCQINYSSCRVRYEIYPFYFPLAGNGGAGGRATTDMTKNTKIIVHP

SEQ ID NO: 20376 - DNA, 804 bp, Sorghum bicolor; identical to SEQ ID NO: 20374
  misc_feature: Ceres ANNOT ID no. 8641842
  misc_feature: Up-regulated in shoot tissues in response to salicylic acid treatment
  misc_feature: Encodes the peptide sequence at SEQ ID NO 20377

SEQ ID NO: 20377 - protein, 267 aa, Sorghum bicolor; identical to SEQ ID NO: 20375
  misc_feature: Ceres ANNOT ID no. 8641842
  misc_feature: Up-regulated in shoot tissues in response to salicylic acid treatment

SEQ ID NO: 20378 - DNA, 2283 bp, Sorghum bicolor
  misc_feature: Ceres ANNOT ID no. 8641893
  misc_feature: Down-regulated in shoot tissues in response to aminocyclopropane carboxylic treatment
  misc_feature: Up-regulated in root tissues in response to salicylic acid treatment
  misc_feature: Encodes the peptide sequence at SEQ ID NO 20379
atggacgacgaggcggccaagtctgttcctacatcagacatgaataccgacgctgccgcggaagccgaggcggccgccgctccgctgcggccctcgagctctgaagcggcggagagggaggcaaaggttgagggcgcggatgaggagggccaggtggttgagcgattggtcgagctggtgagcgagatcgcgaccatctcggacttcaggaactcgtacaggcggcagttctgcaacctgtcccggcggatccggctcctcgtgcctatgctggaggaggccaaggaagcgcccgcgccgcttccggcggcgtcggaggccgcgctacggcggctcagggacgcgctccacgccgccagggagctgctccggctcggcagcagcggcagcaagatcttcctggttcttgatagagagaaaataatgaagactttccaggatgttactgcaagacttgaacaagccttagctggtatttcgtttgatgaacttgatatatctgatgaagtaagagagcaggttgaattggtgcatactcagttcaaaagagctaaggaacgatcagattcatctgatgatgatctttttaatgagctgatgtctctctataattcaagcagcagtgctagtgttgacccagatattcttcgaaggttatctgagaagttgcagcttgtcacaatatatgacctcaatcatgagtctctgaccttgcatgagatggctagaggcggtgatcctggtgcagttgttgaaaagatgtcaatgctcctcaaaaggattaaggattttgtgcagacagaagaccctgagatgggcgctcgagcaagtacagcaaacattttcccaaaagacaactcagcacgtcctgttattcctgatgatttccgttgcccaatatcactggatttaatgagcgacccagttattgttgccactgggcagacttatgagcgggggtacatagagatgtggctggaggctggccatgatacctgtccgaagacacagcagaagcttgctaataaatccctgactccaaattatgtcctacgtagcctcataactcaatggtgtgaggcaaatggtattgaacctccaaaacgccctgctcaacttaaggatgcaccattgccatgtagtgctgctgaacatagcaatgttcttgagcttcttcagaaactgtcatcccaaaaccttgaagatcaacgtggcgctgctggtatgcttcgtcagcttgccaagcgcagtgctgaaaatcgtgcttgtattggagatgctggtgctattcctattcttgttagtatgctatcaaccactgatgttagcacccaggaacacgtggttactgctctcttgaatctttccatctatgaagagaacaaggcaaggataatctcttctggagctgttcctggaattgtgcacgtattaaagaggggcagcatggaggctcgggagaattcagccgccacactgttcagcctatctattgtagatgagaacaaggtgactattgggtgctcaggggcaattcctgcgcttgtgcagctattgagtgacggaagccaacggggtaaaaaggatgcagcaacagcactatttaacttgtgtatttaccagggcaacaagcggaaagctgttagagctggattggtacctatactactagaactactcatggagtctgaaagtgggatggtagatgaggcccttgcaatattggcaatcctctcaggccaccctgaggggaaagcagctattggtgctgcttctgcaatacctgtacttgttggagttatcagaactggatctccaaggagcaaggaaaatgctgctgctgttatggtgcatctatgcaatggcgaaggagaacagcagcaacagcatcttgctgaagcacaagagcagggcatcgtgtctttgctggaggaactagcagaaagtggcacggacagaggaaagaggaaagctgtgcatctgctcgaacgaatgaatcggttcctaaagcggcagagtcaagcccaagccgaagcagaggccatggcacaggctcacgcgcacaggcacaggcacaggcacaggcacaggcacaggcacaggcacaggcacagcctcagatcctggttcaagctgaagcacacgcagatatgcaagctgagcgatcactacttcccacttcaccagatatttctgatagatgaggtttttgatcagcagcttgttttgtctagtggaagattgcctgcaattgttattgtggaggtttctggtttctgttga

SEQ ID NO: 20379 - protein, 760 aa, Sorghum bicolor
  misc_feature: Ceres ANNOT ID no. 8641893
  misc_feature: Down-regulated in shoot tissues in response to aminocyclopropane carboxylic treatment
  misc_feature: Up-regulated in root tissues in response to salicylic acid treatment
  misc_feature (417)..(457): Pfam ID: Arm Pfam Description: Armadillo/beta-catenin-like repeat
  misc_feature (499)..(539): Pfam ID: Arm Pfam Description: Armadillo/beta-catenin-like repeat
  misc_feature (581)..(621): Pfam ID: Arm Pfam Description: Armadillo/beta-catenin-like repeat
  misc_feature (292)..(365): Pfam ID: U-box Pfam Description: U-box domain
MDDEAAKSVPTSDMNTDAAAEAEAAAAPLRPSSSEAAEREAKVEGADEEGQVVERLVELVSEIATISDFRNSYRRQFCNLSRRIRLLVPMLEEAKEAPAPLPAASEAALRRLRDALHAARELLRLGSSGSKIFLVLDREKIMKTFQDVTARLEQALAGISFDELDISDEVREQVELVHTQFKRAKERSDSSDDDLFNELMSLYNSSSSASVDPDILRRLSEKLQLVTIYDLNHESLTLHEMARGGDPGAVVEKMSMLLKRIKDFVQTEDPEMGARASTANIFPKDNSARPVIPDDFRCPISLDLMSDPVIVATGQTYERGYIEMWLEAGHDTCPKTQQKLANKSLTPNYVLRSLITQWCEANGIEPPKRPAQLKDAPLPCSAAEHSNVLELLQKLSSQNLEDQRGAAGMLRQLAKRSAENRACIGDAGAIPILVSMLSTTDVSTQEHVVTALLNLSIYEENKARIISSGAVPGIVHVLKRGSMEARENSAATLFSLSIVDENKVTIGCSGAIPALVQLLSDGSQRGKKDAATALFNLCIYQGNKRKAVRAGLVPILLELLMESESGMVDEALAILAILSGHPEGKAAIGAASAIPVLVGVIRTGSPRSKENAAAVMVHLCNGEGEQQQQHLAEAQEQGIVSLLEELAESGTDRGKRKAVHLLERMNRFLKRQSQAQAEAEAMAQAHAHRHRHRHRHRHRHRHRHSLRSWFKLKHTQICKLSDHYFPLHQIFLIDEVFDQQLVLSSGRLPAIVIVEVSGFC

SEQ ID NO: 20380 - DNA, 2553 bp, Sorghum bicolor
  misc_feature: Ceres ANNOT ID no. 8641932
  misc_feature: Down-regulated in shoot tissues in response to salicylic acid treatment
  misc_feature: Encodes the peptide sequence at SEQ ID NO 20381
atggcgctaacctcccaaggcatcaccctgcgttccccgccagcggggccccgcggccacggcgggaggcggtcctcttccgtgcccgccgccgcggtcccgcgcggctgggggcagcatcacgcggggcaagccttatccatctcgcccgccaggtacgaacccgccgctcgcccaccacggggtggctcctcctcctccgccatacgcgccgccgcctcggccggcgcgcagcccggcagcgacccggtccccgccgagcccagaatcgagctccccgcgatatttaccgtcttctctgaggccgctaagaccggcgctgccttcttcatcgcctcgtcgggcgcggcctttcttctcgggtcgtttggggggttcggaggcggcgctgggggtctcttcggcggcggtggcggagggggtggatggggcgcggggggtgccggtggcggagggggtggagacttcttgtcccggctgttctccgtcggcgcggcgcacgcggatgacaagtcgtcgggggattgggacgcgcacgggctccccgtcaacatgacggtgccgctcacgaagctgagcgggctgaagaggtacaagctgtctgagctcaagttcttcgaccgtgcagctgccggcggtggtgcctacacggggccggaggattccttcttcgaaatggtgacattgcagcctggtggtgtgtacaccaagtcgcagctgctgaaggagctcgagacactcgtctcctgtggcatgtttgagcgggttgatctggaggtgaagcccaagccggataacacaattgggctcacagtctccttcgtggagagtgtgtggagtgccgcaaagcagttcaagtgcatcaatgtggggctcatgtcacagtcaggacaggttgacttcgaccaggacatgacagagagggagaaaatggattacctccgcaagcaggaacgtgattaccagcagcgtgtacggggtgctaagccctgcatcttaccagaaaatgtacgtggagaggtgctgggaatgatgaagaagcaggagaaggtgagcgccaggatgctgcagaagatcagggaccatgtccagaaatggtaccacaacgagggtttcgtatgcgctcaggtggttaactttggaaaccttaacaccaatgaggttgtgtgtgaggtggtcgagggtgacatcaccaaggtggagtaccagttccaggataagcttggaaatattgttgagggaaatacccagcttccgatcatagaccgagagctgccccaacagcttcgacctggccacatctttaacattggagcagggaaacaggctctgaagaatataaattcacttgctttgttttccaatatagaagttaatccacgtcctgatgagacaaaggaagggggcatagtagttgaaattaagctcaaggagctggaacccaagtcagctgaagtaagcacagaatggagtattgtacctgggcgtgaaggccgaccaactttggcatccatacaacctggaggaactgtgtcatttgagcaccggaacatctatggtcttaatagatctattgttggttctgttacatccagcaacctgctgaaccctcaggatgatctttcattcaagcttgagtatgttcatccttatttggatggtgtggatgatcgtagtaaaaaccgcacattcaaaactagctgcttcaacacgaggaaattgagtcctgtctttgttgctggtcccaacatggatgaggctccacctgtttggatcgatagagttggatttaaagccaacataacagagagcttcacacggcaaagcaaattcacatatggccttgtggttgaagagattacaacacgtgatgaaactaattctatctgcacccatggttctcgagcaatgcctagcggcggtttgagcatggatggacctcccacaaccctcagtggtactggagttgaccgaatggcattccttcaggctaatataacccgcgacaatactgagtttgtgaatggtgcaattgttggagacagatacatttttcagttagaccaaggtctcggcatcggaagcaaaaacccattcttcaaccgtcatcaacttactctgaccaagttcatcaatttaaataagcaagagaaaggtgctggcaagccactaccagctgttttagttcttcatggtcattatgctggctgtgtgggtgatttgccaagctatgatgcgttcgcacttggagggccttactctgttaggggctttagtaacggtgaactgggcgcttctaggaatattcttgaggttgctactgagttgcgcatccctgtaagaaacacacacgtttatgcatttgctgaacatgggactgaccttgggagttccaaggatgtgaaaggaaaccctacagagtttttcaggcgtgttggtcatggatcttcatatggtgttggtgtcaagcttgggttggtaaggggagagtacattgtagatcacaatgctggtaccggaaccattttcttcagatttggtgagagattttga

SEQ ID NO: 20381 - protein, 850 aa, Sorghum bicolor
  misc_feature: Ceres ANNOT ID no. 8641932
  misc_feature: Down-regulated in shoot tissues in response to salicylic acid treatment
  misc_feature (517)..(850): Pfam ID: Bac_surface_Ag Pfam Description: Surface antigen
MALTSQGITLRSPPAGPRGHGGRRSSSVPAAAVPRGWGQHHAGQALSISPARYEPAARPPRGGSSSSAIRAAASAGAQPGSDPVPAEPRIELPAIFTVFSEAAKTGAAFFIASSGAAFLLGSFGGFGGGAGGLFGGGGGGGGWGAGGAGGGGGGDFLSRLFSVGAAHADDKSSGDWDAHGLPVNMTVPLTKLSGLKRYKLSELKFFDRAAAGGGAYTGPEDSFFEMVTLQPGGVYTKSQLLKELETLVSCGMFERVDLEVKPKPDNTIGLTVSFVESVWSAAKQFKCINVGLMSQSGQVDFDQDMTEREKMDYLRKQERDYQQRVRGAKPCILPENVRGEVLGMMKKQEKVSARMLQKIRDHVQKWYHNEGFVCAQVVNFGNLNTNEVVCEVVEGDITKVEYQFQDKLGNIVEGNTQLPIIDRELPQQLRPGHIFNIGAGKQALKNINSLALFSNIEVNPRPDETKEGGIVVEIKLKELEPKSAEVSTEWSIVPGREGRPTLASIQPGGTVSFEHRNIYGLNRSIVGSVTSSNLLNPQDDLSFKLEYVHPYLDGVDDRSKNRTFKTSCFNTRKLSPVFVAGPNMDEAPPVWIDRVGFKANITESFTRQSKFTYGLVVEEITTRDETNSICTHGSRAMPSGGLSMDGPPTTLSGTGVDRMAFLQANITRDNTEFVNGAIVGDRYIFQLDQGLGIGSKNPFFNRHQLTLTKFINLNKQEKGAGKPLPAVLVLHGHYAGCVGDLPSYDAFALGGPYSVRGFSNGELGASRNILEVATELRIPVRNTHVYAFAEHGTDLGSSKDVKGNPTEFFRRVGHGSSYGVGVKLGLVRGEYIVDHNAGTGTIFFRFGERF

SEQ ID NO: 20382 - DNA, 1509 bp, Sorghum bicolor
  misc_feature: Ceres ANNOT ID no. 8641947
  misc_feature: Up-regulated in shoot tissues in response to salicylic acid treatment
  misc_feature: Up-regulated in root tissues in response to salicylic acid treatment
  misc_feature: Encodes the peptide sequence at SEQ ID NO 20383
atgcgtcaaccacgtagaccgggccccgcccgcctccccctccccacacaaccaacgtgccacgcgaccccaccccctcgacctcgagccacagcgaccgtggcgaaacaccaaacaccgcgcgccgggccggccgaaccgccccccgtccccgttgatactcgtggcacgcagccgcgcgccccagctcgctaccgcctggtggacgcgcccacgcgtcgacacgcgtcccgcgggcacgtaccggccacgggcgcgcgtcacgtggggcgtatccgacggcttcgacaactgtacgggggccggctcggcgggccgcgtggcgtggcggcgaccgggtcggaccggaagggggagtgcgtcggcggggacgccggcagccgagcggcgcggaagcggaggatggagatccggcggctcagggtggtggccgaggaggcgtccgccaagaggcggaggctggaggcggatgaggaagacgcggtaaggagaccggcgccgaggtacggcgtgacgtcggtctgcgggcggcggagggacatggaggacgcggtgaccacccggcttgggttcatcgacggccaccacttctttggggtgttcgacggccacggctgctcacacgtggcgacgtcgtgcgggcagcggatgcaccagatcgtggccgaggaggcgaccgccgccgcgggctcgtcggcttcggacgacgcggcgcggtggagggatgtcatggagaagagctactcgaggatggacgccgaggccgtcggctccagggacaccgccggcccggcgcccacctgccgttgcgagatgcagcttcccaagtgcgaccacgtgggctccacggccgtcgtcgccgtggtggggccacgccacctcgtcgtcgccaactgcggcgactcccgcgcggtcctctgcagcggaggcgccgcgatccctctctctgatgaccacaagcctgaccgccccgacgagctggaacggatccacgcagcgggagggcgcgtcatcttctgggacggcgcccgcgtcttcggcatgctcgccatgtcccgcgccatcggcgacagctacctgaagccgttcgtgatatcggacccggaggtgcgggtggtggagaggaaggacggcgaggacgagttcctgatcctggccagcgacgggctgtgggatgtggtgagcaacgaggtggcgtgcaaggtcgtgcgcacctgcctccggaacagagcgccgccgcacccgcacggcggggacggggagcgttcgagcccaacctccaacctgagccccaggcagagcagcggcagcggcagcagcagcggggacgaggagggcgctgggcccagcgacggcgcagggtccgagagcgacggcgacggcgagagcagcgaggacagggcgtgctccgaggcggccatcctgctgaccaagctagccctggcgcggcagaccgcggacaacgtcagcgtcgtcgtcgtcaacctcaggcggcgcaggaggtcgtga

SEQ ID NO: 20383 - protein, 502 aa, Sorghum bicolor
  misc_feature: Ceres ANNOT ID no. 8641947
  misc_feature: Up-regulated in shoot tissues in response to salicylic acid treatment
  misc_feature: Up-regulated in root tissues in response to salicylic acid treatment
  misc_feature (158)..(408): SWISSPROT Homolog: EC 3.1.3.16 Phosphoprotein phosphatase
  misc_feature (167)..(489): Pfam ID: PP2C Pfam Description: Protein phosphatase 2C
MRQPRRPGPARLPLPTQPTCHATPPPRPRATATVAKHQTPRAGPAEPPPVPVDTRGTQPRAPARYRLVDAPTRRHASRGHVPATGARHVGRIRRLRQLYGGRLGGPRGVAATGSDRKGECVGGDAGSRAARKRRMEIRRLRVVAEEASAKRRRLEADEEDAVRRPAPRYGVTSVCGRRRDMEDAVTTRLGFIDGHHFFGVFDGHGCSHVATSCGQRMHQIVAEEATAAAGSSASDDAARWRDVMEKSYSRMDAEAVGSRDTAGPAPTCRCEMQLPKCDHVGSTAVVAVVGPRHLVVANCGDSRAVLCSGGAAIPLSDDHKPDRPDELERIHAAGGRVIFWDGARVFGMLAMSRAIGDSYLKPFVISDPEVRVVERKDGEDEFLILASDGLWDVVSNEVACKVVRTCLRNRAPPHPHGGDGERSSPTSNLSPRQSSGSGSSSGDEEGAGPSDGAGSESDGDGESSEDRACSEAAILLTKLALARQTADNVSVVVVNLRRRRRS

SEQ ID NO: 20384 - DNA, 612 bp, Sorghum bicolor
  misc_feature: Ceres ANNOT ID no. 8641987
  misc_feature: Up-regulated in shoot tissues in response to salicylic acid treatment
  misc_feature: Encodes the peptide sequence at SEQ ID NO 20385
atggagccgggagccaaatcggaagcaaagcaaggtgaggcgagagcgggatctggtgcgggggcaagcggcagcggcggcggcagcatcaaggtgtatcatgagaggcagaggttgcaattctgtctcctccatgctctcaacaaccttatgcaggaaaaggaatgtttcacccgtgttgagttggatgagatcgctgggaatcttgttctcaatgatccaaacaagggccaatggactcctctatcattcatttttaaacctcaccacaatgttataactgggaactacgatgtaaatgttctcatcacagcattagaagctagaaagaagaaggtggtttggcatgatcgtcggaaaggggcatcatcaattgatctgaatgctgaagcattggtaggcctgatgatcaatgtgcctgtcaggaggttcagggggctctggactggcaggcattgggtggcaattcgaagcattgatggcgtctggtttaatctggacagtgatctttctgaacccaagcagtttaaggacaaagaaaatgtgattgggttccttgacagtgtgctcagtcaaggtggagaactcatggtcgtgctgcaagacgaataa

SEQ ID NO: 20385 - protein, 203 aa, Sorghum bicolor
  misc_feature: Ceres ANNOT ID no. 8641987
  misc_feature: Up-regulated in shoot tissues in response to salicylic acid treatment
  misc_feature (29)..(203): Pfam ID: Josephin Pfam Description: Josephin
MEPGAKSEAKQGEARAGSGAGASGSGGGSIKVYHERQRLQFCLLHALNNLMQEKECFTRVELDEIAGNLVLNDPNKGQWTPLSFIFKPHHNVITGNYDVNVLITALEARKKKVVWHDRRKGASSIDLNAEALVGLMINVPVRRFRGLWTGRHWVAIRSIDGVWFNLDSDLSEPKQFKDKENVIGFLDSVLSQGGELMVVLQDE

SEQ ID NO: 20386 - DNA, 2034 bp, Sorghum bicolor
  misc_feature: Ceres ANNOT ID no. 8642044
  misc_feature: Down-regulated in root tissues in response to methyl jasmonate treatment
  misc_feature: Down-regulated in shoot tissues in response to methyl jasmonate treatment
  misc_feature: Encodes the peptide sequence at SEQ ID NO 20387
atgtccaagaagctccagatgggggggcctaagcaggctaagggcgcgaccgacgacggcaagggtgacgtcgctggcgccgggggcagcgcagtgacggcgagcgccatcgcggcctcctacgacgaccagatccgcccgctgctcgacgcggtggacaggctgcgccacctcaaggtgacgcaggagggcatccagctgcccaccatcgtcgtcgtcggggaccagtccagcggcaagtccagcgtgctcgagtcccttgccggcatcagcctgccgcgcggccagggcatctgcacgcgcgtgcccctcgtcatgcgcctgcaggacgacccttccgcggattcgcccaaacttcagctggagtacagtaacggccgcgtggtgaccaccaccgaggccaacgtcgcggacgtcatcaacgccgccaccgcggagatcgccgggagcggcaagggcatctccgatgcgcccatcacgctagtcgtgcgcaagcgcggcgtgcccgacctcaccctcgtcgacctccccggcatcacgcgcgtgcccgtgcaggggcagcccgaggacatatccgaccaggtggccaagatcatcaaggagtacatcgccccgaaggagagcatcatcctcaacgttctctcggccacggtggacttcccgacgtgcgagtccatccgcatgtcgcagcaggtggaccgcaccggggagcgcacgctggccgtggtcaccaaggtggacaaggcccccgagggcctgcttgagaaggtcaccatggacgacgtgcacatcggcctcggctacgtctgcgtccgcaaccgtatcggcgacgagacgtatgaccaggcgcgcgtcgaggaggagcggctgttcaagtaccatccgttgctgtccgagatcgacaagtccatggtcggcatccccgtcctcgcccagaggcttatgcagatacaggccaccatcatcgccaagtgcctccccgacatcgtcaagcaaatcaacgagcgcctcagccgcagcagcgaggagctcgaccagatgccgcaggatctgaacaacgtcgccgatgcggtcagggtgttcttccacatcgtcaagcaggtctgcaactcactagagaaggtgctggtgaggggcgacttcgccgagtaccctgatgaccgcgagttccatggcacggcgcgcatcgccgagatgctgagtggatacgccaagagtctgcccgtgcagtgcccgacgaacactaacgaggcgtttctgatggaggaggtgcgtatcctggaggagacgaagggcatcaatctccccaacttcctgccaagatcagcgtttcttgtcttgttgaagaagaaggtggagaccattgatcaggtccctcaggaccttgtcaatggcgtctgggactacgtggaggagctggtgatgaaggttctgctgaagcactccgacaacttcccgcagatgcagtcgccgtgccgccgcgccgtgcagacgctgatggacaaggcgcggctgcgctcggcgcagcacgtcaaggagctgatcgccatggagctggtggcggactacaccgccaacccggactacatgaagacctggtcggagatcatggaagggtacgagaagttcatggaggccgtggaggacaagacgaagccgacgaggatcacactggaaggctttggcgaggtggacgtgtcgcatctcagggtgtacgctgacttcgcagggaaggcgttcgacctgagggcgcgcctgaccgcgtactggaagagcatagtgctgaggctcgttgatggcctggcgctgcatgtccttctcagcgtcaagctgctggtggagaaggacctcgaggaggagctcggcaacgagctgctgagcaacaagttcgccggggtggagaagatgctcgcgccgtcgccgagcactggaacgaagcgtgagcgcctgaagaagagcatcgtcctgctgcgtcagtccaaggaggtcgtggccaacatcatggacaggattagcgcggcgggtgaaatctag

SEQ ID NO: 20387 - protein, 677 aa, Sorghum bicolor
  misc_feature: Ceres ANNOT ID no. 8642044
  misc_feature: Down-regulated in root tissues in response to methyl jasmonate treatment
  misc_feature: Down-regulated in shoot tissues in response to methyl jasmonate treatment
  misc_feature (48)..(529): SWISSPROT Homolog: EC 3.6.5.5 Dynamin GTPase
  misc_feature (70)..(246): Pfam ID: Dynamin_N Pfam Description: Dynamin family
  misc_feature (253)..(553): Pfam ID: Dynamin_M Pfam Description: Dynamin central region
MSKKLQMGGPKQAKGATDDGKGDVAGAGGSAVTASAIAASYDDQIRPLLDAVDRLRHLKVTQEGIQLPTIVVVGDQSSGKSSVLESLAGISLPRGQGICTRVPLVMRLQDDPSADSPKLQLEYSNGRVVTTTEANVADVINAATAEIAGSGKGISDAPITLVVRKRGVPDLTLVDLPGITRVPVQGQPEDISDQVAKIIKEYIAPKESIILNVLSATVDFPTCESIRMSQQVDRTGERTLAVVTKVDKAPEGLLEKVTMDDVHIGLGYVCVRNRIGDETYDQARVEEERLFKYHPLLSEIDKSMVGIPVLAQRLMQIQATIIAKCLPDIVKQINERLSRSSEELDQMPQDLNNVADAVRVFFHIVKQVCNSLEKVLVRGDFAEYPDDREFHGTARIAEMLSGYAKSLPVQCPTNTNEAFLMEEVRILEETKGINLPNFLPRSAFLVLLKKKVETIDQVPQDLVNGVWDYVEELVMKVLLKHSDNFPQMQSPCRRAVQTLMDKARLRSAQHVKELIAMELVADYTANPDYMKTWSEIMEGYEKFMEAVEDKTKPTRITLEGFGEVDVSHLRVYADFAGKAFDLRARLTAYWKSIVLRLVDGLALHVLLSVKLLVEKDLEEELGNELLSNKFAGVEKMLAPSPSTGTKRERLKKSIVLLRQSKEVVANIMDRISAAGEI

SEQ ID NO: 20388 - DNA, 1161 bp, Sorghum bicolor
  misc_feature: Ceres ANNOT ID no. 8642125
  misc_feature: Up-regulated in shoot tissues in response to methyl jasmonate treatment
  misc_feature: Up-regulated in shoot tissues in response to salicylic acid treatment
  misc_feature: Encodes the peptide sequence at SEQ ID NO 20389
atggagaggagtaatagcagctggttcgggtggtggaggaagaaggcgcgggaggggcagggcggcggccgccgccgtgaccgtgagaaggtggtggtggacgggacggagatccgggagctggtggaggaccgggaggcgttcgggatgctcgtggacagcaagttccggcagctcgacgccgacggtcacggcatgctctccgtgagcgagctgcgccccgccgtggaagacatcggcgccgcgctcgggctgcccgcggagggggcgtcgcccaacaccgaccatgtctacgcagaggtggtgagcgagctgactcatgggacatcccagggggaggtgagcaaggccgagttccaggaggcgctgtcagacatactcctcggcatggcggccgggctcaagagggaccccctcgtgatactgcgcatggacggcgaggacctcagggacttcgtcgccggcagcagatacgaacccacagctgctgccgttttctcgaaggtcggtttcggttctgaagaagacgcgtcgtctctgcgtcagtgcgtgttggccgctctccagaagctgaccgtcgaccacggagtgccaccggcttcagacacctgggtcgcgaagaacatcgtagagccggcgttgcagcagcttcctgcggatcagcttgagcagcagccggcctcccgggacgacttgttccagcaactgaagaagctgctgtgcgccatcgctgatcgactccaggagcagcctgtgatcgtcgcgcacaccgagaaccactatgacgggagtggcgtcaagaggctgctggccaacaaattcgagttggacaagctgctggattctgtttggaaaggtttaccagtagaacataagaacaaggcgtccaaggagtacctcatagctgcgcttgataagatggccgatgctgcaagcctgccatactatggtgctgttaaagaggtggatgctgtcgtggacgagtcgatcaaaacagcgggcgtcgaagaaggaaaagcagcagatgaagcagagttcaagaaatcactcacagatatccttagggccatcatgctgaggctgaacgacaaacccgttttcgtctctaccaacatcgtcgtgcacgagcctttgtctggctcatccaccctattgaagtga

SEQ ID NO: 20389 - protein, 386 aa, Sorghum bicolor
  misc_feature: Ceres ANNOT ID no. 8642125
  misc_feature: Up-regulated in shoot tissues in response to methyl jasmonate treatment
  misc_feature: Up-regulated in shoot tissues in response to salicylic acid treatment
MERSNSSWFGWWRKKAREGQGGGRRRDREKVVVDGTEIRELVEDREAFGMLVDSKFRQLDADGHGMLSVSELRPAVEDIGAALGLPAEGASPNTDHVYAEVVSELTHGTSQGEVSKAEFQEALSDILLGMAAGLKRDPLVILRMDGEDLRDFVAGSRYEPTAAAVFSKVGFGSEEDASSLRQCVLAALQKLTVDHGVPPASDTWVAKNIVEPALQQLPADQLEQQPASRDDLFQQLKKLLCAIADRLQEQPVIVAHTENHYDGSGVKRLLANKFELDKLLDSVWKGLPVEHKNKASKEYLIAALDKMADAASLPYYGAVKEVDAVVDESIKTAGVEEGKAADEAEFKKSLTDILRAIMLRLNDKPVFVSTNIVVHEPLSGSSTLLK

SEQ ID NO: 20390 - DNA, 3084 bp, Sorghum bicolor
  misc_feature: Ceres ANNOT ID no. 8642146
  misc_feature: Down-regulated in root tissues in response to methyl jasmonate treatment
  misc_feature: Encodes the peptide sequence at SEQ ID NO 20391
atggatcgacgcagctggccttggaagaagaaatcatctgataaatcatcaaatgcagatgcgttgcataattctaatcatgcagaacaggaagataaagctccaaaatttgtgcaactttcacctgaaacatatgcacatcttactgagtcagaggaaaaagtaaaagttttagaagaaaatgtgaaggtcctgaatgaaaaactctctgcggcacaatctgagatcacaactaaagatgctcttgtgaagcagcatgcaaaagttgctgaagaagctgtatcaggttgggagaaagctgaagcagaggcctccgcactgaagcttcagctagaaactgttacattgtctaagctagcagctgaagaaagaggtgcacatctggatggtgcattgaaagaatgcatgaaacaagtaaggacagttaaggaagaaggtgagcagaagctacatgatgtagtctttgcaaaaaccaaacagtgggagaagataaaggccgagttcgaagcaaaattacttgaatttgaacaggaactcataagggctggtgctgagaatgatgcactcacaagatcactagaagagcgggcagaactgttgatgaaaattgatgaggaaaaagctcaagccgaagccgagattgaaatcttaaagagcacaatccaatcaggtgaaagggagataaattcactaaaatatgaattgcatgttgtctccaaagagcttgaaatccgcaatgaagaaaagaacatgagtgtgcgctcagccgatgtagcaaccaaacagcaccaggaagatgtcaagaaaatatcaaagcttgaagctgaatgccaaagattacgcggccttgttcgaaagaagttacctggccctgctgcactagctcagatgaaaatggaggtggagagcttgggtagagagtatggagaccacagagtacgacgatcccctgcaaagaattctagtttccatcggcctatgtctcctatgtctcctgttcctgattatgcaattgagaacatacaacaaatgcagagagagaatgagtttctgactgcccgtttattaacaatggaagaagaaaccaagatgcttaaagaggcattgacaaagagaaacagtgagctgcaatcgtcaagaagcatgtatgctaagacagcaggaaagctccgaagcttggaagttcaaatgttgactggaaaccaacataagagtccatcaactccaaacatggatattcactttgatggtgcactgagccaaaatggaagcaacccacctagcatgacttccatgtctgaagatggggtagatgatgaaggaagttgtacagaatcttgggccaacgctctggtatctgagctctctcaattaaaaaaagagaaggtggccaagagcagtgcgacagaaagctccaataggttggagctcatggatgacttcttagagatggagagattagcatgtctgtcttctgaagttaatggcaatggcagtactattgacaaaatgaagatagacgatgttggggctactttgtctggctctactgaaagagatggtgttaaagatttgcagtcagcttcaccaatgtcagaaactccatctaataaacagcgtctgtctgagaaatcttcgctttcgaaattccagtcaagaatatcttccttactggattctgaatcaccagagaataatgctggaaaggtacttgatagtatcagaaacattctaaaggatattgaagatgaggcagattcggtgaatgcaaatgggaccttaaattcagagagcaaatgtgccatggatcaagaacttaagaatgccatattgaagattcaggactttgtcaagttacttgatcaagaagtctccaagtttcaaggccagtcatctgattatgatgggctatgtgagaaaacacgacagttttctgcattagttgacaaagttctgtcaaacggtgatgtcctaaatgatattgtcatggcactgtctgttatattgtcagaaactagccagattaagttcacaatgttgagagacaatagcaatgaagcagaaagtaataacttagattgtgttgataaagtgactctacttgaaaataaggtgcagcccgagccagtaaaagacaatgtatctggtctctgcccactgttgcctcattcatcttctgatcctgagttcgaggggcctgctgatgctgcatttgatgttaagactgcagtgaaggtctgctcgccagaggaatatgaacaacttaaatctgagaagacaaatttggagggagaactagcgaagtgcaacgaaataatagaagaaacaaaggttagattaagtgatatggagaaaaacctggaagacctcagatctaagttggctgacagtgagaaatcaaatagcttgagtgagacacagctgaagtgtatggctgaatcttacaagtcacttgaatcaaggaaaattgaattagaaaatgagatagaagtgttacggtccaaaatagatgctttaacagctgaactctctgatgaaagacaaagtcatcaggaggacttagttaaatacagagatctcgaggagaagatggaaaggtatgagatggagaggagttcaatgcttgtggatgaggacccagacaccaagttaaaggagaaagagatagcggctgcagcagagaagctggcagagtgccaggagactatattgattcttggccgtcagctgcaagctatgcgtcctccagccgaatcactaggctcttcacctaatcggcaacgcatggaggagtttctgcaggacgctgtaggaacaaccgcaggagaatattcccagaagccttcaggccaacctgatacagaccaggagatacttgggacaggaaatgtgtctccagtcaatggatacaagacacacatgatcccttctgatgcggacgggagccctttcctttctcctaacagctccaagcgcccgaagcatcgatcgagatcctcttcgtcttcctcattcaccaatcacccgttgccagacaaacagagccgaggattcagccggttcttcgcgaagaccaaagagtga

SEQ ID NO: 20391 - protein, 1027 aa, Sorghum bicolor
  misc_feature: Ceres ANNOT ID no. 8642146
  misc_feature: Down-regulated in root tissues in response to methyl jasmonate treatment
  misc_feature (342)..(879): SWISSPROT Homolog: EC 2.7.11.1 Non-specific serine/threonine protein kinase
MDRRSWPWKKKSSDKSSNADALHNSNHAEQEDKAPKFVQLSPETYAHLTESEEKVKVLEENVKVLNEKLSAAQSEITTKDALVKQHAKVAEEAVSGWEKAEAEASALKLQLETVTLSKLAAEERGAHLDGALKECMKQVRTVKEEGEQKLHDVVFAKTKQWEKIKAEFEAKLLEFEQELIRAGAENDALTRSLEERAELLMKIDEEKAQAEAEIEILKSTIQSGEREINSLKYELHVVSKELEIRNEEKNMSVRSADVATKQHQEDVKKISKLEAECQRLRGLVRKKLPGPAALAQMKMEVESLGREYGDHRVRRSPAKNSSFHRPMSPMSPVPDYAIENIQQMQRENEFLTARLLTMEEETKMLKEALTKRNSELQSSRSMYAKTAGKLRSLEVQMLTGNQHKSPSTPNMDIHFDGALSQNGSNPPSMTSMSEDGVDDEGSCTESWANALVSELSQLKKEKVAKSSATESSNRLELMDDFLEMERLACLSSEVNGNGSTIDKMKIDDVGATLSGSTERDGVKDLQSASPMSETPSNKQRLSEKSSLSKFQSRISSLLDSESPENNAGKVLDSIRNILKDIEDEADSVNANGTLNSESKCAMDQELKNAILKIQDFVKLLDQEVSKFQGQSSDYDGLCEKTRQFSALVDKVLSNGDVLNDIVMALSVILSETSQIKFTMLRDNSNEAESNNLDCVDKVTLLENKVQPEPVKDNVSGLCPLLPHSSSDPEFEGPADAAFDVKTAVKVCSPEEYEQLKSEKTNLEGELAKCNEIIEETKVRLSDMEKNLEDLRSKLADSEKSNSLSETQLKCMAESYKSLESRKIELENEIEVLRSKIDALTAELSDERQSHQEDLVKYRDLEEKMERYEMERSSMLVDEDPDTKLKEKEIAAAAEKLAECQETILILGRQLQAMRPPAESLGSSPNRQRMEEFLQDAVGTTAGEYSQKPSGQPDTDQEILGTGNVSPVNGYKTHMIPSDADGSPFLSPNSSKRPKHRSRSSSSSSFTNHPLPDKQSRGFSRFFAKTKE

SEQ ID NO: 20392 - DNA, 1032 bp, Sorghum bicolor
  misc_feature: Ceres ANNOT ID no. 8642220
  misc_feature: Up-regulated in root tissues in response to methyl jasmonate treatment
  misc_feature: Up-regulated in shoot tissues in response to methyl jasmonate treatment
  misc_feature: Encodes the peptide sequence at SEQ ID NO 20393
atggcgcagcgcaaagttgccatggcggccgcagcgttcttcgcccttctcgccgtggcttcgctcctgtgcgcgccggccgccgcggggctggtccgcatggagcacccggccaagaacgacggctccctcagcctgctcgtcgtcggcgactggggccgcaagggcacgtacaaccagtccagggtcgcctatcagatgggcaaggttggggagcagctcaacatcgactttgtcatttccaccggggacaacttctacgagaacggcctgacgggcacggatgatcaagggttcgagcagtccttcaccgatatctacacggcgaagagcctgcagaagccgtggtacctggtactgggaaaccatgactacaggggtgatgcgctcgcacagctgagcccagtcctgcgaaagattgacagccgattcatttgcatgaaatcatttatcgttaatgcagaaattgtggacttcttctttgttgacaccactccgtttcaactcaagtactggactcaccctaaagatgatcactatgactggagaggagtggcacctcgagaaaaatacataaatattttgctcaaggatttggatgaggccatgaagaaatcaactgcggcgtggaagattgccgtgggccaccataccatgaggagtgtcagtgatcatggtgacactaaggagctactgcaactactgcttccagtccttcaggccaacggcgtcgatttctacatcaacgggcatgaccactgcctggaacacatcagcagcagagacagcccaatccaatacttcacaagcggaggcggttcgaaagcatggagaggagtgcaaaataccaacgaagatgacctcaagttcttctatgatggacaagggttcatgtccctccagctagaccatagcgaagcccatttcaccttttacgatgtcgatggagaggcactgtaccattacacgcggccgagcctgaggaaaactgcaggccacctccaagcctccggctatgtcaacgaggaatga

SEQ ID NO: 20393 - protein, 343 aa, Sorghum bicolor
  misc_feature: Ceres ANNOT ID no. 8642220
  misc_feature: Up-regulated in root tissues in response to methyl jasmonate treatment
  misc_feature: Up-regulated in shoot tissues in response to methyl jasmonate treatment
  misc_feature (37)..(325): SWISSPROT Homolog: EC 3.1.3.2 Acid phosphatase
  misc_feature (44)..(255): Pfam ID: Metallophos Pfam Description: Calcineurin-like phosphoesterase
MAQRKVAMAAAAFFALLAVASLLCAPAAAGLVRMEHPAKNDGSLSLLVVGDWGRKGTYNQSRVAYQMGKVGEQLNIDFVISTGDNFYENGLTGTDDQGFEQSFTDIYTAKSLQKPWYLVLGNHDYRGDALAQLSPVLRKIDSRFICMKSFIVNAEIVDFFFVDTTPFQLKYWTHPKDDHYDWRGVAPREKYINILLKDLDEAMKKSTAAWKIAVGHHTMRSVSDHGDTKELLQLLLPVLQANGVDFYINGHDHCLEHISSRDSPIQYFTSGGGSKAWRGVQNTNEDDLKFFYDGQGFMSLQLDHSEAHFTFYDVDGEALYHYTRPSLRKTAGHLQASGYVNEE

SEQ ID NO: 20394 - DNA, 1836 bp, Sorghum bicolor
  misc_feature: Ceres ANNOT ID no. 8642230
  misc_feature: Down-regulated in root tissues in response to aminocyclopropane carboxylic treatment
  misc_feature: Encodes the peptide sequence at SEQ ID NO 20395
atgggcgagatggtcgtggccgggtatggcatggacaaggctctgcgggccagcgtcagcttcgacacgccatgcggcgcgctgctgcgcgagcttgagcaaatatggacagagattggggagcgtgaacaagataaagatcgcatgttccttgaactggaaacagagtgcatgcgtgtataccgtcgaaaggttgatagtgccaatgctgagagagcgcagctccgccagtcattgatggccaaagaagcagagcttaaagctctagttgcttctataggggaaaatggcccacgatttacggtggatgaaaagcacacatcgttgaaagatcaacttgctgcagtgacacctctcttggaagatcttagagcaaagaaacaagacagaatcaaacaaatctcaaatgtgcaatctcaaatcgagaagataaaagcacaaatttctgatcacaattatcaggacagtgatggttccgtcaaacaacttaatgatgatcatgacttgtcaaccagaagaatttctgatcttcaaatgcaactgcgtaatctacagaaggagaagtctgatcgtcttcaaaaggtttttatatatgtggatgaagtgcactgcctatgtgcagtgcttgggatggattttgcaaagactgtaaaagaggttcacccaagtttgcatggagccaattctgaaaattcaacaaatattagtgataaaactcttgaaggtcttactcagactatcctgaagctcaaagcagaaaagaagacaagagttttaaagttgcaagagactgtagaaaaacttcacaagttatggaatctgatggagtcaactgaacaagagaggatacacttctctgaagtagctgctgttcttggatctactgaggaagaaatcaattctccaggcattctgtcattggagacaattcaggagactgaagaggaagttgaaaggctaactatacaaaaagctagtagaatgaaggagcttgttctcaagaaaaggttagaactagaagtcatctgcagaaatgcacacatggagcctgatatgagcacagcaccagagaagatcattgcgctgattgattccggtttagtggatccttgcgaactcctttccagcgttgaagtacagataacaaaagcaaatgaagagtccttaacaaggaaagatatcatggagagagtggataaatggctatcagcttgtgatgaagagacttggcttgaggaatataaccaagatgataataggtatagtgctggcaggggtgcccacttgaatctcaagcgtgcagaaaaggcaagaataactgtgcaaaagattccaactatgattgacaacttgatagccaaaacttttgcatgggaggatgaaagaaatgtgccatttttatatgatggagtccgtttggttgccattttggaagagcaaaaactcagaagggcacaaagggaggaagacaggagacgctgccgggaccagaagaagctgcacagtttattgcttaaggagaaggagttgattttcgggtccaaacctagtcctaaaaagacaagcagcttcaataggaggacaagcaaccaccatccaaatgcaaatggcactggattcatgactccggttccacgccgagtttcagctggcagtgccaccccagagcttctaaccccacgctcatattctggccggtacaacaactacttcaaggagaacaggcgtctgacaaccgcaccgctaaacttctcagttggttccaaggaggatagcatgtcatccttcgcatccattagtggctcggaacctgattcgccattgtttttgcactaa

SEQ ID NO: 20395 - protein, 611 aa, Sorghum bicolor
  misc_feature: Ceres ANNOT ID no. 8642230
  misc_feature: Down-regulated in root tissues in response to aminocyclopropane carboxylic treatment
  misc_feature (45)..(608): Pfam ID: MAP65_ASE1 Pfam Description: Microtubule associated protein (MAP65/ASE1 family)
MGEMVVAGYGMDKALRASVSFDTPCGALLRELEQIWTEIGEREQDKDRMFLELETECMRVYRRKVDSANAERAQLRQSLMAKEAELKALVASIGENGPRFTVDEKHTSLKDQLAAVTPLLEDLRAKKQDRIKQISNVQSQIEKIKAQISDHNYQDSDGSVKQLNDDHDLSTRRISDLQMQLRNLQKEKSDRLQKVFIYVDEVHCLCAVLGMDFAKTVKEVHPSLHGANSENSTNISDKTLEGLTQTILKLKAEKKTRVLKLQETVEKLHKLWNLMESTEQERIHFSEVAAVLGSTEEEINSPGILSLETIQETEEEVERLTIQKASRMKELVLKKRLELEVICRNAHMEPDMSTAPEKIIALIDSGLVDPCELLSSVEVQITKANEESLTRKDIMERVDKWLSACDEETWLEEYNQDDNRYSAGRGAHLNLKRAEKARITVQKIPTMIDNLIAKTFAWEDERNVPFLYDGVRLVAILEEQKLRRAQREEDRRRCRDQKKLHSLLLKEKELIFGSKPSPKKTSSFNRRTSNHHPNANGTGFMTPVPRRVSAGSATPELLTPRSYSGRYNNYFKENRRLTTAPLNFSVGSKEDSMSSFASISGSEPDSPLFLH

SEQ ID NO: 20396 - DNA, 4434 bp, Sorghum bicolor
  misc_feature: Ceres ANNOT ID no. 8642358
  misc_feature: Up-regulated in root tissues in response to methyl jasmonate treatment
  misc_feature: Up-regulated in shoot tissues in response to methyl jasmonate treatment
  misc_feature: Encodes the peptide sequence at SEQ ID NO 20397
atggcgtggggggaggacgaggccattggccccgacgtggcctcggcgggtcttcacgtctcggagcggatcggccgcgacgccgccgcgcagcccgacctggaggaggcccttgaagcctcgcgctacgcgtcccacccctactcctcgcaccccaaggagtggccttctttggtggaagttgcagaaactcgtcaacttcctcctatggtgattgaaagatataacacagttgccggtgaaggaacagctctttgcgggattttttctgacatacatcgggcctgggcaacagttgacaattcatttttcgtctggcgttttgataaatgggatgggcagtgccaagagcataatgttgatgatcaagcaatttgtgctgttggccttgctagggcaaagcctgggattttcattgaagccattcaataccttttagttttagcaactcctgttgagctgatacttgttggagtttgctgttctgcaagtgctgatggaacggacccatatgctgagctttcattacaacctttacccgagtacatgattgccactgatggtgtcacaatgacatgcatcacatgtacagacaaaggccaaatttttctagctggtcgcgatggccatatatatgaattgcagtatacaactggttcaggttggcgtaaacgctgccgtaaagtttgtcttactactggtattggcagccttctttctaggtgggtactgccaaatgcattcaaattctcaaccgttgatccaattgttgatatggtcatggatgaggagaggaacactatctatgcgcgtaccgagggcatgaaattgcaattatttgatctaggagctaatggtgatggccctttgacaaaaattgctgaagaaaagaacattgttgatccacgggatgcaccctatggtggtcggaggcctaatgcgcgaagagctgcacaatcaccaaaaccatcaattgtttgcatctcacctctatctgctatggaatcaaaatggctccatgctgttgctgttttatcagatgggaagagattattcctcactacatccggtgggagtggttcttctgttggattgaacagtggtctgcagaggccaacctgtttaaaaattgttgctactaggccgtccccacctctgggggttggtggtgggcttacatttggtgctgtttctgcggctggcagagctcatcctgaggatctagctttgaaagttgagtctgctttctattctgctggtgctcttataatgtcagattcatctgctacagccatgtcatctcttctggctgtgcagaaagattcagctgcgcagctatcccttcccagtaccttcggaacagcttctagaacctcccgagctctacgagaaacagtctctgctttgcctgttgagggtcgaatgctttgtgcctctgatgtcttaccacttcctgatgctgcttacacgatgcagtctttgtatgctgatgtggaatgcttcacaggtttcagaaaaccctctgagaaggcatgtataaaactgtgggcaaaaggagatcttcctacccagcacatcttgcctcggaggagggttgttgtattcaatactatgggtttgatggaggtaatttttaacaggcctgttgatattctaaggaaattgtttgatgggaacaccctgagatcacaaattgaagaattctttaatcgctttggtgctggagaggctgcagcaatgtgcttaatgctagctgcgaagctactttatgctgaagatagtctgataagcaatgctgtttctgagaaagctgctgaggcatttgaggaccctgggcttgttgggatgcctcaaattgatggcaccactgctttatctaatacacgaactcaagctggaggctttagtatgggccaagttgttcaagaagcagaacctttgttttctggtgcatacgaaggcctttgtttgtgctcgtcaagactactttatcccatatgggagctccctgttatggtgattcgaggaccggctggtactaataaacgcgaggatggcgtaattgtttgcaggctttcagctggggccatgaaaattcttgagagtaagattcattctctggaaacatttttaagatctagaaggaacaagagaaggggcctttatggtcatgttgctggtcttggcgattctggttccatactctacaaaacagggcctattattggtcctggagggcatatcaatggcaggagcccatacaactcccaaattcgagatatgaaccctgcagacaaatctgcatcaaataaaaagccaaggctactttatacatcagcagaactagctgctatggaggtgagggcaatggagtgtcttaggcggttgcttaggagatctggtgaagcactctttctgcttcaacttatttgccagcataatgttgcccgtttggctcagacgctgggcaatgatttacgcaagaaattagttcagttaacatttcatcaattggtatgttcggaggatggtgatcagcttgcaatgcgtcttatttctgcactcatggagtactatattggcccagagggcagaggaactgttgaagaaatcagtacgaagttgagggagggttgccctagttacttcaacgagtcagactacaaatattacttggcagtggagtgccttgagagagcatctatgactaataaccccgatgagagagatattcttgctagagatgctttcaacctcttgactaaaattccagactctgctgatttgagtgccatatgcaagagattcgagaacctaagattttacgaggctgtagtccggttgcctctgcagaaagctcaagcacttgactccaatgctgatgttatcaatggtcaaattgatccaaggcatcatgataccataatgttgcagcgtcaacaatgctatgagattgttatgaatgctctgcggactctcaagggtgtcgggcatagtcgaatgcaaagtgcagacaagtcatctggtctagcaactgctgttgatccagcttctcgaagcaagtacatcaaacaaattatccaacttagtgtccaatggccagacacagttttccatgagcatctatacagaacactaattgagctcggtctagaaaatgagcttttggagtatggtggttctgatttggtttcttttctgcagagtgctggtcgtaagcatcaggaagaggttcggtcaatttcttcagttacatctggagctgctaagttgcatgatttaggtgcacctatctcgactagtcaaacaaagtatcttgagctcctagctaggtactatgttcgcaagggggagcatattgctgctgccaggatgttgttaatattggcagagcgacagtgctccaattccgaagaagctccaactcttgacaagaggtatgaatatctcagagatgcagtgcttcaggccaaaagcgcaggcatctctgctgattcgtctagaaatcctattgatagtagcacagtggatttgcttgaaggcaaacttgccgtgctacgcttccaaatgcaaatcaaacaagaattggagctcatggctgcgcggattgaaaatattccaagcagttctgaatcacctagtgttccattccctcgggacaacattcttgccgacgcagagactgctaaggctgctaaggataaggcaaatgaactatcattgaatctcaagagtatcactcaactgtataatgattatgctgttccatttggtctctgggaggtttgcctggaaatgctgagctttgctaattactctggagacactgatagcaaaattgttcgagaaatttgggctagactccttgatcagacacttacaaaaggtggtgttgcagaagcatgttctgtggtgaaaagagtaggctcgaaacttgatcctgcagatggagcttgtttacctttagatataatatgccttcatcttgagaaggctgcattggatagattaagttcaggagaagaattagttggtgatgatgatgtttcaagagctcttcttggtgcctgtaaaggtcttcctgaacctgtacttgctgtatatgatcaactgttatctaatggtgcaatcataccctcactaaatctgaagttgcgcctgctgcgatcagttcttgcaatcctccgtgagtgggggatatctgtcgttgcacataggctaggcaccacaagtgctggggcttcattctttcttgatggaacattctcaatgaaccaaacagggactgcaaatcaaggtgctcgagataaaataattagtttggcgaacaggtacatgactgaggtgaggcgattaaaccttccacagaaccaaacggaggatgtctaccgcggtttccgtgaacttgaggagaaattactatctccttattag

SEQ ID NO: 20397 - protein, 1477 aa, Sorghum bicolor
  misc_feature: Ceres ANNOT ID no. 8642358
  misc_feature: Up-regulated in root tissues in response to methyl jasmonate treatment
  misc_feature: Up-regulated in shoot tissues in response to methyl jasmonate treatment
MAWGEDEAIGPDVASAGLHVSERIGRDAAAQPDLEEALEASRYASHPYSSHPKEWPSLVEVAETRQLPPMVIERYNTVAGEGTALCGIFSDIHRAWATVDNSFFVWRFDKWDGQCQEHNVDDQAICAVGLARAKPGIFIEAIQYLLVLATPVELILVGVCCSASADGTDPYAELSLQPLPEYMIATDGVTMTCITCTDKGQIFLAGRDGHIYELQYTTGSGWRKRCRKVCLTTGIGSLLSRWVLPNAFKFSTVDPIVDMVMDEERNTIYARTEGMKLQLFDLGANGDGPLTKIAEEKNIVDPRDAPYGGRRPNARRAAQSPKPSIVCISPLSAMESKWLHAVAVLSDGKRLFLTTSGGSGSSVGLNSGLQRPTCLKIVATRPSPPLGVGGGLTFGAVSAAGRAHPEDLALKVESAFYSAGALIMSDSSATAMSSLLAVQKDSAAQLSLPSTFGTASRTSRALRETVSALPVEGRMLCASDVLPLPDAAYTMQSLYADVECFTGFRKPSEKACIKLWAKGDLPTQHILPRRRVVVFNTMGLMEVIFNRPVDILRKLFDGNTLRSQIEEFFNRFGAGEAAAMCLMLAAKLLYAEDSLISNAVSEKAAEAFEDPGLVGMPQIDGTTALSNTRTQAGGFSMGQVVQEAEPLFSGAYEGLCLCSSRLLYPIWELPVMVIRGPAGTNKREDGVIVCRLSAGAMKILESKIHSLETFLRSRRNKRRGLYGHVAGLGDSGSILYKTGPIIGPGGHINGRSPYNSQIRDMNPADKSASNKKPRLLYTSAELAAMEVRAMECLRRLLRRSGEALFLLQLICQHNVARLAQTLGNDLRKKLVQLTFHQLVCSEDGDQLAMRLISALMEYYIGPEGRGTVEEISTKLREGCPSYFNESDYKYYLAVECLERASMTNNPDERDILARDAFNLLTKIPDSADLSAICKRFENLRFYEAVVRLPLQKAQALDSNADVINGQIDPRHHDTIMLQRQQCYEIVMNALRTLKGVGHSRMQSADKSSGLATAVDPASRSKYIKQIIQLSVQWPDTVFHEHLYRTLIELGLENELLEYGGSDLVSFLQSAGRKHQEEVRSISSVTSGAAKLHDLGAPISTSQTKYLELLARYYVRKGEHIAAARMLLILAERQCSNSEEAPTLDKRYEYLRDAVLQAKSAGISADSSRNPIDSSTVDLLEGKLAVLRFQMQIKQELELMAARIENIPSSSESPSVPFPRDNILADAETAKAAKDKANELSLNLKSITQLYNDYAVPFGLWEVCLEMLSFANYSGDTDSKIVREIWARLLDQTLTKGGVAEACSVVKRVGSKLDPADGACLPLDIICLHLEKAALDRLSSGEELVGDDDVSRALLGACKGLPEPVLAVYDQLLSNGAIIPSLNLKLRLLRSVLAILREWGISVVAHRLGTTSAGASFFLDGTFSMNQTGTANQGARDKIISLANRYMTEVRRLNLPQNQTEDVYRGFRELEEKLLSPY

SEQ ID NO: 20398 - DNA, 2391 bp, Sorghum bicolor
  misc_feature: Ceres ANNOT ID no. 8642378
  misc_feature: Down-regulated in shoot tissues in response to salicylic acid treatment
  misc_feature: Encodes the peptide sequence at SEQ ID NO 20399
atgctcatcctcgttttcctgctcttctccagcgtggacctccaaataagtggagcaaccgacacgctcaccttgggccagtctctcccatggaaccagacgctggtctccaagggcggcaacttcgagctcggcctcttctccccgggcaactccaagaagcactacatcggcatctggttcaagaaggtctccaagcaaaccgtcgtgtgggtggcgaaccgggaccgcccgatccttgacccgtcggcctctcgcttcactctcagcggccgcggcgagctcctcctcacgacgccatcgaacaccctgctgtggtcatccaacgcgtcctccccgtcgccgccgcgcagcaccgtcgccacgctccaggacgacggcaacctggtggtgcggagcaacgcgtcggcgtcggcgtcggcgtccgtggcgtggcagagcttcgaccaccccacggacacgtggctccccggggctaggctcggctacgacagggcccgcggcgtgcacagcttcctcacgtcgtggaccgactcggagaacccggctcccggcgccttctccatggagatcgaccggcgcgggcaggccaagtttgatctgctcgccggcggcacgaaccagtactggacgaccggcgtgtgggacggcgaggtcttcgccaacgtgccggagatgcggtcgggctacttcgacggcgtcccgtacgcacccaacgccagcgtcaacttcttcagctacaagaaccggataccgggcatcggcaacttcgtgctggaagtgaacgggcagatgcagcggcggcagtggagcccggaggcaggcaagtggatcctcttctgctccgagccccacgacgggtgcgacgtctacggctcctgcgggcccttcggtgtgtgcagcaacacctccagcgccatgtgcgagtgccccgcggcgttcgcgccgcggtcgcaggggcagtggaagctggggaacacggcctcagggtgcgtcaggcggaccaaactggactgtcccaacgacggcttcctcaagctgccgtacgccgtgcagcttccggtcggctctgcagagtcggccggagcccggagcgacaagatgtgtgctctctcctgcctgcgagactgctcctgcactgcctacgcctacgaggcaaccaagtgcttggtgtggaacggcgagctcgtcaacctgaggacactccctggcgatcaaggcgtcgcgggggcggttgttcttcacgtccgtgtggcggcctcggaggtgccacctcctgcgccgcatcattcttggaggaagtcaatagtgatccttagcagctcagtgtccgccgtggtcctactcctggcgggcctcataatcgttgtcgcggtggcggtggttttgcggaagcggcgggggaagggcaaggtgacggcggtgcagggctcgttgctgctgttcgactaccaggccgtgaaatcggcgacgcgggatttcacggagaagctcggcagcggcagcttcggctcggtgtacaaggggacgctccccgacacgacgcccgtggccgtcaagaagctcgacgggttgcggcagggcgagaagcagttccgtgccgaggtcgtcaccctcggcatgatccagcacatcaacctcgtccgtctccgcggcttctgctgcgaggggaacaagagggcgctcgtatacgactacatgcccaacggctcgctggatgcgcacctgttcaagaacagctcgagctccaaggtcttgagctggagcgagaggtttggcatcgcagttggcgtggccaggggtctgtcttacttgcacgagaagtgccgggagtgcatcattcactgcgacatcaagccggagaacatcctgctcgatgaggagctgggcgcgaagctcgcggacttcggcatggccaagcttgtcggccacgacttcagccgcgttctgaccaccatgcggggaacgatgggttatctcgcgccagagtggctcgcgggcgcgccggtcaccgccaaggccgacgtgtacagcttcggcctgctcctgttcgagctcgtctcgggccgccggaacaacggctcctcgcaggccgccgtgtacttcccggtgcacgccgccgtcaggctgcacgcgggggacgtggtcggcctgctagacgagaagatcgccggggatgccaacgtgaaggagcttgagaaggtctgcaaggtcgcgtgctggtgcatccaggatgaagaaagcgaccggccgaccatggggctcgttgtgcagcagctggaaggtgttgctgatgtcgacctgccgccgatcccgtcgcggcttcacatgctagcgatgatgaataacggtagcaaattagacaccgaagtgcaagtgtgtaacgagtag

SEQ ID NO: 20399 - protein, 796 aa, Sorghum bicolor
  misc_feature: Ceres ANNOT ID no. 8642378
  misc_feature: Down-regulated in shoot tissues in response to salicylic acid treatment
  misc_feature (477)..(762): SWISSPROT Homolog: EC 2.7.11.1 Non-specific serine/threonine protein kinase
  misc_feature (492)..(760): Pfam ID: Pkinase Pfam Description: Protein kinase domain
  misc_feature (66)..(183): Pfam ID: B_lectin Pfam Description: D-mannose binding lectin
  misc_feature (339)..(399): Pfam ID: PAN_2 Pfam Description: PAN-like domain
  misc_feature (197)..(322): Pfam ID: S_locus_glycop Pfam Description: S-locus glycoprotein family
MLILVFLLFSSVDLQISGATDTLTLGQSLPWNQTLVSKGGNFELGLFSPGNSKKHYIGIWFKKVSKQTVVWVANRDRPILDPSASRFTLSGRGELLLTTPSNTLLWSSNASSPSPPRSTVATLQDDGNLVVRSNASASASASVAWQSFDHPTDTWLPGARLGYDRARGVHSFLTSWTDSENPAPGAFSMEIDRRGQAKFDLLAGGTNQYWTTGVWDGEVFANVPEMRSGYFDGVPYAPNASVNFFSYKNRIPGIGNFVLEVNGQMQRRQWSPEAGKWILFCSEPHDGCDVYGSCGPFGVCSNTSSAMCECPAAFAPRSQGQWKLGNTASGCVRRTKLDCPNDGFLKLPYAVQLPVGSAESAGARSDKMCALSCLRDCSCTAYAYEATKCLVWNGELVNLRTLPGDQGVAGAVVLHVRVAASEVPPPAPHHSWRKSIVILSSSVSAVVLLLAGLIIVVAVAVVLRKRRGKGKVTAVQGSLLLFDYQAVKSATRDFTEKLGSGSFGSVYKGTLPDTTPVAVKKLDGLRQGEKQFRAEVVTLGMIQHINLVRLRGFCCEGNKRALVYDYMPNGSLDAHLFKNSSSSKVLSWSERFGIAVGVARGLSYLHEKCRECIIHCDIKPENILLDEELGAKLADFGMAKLVGHDFSRVLTTMRGTMGYLAPEWLAGAPVTAKADVYSFGLLLFELVSGRRNNGSSQAAVYFPVHAAVRLHAGDVVGLLDEKIAGDANVKELEKVCKVACWCIQDEESDRPTMGLVVQQLEGVADVDLPPIPSRLHMLAMMNNGSKLDTEVQVCNE

SEQ ID NO: 20400 - DNA, 4611 bp, Sorghum bicolor
  misc_feature: Ceres ANNOT ID no. 8642455
  misc_feature: Up-regulated in shoot tissues in response to salicylic acid treatment
  misc_feature: Encodes the peptide sequence at SEQ ID NO 20401
atgtcacattttcaccccacacagcatgcgggtgagaatgattttcagatgtggcagcagcagatgatgttcaagcagttgcaggagtttcagaggcagcaacaactacagcagtctgatcatggagccagaatgcagccctcttttggacagtttcatgctcctgcaaaatctttgcctgctgatcaattgtcgacaatgtcaaatgaaatggtcaataatgaggccatgaattctgcatggccacataattttaccggtggtgacccgaatttgacaagtaactcccaaatgttgaataatggtagcacaaattgggatcagattgttggtgctcccggtgtgggcaatttcatgaatggttcaatgttggcgaatgctcagaatcaatcgatgagaccaatgggattagctacccaccaagtggatcaatctttttatccaatgcatgctactagcagcagagggcctggaaaccagtattcccaatttttagggattcctgctgatcctcagagtgcattgacaagggttggttcagatcagtcagaaaagacatccagaccattcaactcttcaatgaatgaacatggtcttcatatgcaaggtaccaccagtttgatgcataattttcgtggaaaagggggtttcttaaataacagtctgatgcaaagtcaaggtgataatatcagagcaggcagtccggttacaatgaatcaactgcaacatggctttcaaacccaagattttcatggtaggtcaaaccaagttgatcttcaagtgggcatgcaagagaaatcagcaatgcaggtagggcaagcaagtcgtggggctagtcttgaccctaccgaggagaaaatcttatttgggagcgatgaggatagcaactggggagctttgttgaggggtgacaatgataatggcaattctttggacaatgataattatggtggtggctactcatctctacagagcggtagctggagtgcccttatgcaggaagctctccagtctacaaccagtgaaaatagtcccaaagaagagtggagtggcttgagtttccataaaagtgagcaggtgatggctaacaatgcaactttatcaggccacgatgataataagcttactgggctaagcggtgcaaacctagaaaatgcacgtccttcaccatcgtccagctatgctgatggaacaatgaataacccaaatcttgccagttttcagcatgccataaggcctccattcgagcgaagggaccatatggctcatgaatctcctactgctcctgttaacaatcataaatcaacttctgaagtgaacaatgggtactttcagcagggtttaaaacaaattcaatctgatggaaggcaagaacaagcacaactagcaaatggaatttggccgcatcaaaagactgaactgctcagaaataatttgcagtcaactggtgtgcatgctacgccacctggtgcacatggattttggatgtcacaacaaaatacagctgatcacaatatcaacagagagtccagtaataaccaaaatgactggaaagctaacaatgcgcttggacaagacatgcacaatagccaaaatgtcttcaatagcaacgagaactcttggaagtcaactggaggtaatgtgaattcagtccagagacttcagcagaggaagtctgacgtaagcactactcatgaaagttcagatggtaaaaatattagcatgatgagctcaagcatgccaatgatgacacaagatcattatcagatggtcactagtcggagtggtgagcaaattggcatgaaccgtaatatggcacatagagctccagagacctctgagtcaccaggaaaaagcgaatatctaaatgcaacccctaacgaaaggcaagcacacattttaaaccatggacaacacataacaagtgattctgctcccagaaggcattctgtatttgctgggaaggaatccgaaaatttaggtcagtctagtcagcaagcaatgggatcttacatgttgcagaatcgtgctatggggagctctggaatgaacattggcccatctccaggcaatccagtttcaaataatctgtttccacctcagatgcggaataatctgcagcatcattttggcacaaactcccatgtttctaataatatgccttcagaacaacttcaatctcgacatggtctccctaacagctccagtgcattaccttttggaggagctgatactggtctatctcagaatagagcagttcaaaacagtcaacatatgcttcagcttcttcataaggtggataactcaagaaatagcaatgtggttgctgacatacccaacaattcccttggcgttgtttctgcccagcaacaacttaaccattcttctttgcaaggatttggattgagactggcaccaccatcccaacgccaatcaaattcgggtaatttatggtctagtcagactaatgctgatggcaagcaatctgaccactcagcacaagatgatgaccgcacacagctaccttccacccctagccagtcactgactcctcagcatcaaaactctcaatcttcaccatttcacagttcagaaacagaaaatactgggcaaccaattgcacgtttcccccaattaagttcaggccaacagtatcctgtggcagatgatagatctggtcctgcacccatggtgcagcagcagcagcctcagcaaagcaactccgcaacagtgttcaagaatgtatggacaaacatatcagcacagcgcctagctggtatgcaagctaacaagattacacccaacatccttcagtctatgatgtttccaaataatgctgcagcttccaacttatggagctctcagaaggcagatgatcaagggcagagggcagcaactccatcagatattgcaacaagttcagcgaactcacagaatcaagatgcaaaacaagctgctgatagcgaggcagggttagcatcttcccagaaggcaaacctagagtcagcaggaactaccataacaggaggaaatgaatccttgcagaagccttctgcagatgggaattccatcaatgctgtttcatcctttgcacagttgcgtcagcaaggcatccttggtgctaaacatggggagatcccaggagctaattttcaggctatgaatgcttcccacaataatgctaataatagtggcggcattgttttacatggaagcccagcaccttcaaacattcagcagcaaaattactctcttttacatcaaatgcaagccttgaggcatacagatattgatccaggcagtttagctgggaaggcgacaagacctgatattggtcctgatgcttcacagattgactggaagtctggtcagaggtttgctcatgtagccaataactcaaccaaatcgtctgcagataacattggaagccctggtgtcccagggccattcacttcagacatgaaaatgctgagttttgcttcaaggagtgaggagagaaatcctaatgtaccttctcagcttccttctggagagcgcccatcacctggtatggttactgcacaaaatgataatcggaatcaagttcagcctatgggcacaagtgcaacgtcaaattctgttgaaagaagtgagaggccgaggataaaccctcaaatggcaccttcttggtttggacattacggaaactatagaaatggtcagagtgttgctatgctcaatgcgcagaagcccacggctttgccatataattttccgaaagcttcttggaacaatgaaaataatagccctgctgaaaatagagttgaatctggccaatctgttaggcctgggcatcatctcccatcaacaagaatggaagctttggttccttccaatgtaaaagtatcttcaatgatgagaaggcctaagaagcgtaaagcaatggactccacacttgtttcttggcataaaataattgaaagcccacaaaaactgaggaacatcagcacatttgagatggactgggcttgggcagctaatcggttaattgagaaggatgagtcagaaactccagacgacgctcctttaaattatttaccgcggaagaggctaatcttgacaacccagttgattcagcaacttctccctgctataccagcaaccattctgagagcacaagctgtgtctgcttacgaaagtgcgacatacactctatcaatgctgacactaagggatgcgtgcagcatggcatcatcatcattatataactcttgctctcccgtggaggatgaaaataacccatctgaacaaacaacaagtgctaagaaaatggaagacaaagtgtcaaaggccgtggaagtctttgttggaagaatccggaagatggaaaatgactttataagtttgaacaagagggcctcgatgctagatgtgcaactggagtgccaagatctggagagaatttctattgtaaatcgtttgggaagatttcatggccggaaccatgcagcagcagttgagggttcatctgcttcagaaatgactcctcggagaatttttcctgaaagacatgtcatgtcttttgcagtccctggaaatcttcctgaaggagtctactgtttgtcactctag

SEQ ID NO: 20401 - protein, 1536 aa, Sorghum bicolor
  misc_feature: Ceres ANNOT ID no. 8642455
  misc_feature: Up-regulated in shoot tissues in response to salicylic acid treatment
  misc_feature (338)..(1024): SWISSPROT Homolog: EC 2.7.10.2 Non-specific protein-tyrosine kinase
MSHFHPTQHAGENDFQMWQQQMMFKQLQEFQRQQQLQQSDHGARMQPSFGQFHAPAKSLPADQLSTMSNEMVNNEAMNSAWPHNFTGGDPNLTSNSQMLNNGSTNWDQIVGAPGVGNFMNGSMLANAQNQSMRPMGLATHQVDQSFYPMHATSSRGPGNQYSQFLGIPADPQSALTRVGSDQSEKTSRPFNSSMNEHGLHMQGTTSLMHNFRGKGGFLNNSLMQSQGDNIRAGSPVTMNQLQHGFQTQDFHGRSNQVDLQVGMQEKSAMQVGQASRGASLDPTEEKILFGSDEDSNWGALLRGDNDNGNSLDNDNYGGGYSSLQSGSWSALMQEALQSTTSENSPKEEWSGLSFHKSEQVMANNATLSGHDDNKLTGLSGANLENARPSPSSSYADGTMNNPNLASFQHAIRPPFERRDHMAHESPTAPVNNHKSTSEVNNGYFQQGLKQIQSDGRQEQAQLANGIWPHQKTELLRNNLQSTGVHATPPGAHGFWMSQQNTADHNINRESSNNQNDWKANNALGQDMHNSQNVFNSNENSWKSTGGNVNSVQRLQQRKSDVSTTHESSDGKNISMMSSSMPMMTQDHYQMVTSRSGEQIGMNRNMAHRAPETSESPGKSEYLNATPNERQAHILNHGQHITSDSAPRRHSVFAGKESENLGQSSQQAMGSYMLQNRAMGSSGMNIGPSPGNPVSNNLFPPQMRNNLQHHFGTNSHVSNNMPSEQLQSRHGLPNSSSALPFGGADTGLSQNRAVQNSQHMLQLLHKVDNSRNSNVVADIPNNSLGVVSAQQQLNHSSLQGFGLRLAPPSQRQSNSGNLWSSQTNADGKQSDHSAQDDDRTQLPSTPSQSLTPQHQNSQSSPFHSSETENTGQPIARFPQLSSGQQYPVADDRSGPAPMVQQQQPQQSNSATVFKNVWTNISAQRLAGMQANKITPNILQSMMFPNNAAASNLWSSQKADDQGQRAATPSDIATSSANSQNQDAKQAADSEAGLASSQKANLESAGTTITGGNESLQKPSADGNSINAVSSFAQLRQQGILGAKHGEIPGANFQAMNASHNNANNSGGIVLHGSPAPSNIQQQNYSLLHQMQALRHTDIDPGSLAGKATRPDIGPDASQIDWKSGQRFAHVANNSTKSSADNIGSPGVPGPFTSDMKMLSFASRSEERNPNVPSQLPSGERPSPGMVTAQNDNRNQVQPMGTSATSNSVERSERPRINPQMAPSWFGHYGNYRNGQSVAMLNAQKPTALPYNFPKASWNNENNSPAENRVESGQSVRPGHHLPSTRMEALVPSNVKVSSMMRRPKKRKAMDSTLVSWHKIIESPQKLRNISTFEMDWAWAANRLIEKDESETPDDAPLNYLPRKRLILTTQLIQQLLPAIPATILRAQAVSAYESATYTLSMLTLRDACSMASSSLYNSCSPVEDENNPSEQTTSAKKMEDKVSKAVEVFVGRIRKMENDFISLNKRASMLDVQLECQDLERISIVNRLGRFHGRNHAAAVEGSSASEMTPRRIFPERHVMSFAVPGNLPEGVYCLSL

SEQ ID NO: 20402 - DNA, 1284 bp, Sorghum bicolor
  misc_feature: Ceres ANNOT ID no. 8642443
  misc_feature: Up-regulated in shoot tissues in response to methyl jasmonate treatment
  misc_feature: Encodes the peptide sequence at SEQ ID NO 20403
atggacgcgtcgcacccgaagggcgaggccgcggcggggtgggtgacgatcgaggagtggagcggctcgtcagcctccgcgctctcccgcaccgccgtcctcaccgcctccgcctccgcctcctctctcaccgcacacaggttcggcagccgatgggggcagatcgggagccgcatgctcggcgccttcgtgcctgagggctttcctgggagcgtgactccggattatgtcccgttccagatgtgggatacgttgcaggctcttctaggtgcaattggagtgggagaacagtctgcaactgtcataggtgctacttttcagtggtttctgagggacttgacaggaatgcttggagggattttgttcaccttttatcagggatctaatcttgatagcaatgctaaaatgtggcgtctagttgcagactttatgaatgaccttggaatgttgatggatctcttaagccctctatttccttcatcgttgatagttataatgtgcttaggcagcctatcaaggtcattcactggtgttgctagtggagcaactagagcagcactaacacagcattttgcacttgcaaagaacgcagctgatatttctgcaaaggagggcagtcaggaaacactcgctacaatgatagggatgggattggggatgctgctagctcacattactagaggccatgctttgagtgtatggacatcttttctttctctcacggtgttccatatgtatgcaaattacaaggcagtgcagtcactttcactcactacgctaaactatgagagagcctccatcttgctacagtacttcaaggaatgtggtgacgttcttgcaccgcaaaaggtttctcagcaggaacatattcttcctttttggtcaacctggaggaaattaaacaaaattaaactgccacatgagcgtgtgcacttaggtgctaaagcctcgatgcttacacacagtgacatgttggtgattgcaaaaacaagatcccactatgaaaatacaaactaccttttgctgaataaacaaggcagtgtttacattttcatccacaagctggcaacaccagctgatgttttaaggtccttcgtacatgggctcgtgttagcaagttcgacatcccagcacttagaggcccgtcgatggatggacgagatgtataccaattttatctcgaagttgcagagtgaaggttactcaacagaacgccttctgtcgcattcgattctttggagggcacactggcttcacggccagcatgatgagaagctcaagtag

SEQ ID NO: 20403 - protein, 427 aa, Sorghum bicolor
  misc_feature: Ceres ANNOT ID no. 8642443
  misc_feature: Up-regulated in shoot tissues in response to methyl jasmonate treatment
MDASHPKGEAAAGWVTIEEWSGSSASALSRTAVLTASASASSLTAHRFGSRWGQIGSRMLGAFVPEGFPGSVTPDYVPFQMWDTLQALLGAIGVGEQSATVIGATFQWFLRDLTGMLGGILFTFYQGSNLDSNAKMWRLVADFMNDLGMLMDLLSPLFPSSLIVIMCLGSLSRSFTGVASGATRAALTQHFALAKNAADISAKEGSQETLATMIGMGLGMLLAHITRGHALSVWTSFLSLTVFHMYANYKAVQSLSLTTLNYERASILLQYFKECGDVLAPQKVSQQEHILPFWSTWRKLNKIKLPHERVHLGAKASMLTHSDMLVIAKTRSHYENTNYLLLNKQGSVYIFIHKLATPADVLRSFVHGLVLASSTSQHLEARRWMDEMYTNFISKLQSEGYSTERLLSHSILWRAHWLHGQHDEKLK

SEQ ID NO: 20404 - DNA, 1404 bp, Sorghum bicolor
  misc_feature: Ceres ANNOT ID no. 8642570
  misc_feature: Up-regulated in root tissues in response to methyl jasmonate treatment
  misc_feature: Up-regulated in root tissues in response to salicylic acid treatment
  misc_feature: Up-regulated in shoot tissues in response to salicylic acid treatment
  misc_feature: Encodes the peptide sequence at SEQ ID NO 20405
atgggtatgaggagcaggcacccaaaggcgttgggtttccgctgctacccggcaagccaccggtccctaactctggtactgtggagcctagcggcattggtcgtcgttgtgaatttccatcttctcatcattcataaggaggaggctgagagtatgagtacacacgagatccggcgatcgattatgagggaactggaggtggtggaggaggagaagttccggctatctcctccacggagccggaggaatccccgggctgtgcgccgcaagggagagaagaagccgcctacaatagtggatgagttcttggatcagtcttctgcagtgcatgatatgttcttcccagaactgaatacggctgtagatccaatcaatggaggaaatgacagcatgtacttctactaccccggcagaatttggttggacacagatggaaaaccaattcaagctcatggaggaggtgtcctgtatgataagaggaccaacacctatttctggtacggggagaataaggatggcaaaacctacaaagctcacagcaagggagcagacagggttgacatcattggagtaagctgctattcttcgaaggacctgtggacatggaaaaatgaagggcttgtcctccgtggtgaggagaagaatgtaacacatgatcttcacaaatccaatgtcctggagaggcccaaggtgatatacaatgatcggactggcaaatatgtgatgtggatgcacatagatgatgctaactacaccaaagcttcagttggtgtggccgtcagtgactctccgacaggaccattcacttatctgtacagcaagcgtccacatgactgcgaaagtagagacatgaccatcttcaaggatgatgatgggaaggcctacctgatatactcttctgaggacaacagcgagctccacattggcccgctaactgatgactaccttgatgtcactgatgtgatgcgaaggcttctcatcgcacagcatcgagaagctcctgcgctcttcaggcatgaaggcacctactacatggtaacctctggctgcacaggctgggctccaaacactgcgctagctcatgcggcaacatcagtgatgggaccttgggagacactggggaacccctgcgtgggagggaatgaggtcttcagatcaacaacattcttctcccagagcacatttgtcttgccagttccagggctgccgggctcattcatcttcatggctgatcggtggaacccatccgatcttatagattcgcggtatgtctggctgcctctgacgataggggggatccctgatgaagccgcagattatagcttcatgttccctctctggtcccgggtgtccatttactggcacaaacggtggcgtctccctgaggagtggagggactcttga

SEQ ID NO: 20405 - protein, 467 aa, Sorghum bicolor
  misc_feature: Ceres ANNOT ID no. 8642570
  misc_feature: Up-regulated in root tissues in response to methyl jasmonate treatment
  misc_feature: Up-regulated in root tissues in response to salicylic acid treatment
  misc_feature: Up-regulated in shoot tissues in response to salicylic acid treatment
  misc_feature (157)..(419): Pfam ID: Glyco_hydro_43 Pfam Description: Glycosyl hydrolases family 43
MGMRSRHPKALGFRCYPASHRSLTLVLWSLAALVVVVNFHLLIIHKEEAESMSTHEIRRSIMRELEVVEEEKFRLSPPRSRRNPRAVRRKGEKKPPTIVDEFLDQSSAVHDMFFPELNTAVDPINGGNDSMYFYYPGRIWLDTDGKPIQAHGGGVLYDKRTNTYFWYGENKDGKTYKAHSKGADRVDIIGVSCYSSKDLWTWKNEGLVLRGEEKNVTHDLHKSNVLERPKVIYNDRTGKYVMWMHIDDANYTKASVGVAVSDSPTGPFTYLYSKRPHDCESRDMTIFKDDDGKAYLIYSSEDNSELHIGPLTDDYLDVTDVMRRLLIAQHREAPALFRHEGTYYMVTSGCTGWAPNTALAHAATSVMGPWETLGNPCVGGNEVFRSTTFFSQSTFVLPVPGLPGSFIFMADRWNPSDLIDSRYVWLPLTIGGIPDEAADYSFMFPLWSRVSIYWHKRWRLPEEWRDS

SEQ ID NO: 20406 - DNA, 1200 bp, Sorghum bicolor
  misc_feature: Ceres ANNOT ID no. 8642605
  misc_feature: Down-regulated in root tissues in response to aminocyclopropane carboxylic treatment
  misc_feature: Down-regulated in shoot tissues in response to salicylic acid treatment
  misc_feature: Encodes the peptide sequence at SEQ ID NO 20407
atggacagctccctcgcgagcgccgcggcgatcgccgaccagcgccagaagatcgagcagtaccgccacatcctcgcctccgtcctctcgtcttccccacctgacatctcccaggccaagcgattcctcgaccacatggtgtcggacgaagttccgctcgtggtgtcgcggcagttgctgcagacgttcgcgcaggacctggggaagctggagtccgacgcgcagaaggaggtcgcccactacgcgctcacgcagatccagccacgtgtggtctccttcgaggagcaggtggtagtgattagagagaagcttgcagagctatatgagtctgaacaacaatggtcaaaagcagcacaaatgcttagtgggattgacttggactcaggaatcaggatgcttgatgacaccaacaaattatccaagtgtgtccagattgcacgactctatttagaggatgacgatgcagtaaatgccgaggcttttatcaacaaggcttcatttttggtaaccaacagccaccaggaagttctaaacttacagtacaaggtctgttatgcaaggattttggatctgaaaagaagattcctggaagctgcacttcgatattatgatatctctcaaattgaacaacgcaagattggagacgaagagattgatgaaaatgcactggagcaagctcttagtgccgctgtgacgtgcacaatattggctggtgctggtccacaacgctcccgtgttcttgctactctgtacaaggatgaaagatgctcgaagttgaagatatacccaatactgcagaaggtttatcttgaaaggattttgaggaaaccagaaattgatgcttttgcagaggagctgaggccgcatcaaaaagctttattaccagataggtcgactgtgcttgaccgagcaatgatcgagcataatctccttagtgccagtaaactgtacacaaatatcagctttgatgagcttgggacattactggggattgatccaaggaaggctgagaagatagcatcccggatgatttatgaggataggatgcggggttccattgatcaggttgaggctgtgatacattttgatgatgacacggaagagctacagcaatgggatcaacagattgctggactatgtcaagccctgaacgacatccttgacagcatgtcaagcaagggaatagctattccggtgtga

SEQ ID NO: 20407 - protein, 399 aa, Sorghum bicolor
  misc_feature: Ceres ANNOT ID no. 8642605
  misc_feature: Down-regulated in root tissues in response to aminocyclopropane carboxylic treatment
  misc_feature: Down-regulated in shoot tissues in response to salicylic acid treatment
  misc_feature (265)..(364): Pfam ID: PCI Pfam Description: PCI domain
MDSSLASAAAIADQRQKIEQYRHILASVLSSSPPDISQAKRFLDHMVSDEVPLVVSRQLLQTFAQDLGKLESDAQKEVAHYALTQIQPRVVSFEEQVVVIREKLAELYESEQQWSKAAQMLSGIDLDSGIRMLDDTNKLSKCVQIARLYLEDDDAVNAEAFINKASFLVTNSHQEVLNLQYKVCYARILDLKRRFLEAALRYYDISQIEQRKIGDEEIDENALEQALSAAVTCTILAGAGPQRSRVLATLYKDERCSKLKIYPILQKVYLERILRKPEIDAFAEELRPHQKALLPDRSTVLDRAMIEHNLLSASKLYTNISFDELGTLLGIDPRKAEKIASRMIYEDRMRGSIDQVEAVIHFDDDTEELQQWDQQIAGLCQALNDILDSMSSKGIAIPV

SEQ ID NO: 20408 - DNA, 918 bp, Sorghum bicolor
  misc_feature: Ceres ANNOT ID no. 8642612
  misc_feature: Up-regulated in root tissues in response to methyl jasmonate treatment
  misc_feature: Encodes the peptide sequence at SEQ ID NO 20409
atggggatttctacctcgttcccttcttgtgcggcagctacgtcggtttcagctcggtctctaatgacctccggcgcggtttctcgtacggacaagatgagaataattctctcattgttcttgttcagggaagcttttgtggcaagtgaggcctccgtcttcatgaatcagccccctccacatatgtctagaccatcaattattatcaagctcattttggggttgctgtggaccatcacccacttagcaatcagctttttaaatttatggtcacatctgatttatagtttagaatgctatgttatttcatctggattgttgcggaagtatcagaatcttcatctgggtagactgaagtgcttggctattgtggtagatagcaaagaagctaaaagtactgcaaaggtcaagcaactgttatgctggctctcatctatgggtgtgaagtatgtatgtctctacgacatcgagggagtactgaagaaatcatttgaacctgctgtgaatgcttcaagagataggactgcaggagaacattttggcattggaggaaacatcagtgatctacagtgtagccaaagagagatggtaatagactgtctttctggttctgatggcaaggagggtattgcaaaagcaggcagtttactttgctcaacttacatcaatggtgatactcatggagatggcaaaaggaaaccagcatttacagaagctgacatggctagtgcactgaaagctgtaggttgtggtggaccagaacctgatcttcttctcatgtatggtcctgctagatgccatttaggatttcctgcatggagattacggtatatggggccactgaagtcaatgaaatatggtgctattgtgaaggccttatataacttctcaaagaaacaccaaaattatgggaaatga

SEQ ID NO: 20409 - protein, 305 aa, Sorghum bicolor
  misc_feature: Ceres ANNOT ID no. 8642612
  misc_feature: Up-regulated in root tissues in response to methyl jasmonate treatment
MGISTSFPSCAAATSVSARSLMTSGAVSRTDKMRIILSLFLFREAFVASEASVFMNQPPPHMSRPSIIIKLILGLLWTITHLAISFLNLWSHLIYSLECYVISSGLLRKYQNLHLGRLKCLAIVVDSKEAKSTAKVKQLLCWLSSMGVKYVCLYDIEGVLKKSFEPAVNASRDRTAGEHFGIGGNISDLQCSQREMVIDCLSGSDGKEGIAKAGSLLCSTYINGDTHGDGKRKPAFTEADMASALKAVGCGGPEPDLLLMYGPARCHLGFPAWRLRYMGPLKSMKYGAIVKALYNFSKKHQNYGK

SEQ ID NO: 20410 - DNA, 1602 bp, Sorghum bicolor
  misc_feature: Ceres ANNOT ID no. 8642613
  misc_feature: Down-regulated in shoot tissues in response to aminocyclopropane carboxylic treatment
  misc_feature: Encodes the peptide sequence at SEQ ID NO 20411
atgtcgtcgcagtgcccatactgccgcgcatcggggccggtgcgttgcgcgacgacgcagccgccgctctcgcgcgccgtgtccgagtgctccgcctgcgcccgcatcgtcgtcgagcgccacctccacacgcaccccttcttcccccttctcccctcactccatccgcttcccctagtcacccccgacctcgccaccgccgtcgatcccgccccctccccatcacccggcgacgaagatgacgaggacccttttctccccgcgggcttcgtctccgctttctcggctttctccctcgagcgccaccccgtcctcgcccgctccgcctccaccttctccggcctcctcgccgagctcgagcgcgcgctcgccgtcgactccgccgccgcagccgcctccaacccggaccccgccgggcccatggtctccgtcgacagcctccgcgcctacctccagatcgtcgacgtcgcctccatactccgcctcgacagggacatagccgaccacgccttcgagctcttcaaggattgctcgtccgcgacctgcctcaggaatcggagcgtcgaggcgctcgcgaccgccgcgctcgtgcaggctatccgcgaggcgcagcagcctcggacgctgcaggaaatctctactgctagcaatcttcctcaaaaagagataggaaaatacatcaaaatactcggcgaatctctgaaactgagtcaaccacttaacagcaactcaatagctgttcatatgccccgattttgcagtttgctccagctgaataaatctgctcaggaacttgcagctcatattggtgaggtggttgttaataagtgcttctgtacacggcgaaatcccataagtatatctgctgccgctatctaccttgcatgtcagcttgaagacaaacgcaaaactcaggcagagatctgtaaggttacgggcctcacagaggtcacattacgcaaagtgtacaaagaactgttggagaattgggatgatttgctcccccctgactatacacctgccacaccaccagagaaagctttccccatgaccaacatttactcagggcgctcagcaagtggcaaggatctgtatcaggataagatattcgagagtattaagcaaaaatgccccgagcctgcagagcctgaccacatggtcatcgtgaaagaagaggaagacaagaaaacgattgctcttggtcgtccaccaacaaaacctgatgctcacgacttaggcaaggtgttccggccaccaaatgcccctttctcgacatctcctaaatctgattgtgacaagacagaaactagtgttcgtgggttcaaccttaatgaggtatcatgtgcaatggattctgatagaacagacatcacagtgaagccagcctttggtgatcgattgtcgaatgaatcgaatgtgattcaatctcccaacaggcagcctttaccgtggcagcataagcagggggcgcctgcaactactccatcatattcaaggcttcgcgagcaacagtcgggcctggatcttgtagctgctctgaagaggattgggaaaaggagtgctggggatggtggtgatggccgggatagagaagggaaatga

SEQ ID NO: 20411 - protein, 533 aa, Sorghum bicolor
  misc_feature: Ceres ANNOT ID no. 8642613
  misc_feature: Down-regulated in shoot tissues in response to aminocyclopropane carboxylic treatment
  misc_feature (249)..(319): Pfam ID: TFIIB Pfam Description: Transcription factor TFIIB repeat
  misc_feature (153)..(223): Pfam ID: TFIIB Pfam Description: Transcription factor TFIIB repeat
MSSQCPYCRASGPVRCATTQPPLSRAVSECSACARIVVERHLHTHPFFPLLPSLHPLPLVTPDLATAVDPAPSPSPGDEDDEDPFLPAGFVSAFSAFSLERHPVLARSASTFSGLLAELERALAVDSAAAAASNPDPAGPMVSVDSLRAYLQIVDVASILRLDRDIADHAFELFKDCSSATCLRNRSVEALATAALVQAIREAQQPRTLQEISTASNLPQKEIGKYIKILGESLKLSQPLNSNSIAVHMPRFCSLLQLNKSAQELAAHIGEVVVNKCFCTRRNPISISAAAIYLACQLEDKRKTQAEICKVTGLTEVTLRKVYKELLENWDDLLPPDYTPATPPEKAFPMTNIYSGRSASGKDLYQDKIFESIKQKCPEPAEPDHMVIVKEEEDKKTIALGRPPTKPDAHDLGKVFRPPNAPFSTSPKSDCDKTETSVRGFNLNEVSCAMDSDRTDITVKPAFGDRLSNESNVIQSPNRQPLPWQHKQGAPATTPSYSRLREQQSGLDLVAALKRIGKRSAGDGGDGRDREGK

SEQ ID NO: 20412 - DNA, 1896 bp, Sorghum bicolor
  misc_feature: Ceres ANNOT ID no. 8642664
  misc_feature: Down-regulated in shoot tissues in response to aminocyclopropane carboxylic treatment
  misc_feature: Down-regulated in shoot tissues in response to salicylic acid treatment
  misc_feature: Encodes the peptide sequence at SEQ ID NO 20413
atggatgaggtccctgccaccgccgccgtcctcgacttccgacccggctcgtctccaccacgcgtctccgccgtcgcgcgccgtgccgcggagtgctcccccgacaccggtaaggcctcctcttacgccgcaacggggtcccgcttgacgccgttctggcttggcgtggttggtgaacggaacaccgacccccaagcggtcaaaccactggtggtcggcggtgcagacgaggcgacgggaggtccaggtttcgggaacacagccgccgtttcggcggagttgacggggtcaaattcggccggtcccgatatccaggctgtggattgcgatacatcgggaggccttgctggcggtgacgctgggggcgttgaggttttgtgcttagagaatgctgcggagcttgaattggtggaaccaggtgttttggacgtgagattaggagctccagtggaggagcgccatgaccggacgttggatagtacgggattgggctctgatgaagctggtgagaccaatgggatttcactggttgaggtgtcccagtcaggttccacttcaagcttagatgccactggatcgactggtggctactccctcgtggaggggtctctgccagaggcgagttgtggtgcccaaagatgtgaacctgaggtccatgaagtaccaacagggtcccctgctactgtggggttcccgagtgaggatggaggctctggatttggaattgagctgaatgatgatgtggatggcagaaacggccttgccggaggggaattggaactgtctactgatggcgatgatgccgaagacatcacagagatagctggaatcttgtgtggcgaaagagtggaggggatggagacgaattcaggacaacatgaggcctcgaatggttccaccgtgccttctgaggaaggagtggacaggatggagacgagtttggatgactctgaggcttccgatggctcaaccacacaggattctgataccgacgtcgagacagagtcaagtgtttctagtatagaggaacaagaagcaggatacagagcccacatccctcaaccggatcaagcagtctgcaaggtgcccaaagaaaacaacatggcaggagtgaagagctctgataggatgacttcagtgatcgaatcaacacttgtgctggcttcaggtgcatcgatgttaccacatccttcgaaggtactcacaggtggtgaagatgcatattttattgcttgtgacggctggtttggtgtagcagatggagttggtcagtggtcatttgaagggatcaatgccgggctttatgcaagagaattgatggatggttgcaaaaagattgtaacagagacccaaggagctccagggatgagaactgaggatgttcttgccaaggctgcagatgaagcacggtgccctggttcttccactgttttagttgctcactttgatggccaggtccttcatgcatcaaatattggagattccggattccttgtgataaggaacggagaggtccataaaaaatcaaaaccgatgacctatggtttcaatttcccgttgcaaattgaaaagggcgatgacccttttaaaatcgtacagaactacgccatcgatctacaagaaggtgatgtcattgtaacagcatcagatggtctttttgacaacgtctatgaagaagaagtagcaggcattgtctccaaatcattagaagctgatctcaggcccacggaaattgctgatttattggttgcaagagcaaaggaagtggggcggtgtgggtttggaagaagcccgttttcagactctgctctggcggctgggtacctgggttactccgggggcaagctggatgatgtaactgttgttgtatctattgttcggaaatctgaggtttaa

SEQ ID NO: 20413 - protein, 631 aa, Sorghum bicolor
  misc_feature: Ceres ANNOT ID no. 8642664
  misc_feature: Down-regulated in shoot tissues in response to aminocyclopropane carboxylic treatment
  misc_feature: Down-regulated in shoot tissues in response to salicylic acid treatment
  misc_feature (404)..(522): SWISSPROT Homolog: EC 3.1.3.16 Phosphoprotein phosphatase
MDEVPATAAVLDFRPGSSPPRVSAVARRAAECSPDTGKASSYAATGSRLTPFWLGVVGERNTDPQAVKPLVVGGADEATGGPGFGNTAAVSAELTGSNSAGPDIQAVDCDTSGGLAGGDAGGVEVLCLENAAELELVEPGVLDVRLGAPVEERHDRTLDSTGLGSDEAGETNGISLVEVSQSGSTSSLDATGSTGGYSLVEGSLPEASCGAQRCEPEVHEVPTGSPATVGFPSEDGGSGFGIELNDDVDGRNGLAGGELELSTDGDDAEDITEIAGILCGERVEGMETNSGQHEASNGSTVPSEEGVDRMETSLDDSEASDGSTTQDSDTDVETESSVSSIEEQEAGYRAHIPQPDQAVCKVPKENNMAGVKSSDRMTSVIESTLVLASGASMLPHPSKVLTGGEDAYFIACDGWFGVADGVGQWSFEGINAGLYARELMDGCKKIVTETQGAPGMRTEDVLAKAADEARCPGSSTVLVAHFDGQVLHASNIGDSGFLVIRNGEVHKKSKPMTYGFNFPLQIEKGDDPFKIVQNYAIDLQEGDVIVTASDGLFDNVYEEEVAGIVSKSLEADLRPTEIADLLVARAKEVGRCGFGRSPFSDSALAAGYLGYSGGKLDDVTVVVSIVRKSEV

SEQ ID NO: 20414 - DNA, 1542 bp, Sorghum bicolor
  misc_feature: Ceres ANNOT ID no. 8642649
  misc_feature: Down-regulated in root tissues in response to methyl jasmonate treatment
  misc_feature: Down-regulated in shoot tissues in response to methyl jasmonate treatment
  misc_feature: Encodes the peptide sequence at SEQ ID NO 20415
atggccgacgccacgccgtccatcccgagcgccatcgcctccctccaggcctactccacggccctctccgccttcaccgccgcatggcgtgccgtcgagacccacgcctccagcctcgactccaccctcgccgcccgcctagccggctacaccgagctcgagctgatctgctcggcgatggacggcgccggcctcctcgcgtacctcaccgagcacagggacgagctcaaggagccagcgcgcgccctcgacgccgccctccaggtggcgcccgacccggggcttctggtcctctctgcggccgcgactttctgccgcacgccgccggagaaggccaagaacgacggtagcgtcaaggcgtcctgccgcctgctcatggccttgctcgaccggctgcgcgcgattgggttcaagccgtcgcctgaggcacgcgacgaggccagagctgtcgcggcggactggaagcgaggcaagcggatcgggacggaggtgatgtttaagcaggagacgttcgccttcttgcatctcgtgggagtgtttgggctcgtggaggatgtgggcggtgccggcgaggtgcttgatctagtcgtgtcgatctctggtcgtgagcgcgctgttgaggccttcctcgtccttggcctggacctcgaccagcatatgccaatcctcattcagaaaatggtaaacaaaagcaaacagctagaggcagtcaaattcattcaagctcttaatatagtgcacaaataccctttgttgcctattatgaggtcgtacattgatcatgctgcagttgctggtaagatgatccgcatcaggggagatgatcttgctactcagaatgcagctgatgcaaaagagcgcacacttcttggaacattgcagaagttcattaaggaacagaagctagaagaactgcctatttttgaagaagctaacaagcgaatggcacatttggatcagcaaagtgctgagagaaaaagaactgctgcagcagcggctgcggctgcccaaaaggttagtaagaacattgaggagcagcagaaaaagatacaggagctgatgcagcctgctaagagaccaaggcccgagaatgtggtgcaaggttcattaggccagaatgttaacccagctagaacctctactcaacaatttaagccacagcatagcattcataaagctggagtgtcaaatcagtatcaagctgctttaactcagaatgtactgccagcaatcaatcagatttcgcagctagttgctgggagccatcgtccagttggcatccaaaatcaggccattgctgttccgcctcaatatggtagtggtagcttggcaagttattatggagtgacgtccaccacgccatacaggtccagcactctagctcctggacctggtgctttgaatggtccaagtgcgcaggcatcatcaagatcaaagctctattctggagatcccctcgcggctgtctcccgatcatcagataagaagggatcatcttacaaatattctttgtctagtatgtcaacttatgatcataaatga

SEQ ID NO: 20415 - protein, 513 aa, Sorghum bicolor
  misc_feature: Ceres ANNOT ID no. 8642649
  misc_feature: Down-regulated in root tissues in response to methyl jasmonate treatment
  misc_feature: Down-regulated in shoot tissues in response to methyl jasmonate treatment
  misc_feature (40)..(333): Pfam ID: Frigida Pfam Description: Frigida-like protein
MADATPSIPSAIASLQAYSTALSAFTAAWRAVETHASSLDSTLAARLAGYTELELICSAMDGAGLLAYLTEHRDELKEPARALDAALQVAPDPGLLVLSAAATFCRTPPEKAKNDGSVKASCRLLMALLDRLRAIGFKPSPEARDEARAVAADWKRGKRIGTEVMFKQETFAFLHLVGVFGLVEDVGGAGEVLDLVVSISGRERAVEAFLVLGLDLDQHMPILIQKMVNKSKQLEAVKFIQALNIVHKYPLLPIMRSYIDHAAVAGKMIRIRGDDLATQNAADAKERTLLGTLQKFIKEQKLEELPIFEEANKRMAHLDQQSAERKRTAAAAAAAAQKVSKNIEEQQKKIQELMQPAKRPRPENVVQGSLGQNVNPARTSTQQFKPQHSIHKAGVSNQYQAALTQNVLPAINQISQLVAGSHRPVGIQNQAIAVPPQYGSGSLASYYGVTSTTPYRSSTLAPGPGALNGPSAQASSRSKLYSGDPLAAVSRSSDKKGSSYKYSLSSMSTYDHK

SEQ ID NO: 20416 - DNA, 1416 bp, Sorghum bicolor
  misc_feature: Ceres ANNOT ID no. 8642683
  misc_feature: Up-regulated in root tissues in response to salicylic acid treatment
  misc_feature: Encodes the peptide sequence at SEQ ID NO 20417
atggcccccccgccgccggaggatctccaatgcgccgtgaacggcaactgcgccgccccgccggggaagcccctggcggcgctggccgccagggatggcgagctccggtggctgcggcggtgcgtggaggcagcagcgaagggcttcgccatcggcgggggcctcaagggcggcctcgcgctcttctccgtcctcgtccgcatccgcagccgccgctcccccagatcgaggaaggccggagctatgacgaacgacgaggccgtggtgctcgcggtcaaggagactgtgaggtacggcttgttcttggggacctttgccggcagctacgtctctgtcgacgagtacatcgccgccgtctggggacgtaagagaacagcaaggtggagatcattattagctgggttgattgctggtccttctatgctcctgacaggaccaggaactcagcatacgagcttggctatatacattctgatgcgtgcagcagtgcttgcatcccgttgtggaataaagagcaaacgttttggaaagatctgtaaacctttgacttggtcacatggtgatgtcttccttatgtgcctctcatctgcacaaattttgtccgcgtacattttaaagcaggagagtttgccgtcgtcatataaatcatttctaaacaagcatggtggaaaagatctttctattttgcaaggtgtgaaggatgtagtcaaccacactgctttcagcaacttagcgggtatcgagaagtactacaaatctgttggtgttgacataaagctagatccgaacatgaaagtgccctgctcaattgtgcatggtaaccagtcatgtacaggacatgtcttttcattcttgttgcaagcatatggaagagcagttcctgtatacgttccagtctacttagtccctgcacttgtagttcataggcagcatctcctgaaaaggccttactcaattatcgggaagagttttctaggagtagcaagatctagtatgtttctctcagtatactgtgcatctgcatgggcttggacctgcctgctttttaggaccttccacagagccaatacccctcttgtcatccttggcacgtttccaacaggtctggcgttgcttatcgagaagaagagcaggagaattgagatatccttgtattgtcttgccagagctatcgagagttttttcacatggatgaccgatgcaggactctgccctccaatactgcagataaagcgagccgatgtggttgtgttcagcatagctacctctatcattatgcactgctatgcgcaggaaagagaagtcttccggtccaagtacctgaatgtgctggactgggtatttggtgtgccaccaccacctgacagtgaggacaagaattgctatcgaccagatgaagccaagaaatgccagtga

SEQ ID NO: 20417 - protein, 471 aa, Sorghum bicolor
  misc_feature: Ceres ANNOT ID no. 8642683
  misc_feature: Up-regulated in root tissues in response to salicylic acid treatment
MAPPPPEDLQCAVNGNCAAPPGKPLAALAARDGELRWLRRCVEAAAKGFAIGGGLKGGLALFSVLVRIRSRRSPRSRKAGAMTNDEAVVLAVKETVRYGLFLGTFAGSYVSVDEYIAAVWGRKRTARWRSLLAGLIAGPSMLLTGPGTQHTSLAIYILMRAAVLASRCGIKSKRFGKICKPLTWSHGDVFLMCLSSAQILSAYILKQESLPSSYKSFLNKHGGKDLSILQGVKDVVNHTAFSNLAGIEKYYKSVGVDIKLDPNMKVPCSIVHGNQSCTGHVFSFLLQAYGRAVPVYVPVYLVPALVVHRQHLLKRPYSIIGKSFLGVARSSMFLSVYCASAWAWTCLLFRTFHRANTPLVILGTFPTGLALLIEKKSRRIEISLYCLARAIESFFTWMTDAGLCPPILQIKRADVVVFSIATSIIMHCYAQEREVFRSKYLNVLDWVFGVPPPPDSEDKNCYRPDEAKKCQ

SEQ ID NO: 20418 - DNA, 1554 bp, Sorghum bicolor
  misc_feature: Ceres ANNOT ID no. 8642899
  misc_feature: Up-regulated in root tissues in response to salicylic acid treatment
  misc_feature: Encodes the peptide sequence at SEQ ID NO 20419
atggccgcgtcgctgcttcgccgtggcgctgtcgccagccgccggcgatgcccggaggggatgctgcggcggctggtctcgtctgaggcggcgcccgagcgggcaccgtcgtcgcggccgccgccggagatgccgtcgtttgaccaccagccccgcccgtacgccgggatgggtggcgccgagatcttccagaagaggaaggcggtgctcggaccgtcgctcttccactattaccagaagccgctcaacatcgtggaggggaagatgcagtacctgtatgacgagaatgggaagagatacctcgattgctttgggggcattgtaacagtgtcgtgtggccattgccatccggatattgtgaatgctgtggtggagcagaccaagttgctccagcacacaaccaccatttacttgcatcatgccattgtagagtttgcagaggccctcacctccaaaatgcctggcaatctcaaggttgcgtatttcgtgaattctgggactgaagcgaatgaattagcaatgttgatggcccggctgtatagtgggaatctcagtatggttgcacttagaaatgcatatcatggtggaagtgccggtacgattggattgactggtttgcagacgtggaagtaccccattcctcagggtgaaatacatcatgtcatgaaccctgatccttatcgagggacttttgggtctgatgctgcagcttatgccaaggaagtcgaagaacacataacttacggaagttcaggaagggttgcaggcttcattgcagaaacattccagggtgtcggaggtgctgttgaactagctcctggatacctaaagttagcttatgacattgtgcgcaaggctggtggtgtttgtattgctgatgaagtccagagtggttttggtcgtactggcagtcattattggggattccagacacagggtgttattcctgacatagtcaccatggcaaagggaattggcaatggcctgccactgggggcagttgtaacaactcctgagattgcaagtgtgttagctcaaaaaatccaatttaacacatttggtggaaatccagtttgttctgctggtggattagctgtgcttaaggttcttgacaaggagaaacgccaggcacattgtgctgatgttggagctcacttggtggaacgtctaaaatcgcttcaggagaagcacgaaatcataggtgatgttagaggaaggggcctgatgcttggggtggaactcgttacggacagaaaggagaagacccctgccaaggcagaaaccactgaactgtttgagaagctcaaagatctcggagtactagttggaaagggcggtctgcatggtaacgtcttcagaataaaaccaccaatgtgcttttcgaaggacgatgcaggtttctctcaaaggtcaaagccctcgtggtggagctttttccagcttctctcgtctacttcactcgatctcgactcacgccgccatggtcctcgtcaccggcttaggtgctggtatacatggccatgtggcctgatggcctggcccatggctcggtga

SEQ ID NO: 20419 - protein, 517 aa, Sorghum bicolor
  misc_feature: Ceres ANNOT ID no. 8642899
  misc_feature: Up-regulated in root tissues in response to salicylic acid treatment
  misc_feature (47)..(467): SWISSPROT Homolog: EC 2.6.1.44 Alanine--glyoxylate transaminase
  misc_feature (83)..(416): Pfam ID: Aminotran_3 Pfam Description: Aminotransferase class-III
MAASLLRRGAVASRRRCPEGMLRRLVSSEAAPERAPSSRPPPEMPSFDHQPRPYAGMGGAEIFQKRKAVLGPSLFHYYQKPLNIVEGKMQYLYDENGKRYLDCFGGIVTVSCGHCHPDIVNAVVEQTKLLQHTTTIYLHHAIVEFAEALTSKMPGNLKVAYFVNSGTEANELAMLMARLYSGNLSMVALRNAYHGGSAGTIGLTGLQTWKYPIPQGEIHHVMNPDPYRGTFGSDAAAYAKEVEEHITYGSSGRVAGFIAETFQGVGGAVELAPGYLKLAYDIVRKAGGVCIADEVQSGFGRTGSHYWGFQTQGVIPDIVTMAKGIGNGLPLGAVVTTPEIASVLAQKIQFNTFGGNPVCSAGGLAVLKVLDKEKRQAHCADVGAHLVERLKSLQEKHEIIGDVRGRGLMLGVELVTDRKEKTPAKAETTELFEKLKDLGVLVGKGGLHGNVFRIKPPMCFSKDDAGFSQRSKPSWWSFFQLLSSTSLDLDSRRHGPRHRLRCWYTWPCGLMAWPMAR

SEQ ID NO: 20420 - DNA, 2736 bp, Sorghum bicolor
  misc_feature: Ceres ANNOT ID no. 8643015
  misc_feature: Up-regulated in root tissues in response to methyl jasmonate treatment
  misc_feature: Down-regulated in shoot tissues in response to salicylic acid treatment
  misc_feature: Encodes the peptide sequence at SEQ ID NO 20421
atgaggtcgcagctcaacgcgtccgtctcgccgtcgctgctgctgccgccgccgccgccgccgtcctcgctccggcgagctctcccctccgccacgccccgcgccctcaggtacgccacacgcaccaccgcccaccgcacgtcgcctgcttctgcttcgatatacgctgtgagtttctggacggagcctgagcacagagcactccctgattccaggttgcacgcgttcccgtggcggttccgcgctactcctcgtcaccacggccgcggtgctggagctcgccgcgctaccaatctgcccgcgcccggcagccaaggagttggagtgctcgcctccgagaggaggccagatgatggggacactactactgtgatgaagaatgcagaggcgcctagcacttcaacggccactgcaaattccttgcgctttcccacacagggaaacttcaacgtggctgccattgttagcatagcattctgctttctacacagaattatttctggtcggatgcagtcgctgatgaatttgttcccgtcgatgtcaagtggcattacaagtttgccatttgcttgcatatctgatcctaccaaaagacccatgcctcttaagctagatttgactcttccaccactgcctaatttcggatggagtttttcgcgattgtactatctgttcaactctcagcttgatcggaacattgccttgtctattgttaccttgctcatcacatgcttttcatttgtcattattggaggattactgtttcataagttcaggaagcaacaacaatccctggaggactgcttttgggaagcttgggcatgtctttgttcatcatctacccatctaaggcaaaagacacgtgttgagcgtgtcattgggttctttcttgctatctggggtatattattctattctcgtttattaagtgcaatgacagaacaatttagaaaccagatgcataaagtaagggaaggggcacaggtgcaggttattgaggatgatcatatcattatttgtggagtcaatagtcatctgacatccatactgatccaattggataagtaccatgaatcatcaattcgcttaggtttagctactgcaaggaagcagaaaatcctccttctctcggatattccaaggaagcagattgacaagcttgcagatagcgtggcgaaagatttaaaccatattgatgtattcaccaagagtgctagtcttagcatgtcaaaatcatttgagagagcagcagcacacaaagcaaagtctataattatcttgccagcaaagcatgaaagatatgaagtggatacggatgcatttgtctctctattggctctgcaaccctgtaaacaaatcgcgcctatccctatcattgttgaggcttctaactcaaccacatgcgaacttctgaaatcaatcactggcttaaatgtgcaacctgtggagatggttgcgtctaagttgtttgtgcagtgctctaggcaaaagggccttctgaaaatctacaagcacttgcttaatcagcacaaaaatgttttcaaccttttcagccggcctgaactagggggcatgaagtatatggatgtcagacgtaaaatccatgatgcagtcgtttgcggtatcttccggtctggaaaaatttattttcacccaagcgaagaagaactgctgaaagaaacagacaaattgcttcttattgctcctgttcatgggatgagaagaacaaaatatagagtgttaagtgtaccaaaagaaacacaaacatcgagccattacccagaatcaagagaggatcaaggatcatttaatacggctactaccatggacaatgaaacacggctaaagaacattgtaaagcgcccctcaaaatctctttctaagagtagtgattatatgctgggaccgaaggaacgtgtgcttattattggctggcgaccaaaagttactgaaatgatacgggagtatgatagttaccttggacctggtagtacagtggaaattttgtcagaaacccctattaaagagaggagcagtatcatcaatccccttttgcagagccagcttaaaaatgttgaagttactcatcgggtggggtgtcctttgaactatgatactctgaaggaaacgatacttaacatacagaaatctgcccctgataaagaggttccactttcaatagttgtgatatctgacagagactggtttgttggagatgctgcacaggctgataaacagttggcatatacccttcttcttgctgaaaacatttgccagaaacatggcgttatggttgagaatcttgtatcagaaattgttgacatgggactgggaaaacaaatatctaaaataagaccatccctttcatttattggagcagaggaaataatgagccgtgtaacagcacaagttgcggagagtagtgagttgaatgaagtatggaaggatatcctgaacgctgaaggcgacgagatctacattaaggaaattgggctgtacatgaaggaaggagagaagatatcattctcggagctttctgaaagagcagttttacgtcgtgaagttgcgattggttatgtcaaggatggcaagcagcatattaatcctatcaacaaatcggagccactgtttcttgaaatgaacgattcactcattgtgatatcggagtttgaaggtgaacagccaattgtgatggacgaacagccaattatgatggacgaaggaacttcaggatag

SEQ ID NO: 20421 - protein, 911 aa, Sorghum bicolor
  misc_feature: Ceres ANNOT ID no. 8643015
  misc_feature: Up-regulated in root tissues in response to methyl jasmonate treatment
  misc_feature: Down-regulated in shoot tissues in response to salicylic acid treatment
MRSQLNASVSPSLLLPPPPPPSSLRRALPSATPRALRYATRTTAHRTSPASASIYAVSFWTEPEHRALPDSRLHAFPWRFRATPRHHGRGAGARRATNLPAPGSQGVGVLASERRPDDGDTTTVMKNAEAPSTSTATANSLRFPTQGNFNVAAIVSIAFCFLHRIISGRMQSLMNLFPSMSSGITSLPFACISDPTKRPMPLKLDLTLPPLPNFGWSFSRLYYLFNSQLDRNIALSIVTLLITCFSFVIIGGLLFHKFRKQQQSLEDCFWEAWACLCSSSTHLRQKTRVERVIGFFLAIWGILFYSRLLSAMTEQFRNQMHKVREGAQVQVIEDDHIIICGVNSHLTSILIQLDKYHESSIRLGLATARKQKILLLSDIPRKQIDKLADSVAKDLNHIDVFTKSASLSMSKSFERAAAHKAKSIIILPAKHERYEVDTDAFVSLLALQPCKQIAPIPIIVEASNSTTCELLKSITGLNVQPVEMVASKLFVQCSRQKGLLKIYKHLLNQHKNVFNLFSRPELGGMKYMDVRRKIHDAVVCGIFRSGKIYFHPSEEELLKETDKLLLIAPVHGMRRTKYRVLSVPKETQTSSHYPESREDQGSFNTATTMDNETRLKNIVKRPSKSLSKSSDYMLGPKERVLIIGWRPKVTEMIREYDSYLGPGSTVEILSETPIKERSSIINPLLQSQLKNVEVTHRVGCPLNYDTLKETILNIQKSAPDKEVPLSIVVISDRDWFVGDAAQADKQLAYTLLLAENICQKHGVMVENLVSEIVDMGLGKQISKIRPSLSFIGAEEIMSRVTAQVAESSELNEVWKDILNAEGDEIYIKEIGLYMKEGEKISFSELSERAVLRREVAIGYVKDGKQHINPINKSEPLFLEMNDSLIVISEFEGEQPIVMDEQPIMMDEGTSG

SEQ ID NO: 20422 - DNA, 1281 bp, Sorghum bicolor
  misc_feature: Ceres ANNOT ID no. 8643076
  misc_feature: Down-regulated in root tissues in response to methyl jasmonate treatment
  misc_feature: Down-regulated in shoot tissues in response to methyl jasmonate treatment
  misc_feature: Up-regulated in shoot tissues in response to salicylic acid treatment
  misc_feature: Encodes the peptide sequence at SEQ ID NO 20423
atggccgccgccgccgccaccacgccgcactctctcctcctccagcgcgcggcgagcccggccgcgccgccgagggcgaccgccaccgccacctccctccgtcttccggcccgcgccgccaggatctcatgcgcggcggtggcggcgccgtctccagccgccgcagccgcggcggacgaggcggagcgcggcgtctacaacttcgcggcggggcccgcgacgctgccgctctccgtcctcaagcgggcgcaggcggagctggtggactaccacggctccgggatgagcatcatggagatgagccaccgcgggaaggagttcgacgccgccatcaagaaggccgaggccgacctgcgtgcgctcctcgcggtgcccgacacccacgacgtgctcttcctccagggcggagccaccacgcagttcgccgccgtcccgctcaacctctgcgcggggccctccgaccccgctgacttcgtcgtgtccggctcctggagcgacaaggccttcaaggaggccaagaagttctccgccgcctccgtcgcctggtcgggcaaggacggcaagtacaccgcgctcccgcccttcgacgccatcaagcagaatcccgaggccaggttcctccacatctgctccaacgagactatccacggcgtcgagttcaaggactacccggagccccggaacaagtcgggcatcctcgtcgccgacatgtcctccaacttctgctccaagcccgtcgacgtctcccgcttcggcgtcatctacgccggcgcgcagaagaacgtcgggccctccggcgtcaccatcgccatcgtgcgcaaggacctcatcggcgccgcgcagcccatcacgcccgtcatgcttgacttcaagacgcacgccgacaacgcctctctctacaacaccccgccctgcttcgccatctacatctgcggcctcgtcttcgaggacctgctcgcgcagggcggcctcgccgaggtcgataaaaagaacacgcacaaggccggcatcctctacgacaccatcgacgccagcggcgggtactacatctgccctgtcgacaaatcggtgcggtcgcacatgaacgtgcccttcaccctggcgaaggggccggactttgagaagcagttcatcgcagaggcagccaaggagggcatggtgcagctcaaggggcacaggtcagtcggtggcgtccgtgcttccatctacaatgccatgccactcgccggcgtggagaagcttgtcgccttcatgaaggatttccaagctaggaacccttga

SEQ ID NO: 20423 - protein, 426 aa, Sorghum bicolor
  misc_feature: Ceres ANNOT ID no. 8643076
  misc_feature: Down-regulated in root tissues in response to methyl jasmonate treatment
  misc_feature: Down-regulated in shoot tissues in response to methyl jasmonate treatment
  misc_feature: Up-regulated in shoot tissues in response to salicylic acid treatment
  misc_feature (65)..(425): SWISSPROT Homolog: EC 2.6.1.52 Phosphoserine transaminase
  misc_feature (65)..(414): Pfam ID: Aminotran_5 Pfam Description: Aminotransferase class-V
MAAAAATTPHSLLLQRAASPAAPPRATATATSLRLPARAARISCAAVAAPSPAAAAAADEAERGVYNFAAGPATLPLSVLKRAQAELVDYHGSGMSIMEMSHRGKEFDAAIKKAEADLRALLAVPDTHDVLFLQGGATTQFAAVPLNLCAGPSDPADFVVSGSWSDKAFKEAKKFSAASVAWSGKDGKYTALPPFDAIKQNPEARFLHICSNETIHGVEFKDYPEPRNKSGILVADMSSNFCSKPVDVSRFGVIYAGAQKNVGPSGVTIAIVRKDLIGAAQPITPVMLDFKTHADNASLYNTPPCFAIYICGLVFEDLLAQGGLAEVDKKNTHKAGILYDTIDASGGYYICPVDKSVRSHMNVPFTLAKGPDFEKQFIAEAAKEGMVQLKGHRSVGGVRASIYNAMPLAGVEKLVAFMKDFQARNP

SEQ ID NO: 20424 - DNA, 2868 bp, Sorghum bicolor
  misc_feature: Ceres ANNOT ID no. 8643073
  misc_feature: Up-regulated in shoot tissues in response to methyl jasmonate treatment
  misc_feature: Up-regulated in root tissues in response to methyl jasmonate treatment
  misc_feature: Up-regulated in shoot tissues in response to salicylic acid treatment
  misc_feature: Encodes the peptide sequence at SEQ ID NO 20425
atggccgccgtcgcgccgcccccggctcccgcgcccgccgcgcctgcaccggctgctgctgctgctgctgctccggctccggctcctgccaccgtccctgtcgcggatcaaaccacggatctgctgcagaagctgtcgctggatccgcagcccaaggcggcggatgcaacagagcctactgctgctgccaagaagggcgctgtgacgagccagccgctaagtgtggccataccgccggagcggtccatcacaccggtgcttcaagactttatggatcccaacctattctatctaccagcgtattactatggaggctacgacagttccatgagcgagtgggatgattatccaagatatctaaattcagatggagtggagattgccccagtaagttatcctataagatcttatcccttaatgtatcatgtgatgctttgcatgattgtttgcatcctgtgtcttattctcaatgtagaaatgctggaatggtcaaattgcttgctattagtgtctactggtacctgtactgtcgagtctattgttggatatgtaataagtggaaagctatttcccctctttttggggtatggtttctgctttggttggttccctcttcgttatgctctctgcactgtgaactcttgttggcaaggttgtttttcttgtctgctactatcatcatgtcatggaaattctgtatcttgtatcgtgtggggttgttggactggagcggaaaatgagctaatttccctcaaaatctctctacacatattatggactggaggcttttttttctctatccaaacaggccctgatgcttctcatatttatgctactcttggaaacatcaaggttaaccatttcaatgggtcttttggacttttgcaggcagtatatggagatatttatggatatgggtatgctccttatggggcatactctcctgccacttccccagctccaacggttgatggccagatgtttggtgcacagcattaccagtatccaactgcgtattttcagcctcctacaccagttccttctaccactcaaagtgacctccagtcttctaacaatactgaaaagccagcagctaaagcagatcctgccaagacaactgctaacggtgttccaaatggtactgctcatagtaacagtggaactgtaccccttgcgtcaagccaacaaaattcatcactgacgcctgatggaacttatagggcgccattgctaggtggagttccttctgctggttacctggacatgacatatgggtatgacagcacaggggcacactttgcatggtatgatggctctgcttatgcaaatggtcagcaaagaacaactacaactaatcattatccatcctcaacattcagtggtaatggttcctcagcaagaaatcagaacaagagctccaccacgccgcagatgggtatgcagaacagaagacctacaactacatcagcaactcctacttataccaataggatgtaccctagctcccgaccatacacccagtatgggaattcaataaaaactggtcttccctacgggagtaacggttacgattccaggatatatggtcgatggggcgttggtatggataacaggtacaggcctaggggccgtaatggatactatggttatggcaacgagagtcaggatggaacaattgagttaaacagaggtcctagatctggccgtttcaagaaccagaaattgtatggtcatactgtcactattgctgtgaaagggcagagccttccttctggtgaaagcaagaatgatagtgccgtgcccgatagagcacagttcaatagagacgacttccctgttcagtatgatgctgcaaagttcttcgtcatcaagtcgtacagcgaggatgacatccacaagagtgtaaaatacaatgtgtgggcaagcacaaccaatggaaacaagaagcttgatgctgcttatcaagaagctcagtcaaagggctctgcatgccctatattcttgtttttctcagtgaatacaagtggtcagtttgttggtgttgctgaaatgactggtgctgttgattttgagaaaactctggagtattggcagcaggacaagtggaatggttccttctctgttaagtggcatattgtcaaggacgtgcctaacaatattctcaagcacatcatcctagagaacaatgagaacaagcctgtcacgaatagccgtgacacccaggagatacaccttgaacaaggccttcagatgctcaagatcttcaaggatcatgtcagcaagacatccatcctggatgactttaccttctatgagagccgccagaaattgatgcaggataagaggtcgaaacagcagcaggtccaaaagcaggtctgggacagtaggacccccatttctgtcaccagcgagcaacagcaggaagctgctaatgggaagcccaatccgtctgatgtaccaaatggtgtcactgcagaggtgaaggcggtgaaggctcctgcagagaaacccgtcctcgccaatggagtcaccaacggagtaaccaccactcccgctgtttcctatgcagctaaggtggcccaaacagcaacagggaaacccatcctcgccaatggagtcgccaagaccgctcggatagaggtgccatgtaagacacatttgcgccacaaaatagctggtgcaggttactgctatgtcctgtgtgctgtccccggggcaaagggaggagagggagatttttcttcgacggtggaaactggaagggatgggcctgtggctggtgaatccggttggggaagctctggcctaatacgggtgttcaatttcattccatcaacgcaccgcgctatcctcttggaggagccgtaa

SEQ ID NO: 20425 - protein, 955 aa, Sorghum bicolor
  misc_feature: Ceres ANNOT ID no. 8643073
  misc_feature: Up-regulated in shoot tissues in response to methyl jasmonate treatment
  misc_feature: Up-regulated in root tissues in response to methyl jasmonate treatment
  misc_feature: Up-regulated in shoot tissues in response to salicylic acid treatment
  misc_feature (668)..(758): Pfam ID: YTH Pfam Description: YT521-B-like family
MAAVAPPPAPAPAAPAPAAAAAAAPAPAPATVPVADQTTDLLQKLSLDPQPKAADATEPTAAAKKGAVTSQPLSVAIPPERSITPVLQDFMDPNLFYLPAYYYGGYDSSMSEWDDYPRYLNSDGVEIAPVSYPIRSYPLMYHVMLCMIVCILCLILNVEMLEWSNCLLLVSTGTCTVESIVGYVISGKLFPLFLGYGFCFGWFPLRYALCTVNSCWQGCFSCLLLSSCHGNSVSCIVWGCWTGAENELISLKISLHILWTGGFFFSIQTGPDASHIYATLGNIKVNHFNGSFGLLQAVYGDIYGYGYAPYGAYSPATSPAPTVDGQMFGAQHYQYPTAYFQPPTPVPSTTQSDLQSSNNTEKPAAKADPAKTTANGVPNGTAHSNSGTVPLASSQQNSSLTPDGTYRAPLLGGVPSAGYLDMTYGYDSTGAHFAWYDGSAYANGQQRTTTTNHYPSSTFSGNGSSARNQNKSSTTPQMGMQNRRPTTTSATPTYTNRMYPSSRPYTQYGNSIKTGLPYGSNGYDSRIYGRWGVGMDNRYRPRGRNGYYGYGNESQDGTIELNRGPRSGRFKNQKLYGHTVTIAVKGQSLPSGESKNDSAVPDRAQFNRDDFPVQYDAAKFFVIKSYSEDDIHKSVKYNVWASTTNGNKKLDAAYQEAQSKGSACPIFLFFSVNTSGQFVGVAEMTGAVDFEKTLEYWQQDKWNGSFSVKWHIVKDVPNNILKHIILENNENKPVTNSRDTQEIHLEQGLQMLKIFKDHVSKTSILDDFTFYESRQKLMQDKRSKQQQVQKQVWDSRTPISVTSEQQQEAANGKPNPSDVPNGVTAEVKAVKAPAEKPVLANGVTNGVTTTPAVSYAAKVAQTATGKPILANGVAKTARIEVPCKTHLRHKIAGAGYCYVLCAVPGAKGGEGDFSSTVETGRDGPVAGESGWGSSGLIRVFNFIPSTHRAILLEEP

SEQ ID NO: 20426 - DNA, 2433 bp, Sorghum bicolor
  misc_feature: Ceres ANNOT ID no. 8643118
  misc_feature: Up-regulated in root tissues in response to salicylic acid treatment
  misc_feature: Up-regulated in shoot tissues in response to methyl jasmonate treatment
  misc_feature: Up-regulated in shoot tissues in response to salicylic acid treatment
  misc_feature: Encodes the peptide sequence at SEQ ID NO 20427
atggcgagccaaggcgagccgtcttcgtcggatccgaaggggaagaaggattactcgacggcgatcctcgagaggaagaagtcgccgaaccggctggtggtcgacgaggccaccaatgatgacaactccgtcgtcgctctgcacccggacactatggagaggctccagctcttccgcggtgacactgtcctgctcaagggtaagaagagaaaggacactatctgcatcgtgcttgcagatgacacgtgtgaggagccaaaggtccgaatgaataaggttgtcaggaagaacttgagggtacggcttggtgatgtggtatctgtccatcaatgcccagatgtcaaatacgggaagcgcgtgcacatacttccaattgatgacaccattgaaggcatcactggcaacttatttgacgcctttctaaaaccatacttccttgaagcctatcgtcctttgaggaaaggagaccttttcctagtcagaggtggcatgagaagtgtagaattcaaagtcatagagactgatcctatagagtattgtatcgttgcaccagatacagaaatattctgtgagggtgagcctgttaagagggaggatgaggaaagacttgatgaggttggctatgatgatgttggtggagttagaaagcagatggcccaaattagagaactggttgaacttccactgcgtcatccccagcttttcaagtctattggtgtgaagccaccaaagggcatattgctgtttgggcctcctggatctggcaagacccttattgctagagctgtagctaatgagacaggtgctttcttctttttgataaatgggccagaaatcatgtcaaaactagcaggagaaagtgaaagtaatctcagaaaggcatttgaagaagctgaaaaaaatgcaccttccatcatttttattgatgagatagattccatagctcctaagagagaaaagacccatggagaagttgaaaggcgtattgtttcacagctcttgactcttatggatggtctgaagtctcgtgcacatgttattgttatgggtgccacaaaccgtccaaacagtatcgatcctgctcttagaaggtttggtaggtttgatcgtgagattgatattggtgttccagatgaagttggacgccttgaggttctccggattcacaccaaaaacatgaagttggctgaaaatgttgacttggagctcattgcgaaggatacccatggttatgttggtgctgatcttgcagccctttgtaccgaagctgctcttcaatgcatccgtgagaagatggatattatagatcttgaggatgagaccatagatgctgagatattgaactctatggctgtcacaaatgaccatttcaagactgcacttgggacaagcaacccatctgctctgcgtgaaactgttgttgaagttccaaatgtctcttgggaagatattggtggtctggaaaatgttaagagggagctacaggagactgttcaatatcctgtagagcatcccgagaaatttgaaaagtttggcatgtctccttcaaagggtgttttgttttatggccctcctggctgtggcaagactttgttggccaaggcaattgctaatgaatgccaggctaacttcattagtgtgaagggtcctgaactgcttaccatgtggtttggtgagagcgaggctaatgtccgtgagatttttgataaggctaggcagtctgctccatgtgtcctcttcttcgatgagcttgattccattgctactcagagaggaagcagtgttggtgacgcaggtggtgctgctgatagggtgttgaaccagctgcttactgagatggatggcatgaatgctaagaagactgttttcatcatcggtgcaactaacagaccagatatcattgaccctgccctgctgaggccagggcgtctggatcagcttatctacattcctctacctgatgagcaatccaggctccagatcttcaaagcctgcctcaggaagtctcctgtggctaaggatgtcgacttgaatgctcttgccaaatacacccagggtttcagtggtgcagatatcactgagatctgccagcgtgcgtgcaagtatgctatcagggagaacatcgagaaggatatcgagagggagcggcgcaggaaggacaaccctgaggctatggaggaagacgaggtagacgacattgctgagatcaaggctgctcacttcgaggagtcgatgaagttcgcccgacgcagtgttagtgatgccgacatccgcaagtaccaggccttcgcccagacactccagcagtcccgtgggtttggcagcgagttccgtttcccggaccaaccgacggcagctgcgggatctgctggtgcggccgatccttttgcatccgctgcagcagcagctgacgatgatgacttgtataattag

SEQ ID NO: 20427 - protein, 810 aa, Sorghum bicolor
  misc_feature: Ceres ANNOT ID no. 8643118
  misc_feature: Up-regulated in root tissues in response to salicylic acid treatment
  misc_feature: Up-regulated in shoot tissues in response to methyl jasmonate treatment
  misc_feature: Up-regulated in shoot tissues in response to salicylic acid treatment
  misc_feature (193)..(487): SWISSPROT Homolog: EC 3.6.4.3 Microtubule-severing ATPase
  misc_feature (245)..(429): Pfam ID: AAA Pfam Description: ATPase family associated with various cellular activities (AAA)
  misc_feature (518)..(705): Pfam ID: AAA Pfam Description: ATPase family associated with various cellular activities (AAA)
  misc_feature (28)..(114): Pfam ID: CDC48_N Pfam Description: Cell division protein 48 (CDC48), N-terminal domain
MASQGEPSSSDPKGKKDYSTAILERKKSPNRLVVDEATNDDNSVVALHPDTMERLQLFRGDTVLLKGKKRKDTICIVLADDTCEEPKVRMNKVVRKNLRVRLGDVVSVHQCPDVKYGKRVHILPIDDTIEGITGNLFDAFLKPYFLEAYRPLRKGDLFLVRGGMRSVEFKVIETDPIEYCIVAPDTEIFCEGEPVKREDEERLDEVGYDDVGGVRKQMAQIRELVELPLRHPQLFKSIGVKPPKGILLFGPPGSGKTLIARAVANETGAFFFLINGPEIMSKLAGESESNLRKAFEEAEKNAPSIIFIDEIDSIAPKREKTHGEVERRIVSQLLTLMDGLKSRAHVIVMGATNRPNSIDPALRRFGRFDREIDIGVPDEVGRLEVLRIHTKNMKLAENVDLELIAKDTHGYVGADLAALCTEAALQCIREKMDIIDLEDETIDAEILNSMAVTNDHFKTALGTSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMNAKKTVFIIGATNRPDIIDPALLRPGRLDQLIYIPLPDEQSRLQIFKACLRKSPVAKDVDLNALAKYTQGFSGADITEICQRACKYAIRENIEKDIERERRRKDNPEAMEEDEVDDIAEIKAAHFEESMKFARRSVSDADIRKYQAFAQTLQQSRGFGSEFRFPDQPTAAAGSAGAADPFASAAAAADDDDLYN

SEQ ID NO: 20428 - DNA, 2703 bp, Sorghum bicolor
  misc_feature: Ceres ANNOT ID no. 8643206
  misc_feature: Up-regulated in shoot tissues in response to salicylic acid treatment
  misc_feature: Encodes the peptide sequence at SEQ ID NO 20429
atggctctggcctctggcgtccgggtcgctggctcgctgcaagcctgcaacgacggaacagaggcacgggagcaggaaaacagagacagccagacatgcgaaaaggcagcaccgtgcagctctccagtgagaggaactcaatctgaacggaaggaatacgttggatcaaaggcattgactggcagcacaaggaggagctcgtccgatagatcgggtggtacgcccatgaagatgctgatagctcaggaaatggcgaaggagggggacgcaaatcagaagaccactaatgttgtagcaaggctgatggggcttgacgataacgtggatcttcctaagcatgtagtgccttcaaacaggaggagtttcccggatggccatttatctgctacaatggcaagagttaacaaccaaatttcatttgagaagcacacaagttccgccgaagatgtggagtacaaggatgtctacgaagttgggtaccaaccaccaagaggtgatgaatatccaagaaggaggccgaatgaagatcatgacaagagaaggatggatcttgtccgccagaagtttgttgaagcaaagaggcttgcatcacatgataatatcctccagtcgaaggaattccacgatgctcttgaggttctgaattcaaacaaagacttgtttctcaaatttcttgaagaacctaactctctctttacaaagcaatctggaggacacaattctgcaccaacgtcacctcagagaaagcgcattactgtgttgaagccctcaaaatcagtggagttgaagggtgacaaagcaattaaaaggatgaaaaaccatgcagtcgatggaaacagaatagaaaggagcaacgtacacaagtctgatgctgctcatgtgaaagaagataggcttcccaaacacaccaggatagtggtcttgaaacctacctcagtaattacttccacggagcaatctgagcaaaattatcatgctgatctggatgattctgaagcacctggtctatcaaggcatttgagtgatgagatagattggtcagtgcatggaatttgtcgacaccacacagaatctttgcagggttgcatacagtcaaatttgttcagcgcagatagaccataccatcggtatgctgaagaagagagtgactcggatattggaaccccaacatcacatcattcttgggagtacatctaccagtttagcaatccttactttggctctttgagccatgcttcttgctcccctgagtcacatgtaactagggaggctaagaaacatgcttctgacagatgggcaattgttccatccagtgagatatcccagcaaaaggtaccagtgcgaagaagtttgagcacacttggtgaaatgcttgccatgcctgatatgaagaaagaagaggttgctgatcaagcatctcctgacgctaatacccaccagttgtgtgaaccaacaggcggtgtatcatctaattctgctgttgatgaaggtgagggagaacgctccctcaggaaaatctcgaggtcaagatctgttccggtctcttcaacagcttttgatagcctgcggttagatggtggacgtttggatgctcaacataaagaacctacagtgccaaaggaggtcaaacctaagaacgggaaatcatctttgaagggaaaaatcacgagtttcttctcaaaacgaaagaaagcagaaaaagagaaggctaacccatctcccttgggaaccctgaacagtcgagcttcgtcagcaagtactgtagcagttggtaaatcagatgttccacaacatgtttgtactagtttacaagatgatgttgcttctgaaaatttagaagaacagtttaatcatggaccaattggagttccggttgatgaacccgaagcaccctctgtgtctaagtctccagcttcccatgagaaggcactatcgtttgagattcgaacttcccacttcgatcagcccagccctacatcagttcttgatttacagtttgaggacatcagtgagaaatcccccatttcatcagaaagtgcaattactgctaagcaagaacctctatctaggtctcttccaattggatcaattgcaaggaccttatcgtgggatgatgcttcccaagaggctccattgtgttctaccaaaggagataaccttgagcaagagcagtatgagttcgttgagaagactctaacatctgcaggcttctgtaatgagaaggtccaggacatctttgtccgttggcattcacttgactgccctttgaacccagccgtgcttgaccagctgctggaacgcaaagtggaggatgccaagtgcagagagagacggtcaaaccaaaggcttctcattgattctgtaaatgctgccctactagacattggccaaagtaaactttggggtgcatacccttgcactgcacgccattctaatgcaccgggagttgctacatgtgatgtgctagtaaccgacgaagcatggaggttagtaaagagttggctcttcgatgatgagaatgatattgctggtttgggagactatccaggccttgcagcagattgggttgtcggtaaggagattaatggcaaagggtggcctgaaatgctgcgcttggaggtggatgaaatcagcaaggagatatgcgaggaagtcctgggcgagttggtcggggaggcattttcacagcttgcggatcattga

SEQ ID NO: 20429 - protein, 900 aa, Sorghum bicolor
  misc_feature: Ceres ANNOT ID no. 8643206
  misc_feature: Up-regulated in shoot tissues in response to salicylic acid treatment
MALASGVRVAGSLQACNDGTEAREQENRDSQTCEKAAPCSSPVRGTQSERKEYVGSKALTGSTRRSSSDRSGGTPMKMLIAQEMAKEGDANQKTTNVVARLMGLDDNVDLPKHVVPSNRRSFPDGHLSATMARVNNQISFEKHTSSAEDVEYKDVYEVGYQPPRGDEYPRRRPNEDHDKRRMDLVRQKFVEAKRLASHDNILQSKEFHDALEVLNSNKDLFLKFLEEPNSLFTKQSGGHNSAPTSPQRKRITVLKPSKSVELKGDKAIKRMKNHAVDGNRIERSNVHKSDAAHVKEDRLPKHTRIVVLKPTSVITSTEQSEQNYHADLDDSEAPGLSRHLSDEIDWSVHGICRHHTESLQGCIQSNLFSADRPYHRYAEEESDSDIGTPTSHHSWEYIYQFSNPYFGSLSHASCSPESHVTREAKKHASDRWAIVPSSEISQQKVPVRRSLSTLGEMLAMPDMKKEEVADQASPDANTHQLCEPTGGVSSNSAVDEGEGERSLRKISRSRSVPVSSTAFDSLRLDGGRLDAQHKEPTVPKEVKPKNGKSSLKGKITSFFSKRKKAEKEKANPSPLGTLNSRASSASTVAVGKSDVPQHVCTSLQDDVASENLEEQFNHGPIGVPVDEPEAPSVSKSPASHEKALSFEIRTSHFDQPSPTSVLDLQFEDISEKSPISSESAITAKQEPLSRSLPIGSIARTLSWDDASQEAPLCSTKGDNLEQEQYEFVEKTLTSAGFCNEKVQDIFVRWHSLDCPLNPAVLDQLLERKVEDAKCRERRSNQRLLIDSVNAALLDIGQSKLWGAYPCTARHSNAPGVATCDVLVTDEAWRLVKSWLFDDENDIAGLGDYPGLAADWVVGKEINGKGWPEMLRLEVDEISKEICEEVLGELVGEAFSQLADH

SEQ ID NO: 20430 - DNA, 1656 bp, Sorghum bicolor
  misc_feature: Ceres ANNOT ID no. 8643214
  misc_feature: Up-regulated in shoot tissues in response to salicylic acid treatment
  misc_feature: Encodes the peptide sequence at SEQ ID NO 20431
atgagcgggtggagctggctctgctgtggccgatccaaagccggaggcagcgatgtccggctccccgagcccttccagctgccggcgcccttgcccgattggccgcaaggaggggattttgctaagggcacaatatgcataggagagcttgatgttgtaaatattaccaaattccgcaatatatggacctgctcagatgctacattttatgagccagaaggaattcctgatggtttccactgccttgggcactacgcccaacagaatgaccgccccttacagggatttcttcttgtggcaagggaagtggctagccaccaagttattaatagcaagcccgcccttgagaaaccattagattactcccttgtttggaccagtgctgacttaaatgaagatgacaacagcgaatgtggttgcatctggttgccatgtccaccgaatgggtataaagcccttggctatgtggttactaaaggaccaaagaagccctcactggaagcagttcgatgtgtgcgagatgacctaacagacacatgtgacaatttccgttcaattgtaaatatggataatgcatgccagatttggaagacaaggccttgccaccgaggagtgagagggcacggtataccggttggtactttctcctgtgcaactgattcaacagatagcgatgaatcaagcactccctgcttgaaaaatgttgacccaaatttgagatccatgcctaatttagagcagatcaatgctctgatcaagcactatggcccaactgttttcttccacccacaagagacatacttaccatcatcagtttcttggttctttgagaatggagcgacattgtacaagaaagatgcaaaaatgggagatgcaatactccctggtggcttgaacctgcctgttggtgggacaaatgatggtgagtactggattgatctccctgacgatgacaggaaggagcttgtcagagatggcaatctgaagagtgctgagctatatgctcatgtgaagccagcttatggagggaccttcactgacattgcaatgtgggtattttgcccattcaacgggcctgccactatcaaggtttcatttgcaagttttgctctacagaaagtcggtaggcatattggagattgggagcatttcaccctccgagtgagtaacttctcaggtgagctgtcatctatctacttctcgcagcacagtgggggtgaatgggttgaagcttgtgatctggagttcatctctgggaacaaagcaattgtttactcgtcgaggaatgggcacgcaagctacccccaccctggctgctacctgatggggtctgagaagcttggcgtcggagttagaaacgatgtggcccgaagtgatttatcagtggattcgagcacgcagtataaaatcatctcagcagggcatctcggagatgctgttgtggaaccatgctggctgcaatacatgagggagtggggacccgcagtcacgtacagctcacgttcagagatagacacggcgcttagcttcttgccgttctttctccggtacacagtggaagcaatattcaacagccttccggcggaattgtacgaggaggaaggtcctacaggacccaaggagaagaacaactgggaaggcgatgagagatgctag

SEQ ID NO: 20431 - protein, 551 aa, Sorghum bicolor
  misc_feature: Ceres ANNOT ID no. 8643214
  misc_feature: Up-regulated in shoot tissues in response to salicylic acid treatment
MSGWSWLCCGRSKAGGSDVRLPEPFQLPAPLPDWPQGGDFAKGTICIGELDVVNITKFRNIWTCSDATFYEPEGIPDGFHCLGHYAQQNDRPLQGFLLVAREVASHQVINSKPALEKPLDYSLVWTSADLNEDDNSECGCIWLPCPPNGYKALGYVVTKGPKKPSLEAVRCVRDDLTDTCDNFRSIVNMDNACQIWKTRPCHRGVRGHGIPVGTFSCATDSTDSDESSTPCLKNVDPNLRSMPNLEQINALIKHYGPTVFFHPQETYLPSSVSWFFENGATLYKKDAKMGDAILPGGLNLPVGGTNDGEYWIDLPDDDRKELVRDGNLKSAELYAHVKPAYGGTFTDIAMWVFCPFNGPATIKVSFASFALQKVGRHIGDWEHFTLRVSNFSGELSSIYFSQHSGGEWVEACDLEFISGNKAIVYSSRNGHASYPHPGCYLMGSEKLGVGVRNDVARSDLSVDSSTQYKIISAGHLGDAVVEPCWLQYMREWGPAVTYSSRSEIDTALSFLPFFLRYTVEAIFNSLPAELYEEEGPTGPKEKNNWEGDERC

SEQ ID NO: 20432 - DNA, 1692 bp, Sorghum bicolor
  misc_feature: Ceres ANNOT ID no. 8643227
  misc_feature: Up-regulated in shoot tissues in response to methyl jasmonate treatment
  misc_feature: Up-regulated in shoot tissues in response to salicylic acid treatment
  misc_feature: Encodes the peptide sequence at SEQ ID NO 20433
atggcgctcaacctggcccaccagaccggcgcggccgtgacggcggcaccgacggcgccacgctccgccgtcgtcgcggcggccgccaccgtgtcggcgccgtccgcgtcggcgtccgccgccccggcgcccgcgctccagatgcagacgatgacggtggacgcggcgcccgcgcaggcgccggacgccgtgaagccagacctcgccatggcgtgccaggcgctggtggaaggaagcacgcccgacgaggcgcagcacgccgacgtcgccgccgagctcaagaccaaggccggtgtgcccgtcttcgtgatgatgccgctcgacaccgtgcgtaaggacggcaactcgctcaaccgccggaaggccgtcgaggccagcctggcggcgctcaagagcgccggggtggaaggcatcatggtggacgtctggtggggcatcgccgaggctgatggccccgggcagtacaactttaacgggtacatggagctcatggagatggccaggaagaccgggctcaaggtccaggccgtcatgtccttccaccagtgcggcggcaacgtcggcgattcagtcaccataccacttccgagatgggttgtggaggagatggacaaggaccaggacctggcctacaccgaccggagcggccgccggaactacgagtacgtctccctcggctgcgacacgctgcccgtgctcaagggccgcacgcccatccagtgctacgccgacttcatgcgcgccttccgcgaccacttcgccaccttcatgggcaacaccatcgtggagatccaggtcggcatgggccctgccggcgagctgcgctacccgtcctacccggagagcgacggcacctggtccttccctggcatcggcgagttccagtgctatgacaggtacatgttgagtagcttgaaggcggctgctgagtcggtgggcaagccggagtggggcaacggtggtccgggcgacgccggcggctacaagaactggcctgaggacacgggcttcttccgtcgcgagggcgggtggagcaacgagtacgggcagttcttcatgagctggtactcgcagatgctcctggagcacggcgagcgcatcctgtcggcggcgacgggggtgtacacgggttcccccggcgtgaagatctcggtgaaggtggccgggatccactggcactacggcacccggtcgcacgcggcggagctgacggcggggtactacaacacccggcaccacgacgggtacgcgcccatcgcgcgcatgctggcgcgccacggcgccgtgctcaacttcacgtgcgtggagatgcgggaccacgagcagccgcaggacgcgcagtgcaggcccgaggcgctggtgcagcaggtggcggccgcggcgcgggaggccggcgtcgggctggcgggcgagaacgcgctgccgcgctacgacgagacggcgcacgaccaggtggtggccacggcggccgacagggccgccgaggaccgcatggtggcgttcacgtacctgcgcatggggcccgacctgttccagcccgacaactggcgccgcttcgccgccttcgtcaagcgcatgtcccagccgggcgcacgggacgcgtgccgggagcaggtggagcgcgaggccgacggcgtcgcgcacgccacccagccgctcgtgcacgaggccgccgtcgcgctcaccaactga

SEQ ID NO: 20433 - protein, 563 aa, Sorghum bicolor
  misc_feature: Ceres ANNOT ID no. 8643227
  misc_feature: Up-regulated in shoot tissues in response to methyl jasmonate treatment
  misc_feature: Up-regulated in shoot tissues in response to salicylic acid treatment
  misc_feature (99)..(526): SWISSPROT Homolog: EC 3.2.1.2 Beta-amylase
  misc_feature (102)..(522): Pfam ID: Glyco_hydro_14 Pfam Description: Glycosyl hydrolase family 14
MALNLAHQTGAAVTAAPTAPRSAVVAAAATVSAPSASASAAPAPALQMQTMTVDAAPAQAPDAVKPDLAMACQALVEGSTPDEAQHADVAAELKTKAGVPVFVMMPLDTVRKDGNSLNRRKAVEASLAALKSAGVEGIMVDVWWGIAEADGPGQYNFNGYMELMEMARKTGLKVQAVMSFHQCGGNVGDSVTIPLPRWVVEEMDKDQDLAYTDRSGRRNYEYVSLGCDTLPVLKGRTPIQCYADFMRAFRDHFATFMGNTIVEIQVGMGPAGELRYPSYPESDGTWSFPGIGEFQCYDRYMLSSLKAAAESVGKPEWGNGGPGDAGGYKNWPEDTGFFRREGGWSNEYGQFFMSWYSQMLLEHGERILSAATGVYTGSPGVKISVKVAGIHWHYGTRSHAAELTAGYYNTRHHDGYAPIARMLARHGAVLNFTCVEMRDHEQPQDAQCRPEALVQQVAAAAREAGVGLAGENALPRYDETAHDQVVATAADRAAEDRMVAFTYLRMGPDLFQPDNWRRFAAFVKRMSQPGARDACREQVEREADGVAHATQPLVHEAAVALTN

SEQ ID NO: 20434 - DNA, 1611 bp, Sorghum bicolor
  misc_feature: Ceres ANNOT ID no. 8643255
  misc_feature: Down-regulated in shoot tissues in response to salicylic acid treatment
  misc_feature: Up-regulated in shoot tissues in response to methyl jasmonate treatment
  misc_feature: Up-regulated in root tissues in response to methyl jasmonate treatment
  misc_feature: Encodes the peptide sequence at SEQ ID NO 20435
atggagccgttctttttgttcatagagctggcccttgttctctgcttcctcaccctctactaccgccacttgcaatcgaagaaaacgagtcctttggagccgaccgaatggccaatagtcgggcatctccccggcttggtcgccaacatccatcacttccacgactgggccaccggcgtcctcaccggcgcgggctgcaacttcgaagcacgcggaggccgcaccggcctgcgctacttcatcacctgcgacccctccaacgtgcgccacatcttcacgtccaacttcgccaactaccctaaaggcgaagagtacgccgtgatcttcgacgtccttggcggcggcatcttcaacgccgacggggagtcgtggcggcggcagcgggtgatggcccagatgctcatgaccggccctcggttccgagccttcacggcgcggtgcagtcgcgacaaggtggagcggagcctcctgcctttcctcgcccaccacgccgccgacgagggaagcagcaggccgccgtgcgacctgcacgacgtgttcctgaggctgacgttcgacatgacatgcagtctcgtcttcggcgtcgaccctgggtgcctggcggtcggcttgcccgtcgtccccttcgcgcgcgcgatggacgacgcgctggagacgcttttcctccggcacatcacccccgtggcgtactggaagctgatgaacgtgctggaggtagggcaggagaagaagatggccgcggctcggaggacgatcgacagcttcgtcgccgccaccgtcgcaaaacgcagggccgacaagctcaaagaatgcgaaggcgtcagcaattcgtttgacctgctgtcatccttcatctgtcacgaggactcgagtagtggtgcaaatgacgatgtgttcttacgtgacacgacggtgaacctcctgctcgccggccgcgacaccacgggcgcggcgctgtcgtggttcttctacctcatctccaagaaccctcgcgtcgagcagaaactactggacgagctcgcgcccatcgcttcacggcggcggaaaggtgcagatgatgatgctgcagacacggcggcggccagcggctgcatggtgaccttcgacgcgaacgagctcggcagcctggtttacctgcacgccgcgctgagcgagtgcttgaggctgtacccgtccgtgcctttcgagcacaaggtcgcggcggccgccgacgttctgccgagcgggcaggagttgaaggcaggagacaaggtactggtgttcaactactccatgggcaggatgaagggcgtatggggcaaggactgcatggagttccggccggagagatggctcaacgaggaagggaccaagcttcggtacgagccgtcctacaagttcatctccttcaacgccgggccacggacgtgcctcggcaaggagatggcgttcgtgcagatgaagaccgtggcggcggccgtgctgtggaacttcgccgtcgaggtggtgcccggccacgtcgtggagccgaagctgtccatcatacttcacatgaagaatgggcttgccgtcaaggttaggagaagggatgggacggcggctccgtcgtcgtgcgtcacggcttgcatctga

SEQ ID NO: 20435 - protein, 536 aa, Sorghum bicolor
  misc_feature: Ceres ANNOT ID no. 8643255
  misc_feature: Down-regulated in shoot tissues in response to salicylic acid treatment
  misc_feature: Up-regulated in shoot tissues in response to methyl jasmonate treatment
  misc_feature: Up-regulated in root tissues in response to methyl jasmonate treatment
  misc_feature (367)..(527): SWISSPROT Homolog: EC 1.14.14.1 Unspecific monooxygenase
  misc_feature (112)..(345): SWISSPROT Homolog: EC 1.14.13.15 Cholestanetriol 26-monooxygenase
  misc_feature (31)..(519): Pfam ID: p450 Pfam Description: Cytochrome P450
MEPFFLFIELALVLCFLTLYYRHLQSKKTSPLEPTEWPIVGHLPGLVANIHHFHDWATGVLTGAGCNFEARGGRTGLRYFITCDPSNVRHIFTSNFANYPKGEEYAVIFDVLGGGIFNADGESWRRQRVMAQMLMTGPRFRAFTARCSRDKVERSLLPFLAHHAADEGSSRPPCDLHDVFLRLTFDMTCSLVFGVDPGCLAVGLPVVPFARAMDDALETLFLRHITPVAYWKLMNVLEVGQEKKMAAARRTIDSFVAATVAKRRADKLKECEGVSNSFDLLSSFICHEDSSSGANDDVFLRDTTVNLLLAGRDTTGAALSWFFYLISKNPRVEQKLLDELAPIASRRRKGADDDAADTAAASGCMVTFDANELGSLVYLHAALSECLRLYPSVPFEHKVAAAADVLPSGQELKAGDKVLVFNYSMGRMKGVWGKDCMEFRPERWLNEEGTKLRYEPSYKFISFNAGPRTCLGKEMAFVQMKTVAAAVLWNFAVEVVPGHVVEPKLSIILHMKNGLAVKVRRRDGTAAPSSCVTACI

SEQ ID NO: 20436 - DNA, 1335 bp, Sorghum bicolor
  misc_feature: Ceres ANNOT ID no. 8643395
  misc_feature: Down-regulated in shoot tissues in response to methyl jasmonate treatment
  misc_feature: Up-regulated in root tissues in response to methyl jasmonate treatment
  misc_feature: Down-regulated in shoot tissues in response to aminocyclopropane carboxylic treatment
  misc_feature: Down-regulated in shoot tissues in response to salicylic acid treatment
  misc_feature: Up-regulated in shoot tissues in response to methyl jasmonate treatment
  misc_feature: Up-regulated in root tissues in response to salicylic acid treatment
  misc_feature: Encodes the peptide sequence at SEQ ID NO 20437
atggccacccacgcagctctcgccgcctcgcgcatccccaccagcgcccggctgcacagcagggcggcgtccaggcagagggtggacttcgccgacttctccgggctcaggccaggatcttgctccgtgagcactgccgcgagggaggtctccttctccgacgtccttggtgcgcagctcgtcgccaaggccactggagagaacgcggtgagggcgcccgctgaggcgaagctgaaggtcgccatcaacggcttcggccgcattggccggaacttcctccggtgctggcacggccgtgaggactccccgctcgacgtcgtcgtcgtgaacgacagcggaggcgtcaggaacgcgtctcaccttctcaagtatgactcgatgctgggcaccttcaaggctgacgtcaagatcgtcgacgacacgaccatcagcgtcgatggcaagcccatcaccatcgtctccagcagggaccctctcaagctcccatgggctgagctcggcattgacatcgtcatcgagggcaccggagtcttcgtcgacggccccggcgccggcaagcacatccaggccggcgcaaagaaggtcatcatcactgctccggccaagggcgccgacatcccgacctatgtcgtcggtgttaacgagggcgactacgaccacagcgtcgccgacatcatcagcaacgcttcctgcacgaccaactgcctcgcgccattcgtcaaggtcttggacgaggagttcggaatcgtgaaggggaccatgacgacaacgcactcgtacacgggtgaccagaggctgctggacgcgtcccaccgtgacctccggagggcccgtgcggcggcgctgaacatcgtgccgacgagcacgggcgccgccaaggccgtggcgctggtgctgccccagctgaaggggaagctgaacggcatcgcgctccgtgtgccaaccccgaacgtgtccgtggtggacctggtgatcaacaccgtgaagacgggcatcactgccgacgacgtgaacgcggcgttccgcaaggccgccgacggcccgctgaatggcgtcctgtcggtctgcgacgtgccgctcgtgtccgtggacttcaggtgctccgacgtgtcctccaccatcgacgcgtcgctcaccatggtcatgggcgatgacatggtcaaggtcgtcgcctggtacgacaacgagtgggggtacagccaacgcgtggttgatctggcgcacctggtggcggccaagtggccaggcgcggcggcggcgggcagcggcgaccctctggaggacttctgcaaggacaaccccgagaccgacgagtgcaaggtgtacgaagcatga

SEQ ID NO: 20437 - protein, 444 aa, Sorghum bicolor
  misc_feature: Ceres ANNOT ID no. 8643395
  misc_feature: Down-regulated in shoot tissues in response to methyl jasmonate treatment
  misc_feature: Up-regulated in root tissues in response to methyl jasmonate treatment
  misc_feature: Down-regulated in shoot tissues in response to aminocyclopropane carboxylic treatment
  misc_feature: Down-regulated in shoot tissues in response to salicylic acid treatment
  misc_feature: Up-regulated in shoot tissues in response to methyl jasmonate treatment
  misc_feature: Up-regulated in root tissues in response to salicylic acid treatment
  misc_feature (1)..(443): SWISSPROT Homolog: EC 1.2.1.13 Glyceraldehyde-3-phosphate dehydrogenase (NADP(+)) (phosphorylating)
  misc_feature (236)..(393): Pfam ID: Gp_dh_C Pfam Description: Glyceraldehyde 3-phosphate dehydrogenase, C-terminal domain
  misc_feature (78)..(231): Pfam ID: Gp_dh_N Pfam Description: Glyceraldehyde 3-phosphate dehydrogenase, NAD binding domain
MATHAALAASRIPTSARLHSRAASRQRVDFADFSGLRPGSCSVSTAAREVSFSDVLGAQLVAKATGENAVRAPAEAKLKVAINGFGRIGRNFLRCWHGREDSPLDVVVVNDSGGVRNASHLLKYDSMLGTFKADVKIVDDTTISVDGKPITIVSSRDPLKLPWAELGIDIVIEGTGVFVDGPGAGKHIQAGAKKVIITAPAKGADIPTYVVGVNEGDYDHSVADIISNASCTTNCLAPFVKVLDEEFGIVKGTMTTTHSYTGDQRLLDASHRDLRRARAAALNIVPTSTGAAKAVALVLPQLKGKLNGIALRVPTPNVSVVDLVINTVKTGITADDVNAAFRKAADGPLNGVLSVCDVPLVSVDFRCSDVSSTIDASLTMVMGDDMVKVVAWYDNEWGYSQRVVDLAHLVAAKWPGAAAAGSGDPLEDFCKDNPETDECKVYEA

SEQ ID NO: 20438 - DNA, 1581 bp, Sorghum bicolor
  misc_feature: Ceres ANNOT ID no. 8643447
  misc_feature: Up-regulated in shoot tissues in response to methyl jasmonate treatment
  misc_feature: Up-regulated in root tissues in response to methyl jasmonate treatment
  misc_feature: Encodes the peptide sequence at SEQ ID NO 20439
atgggggcgcggaggaggctgctggcggatgcgccgccggagcaccaccacaggcagggcgcgccgccgtcggactggagcgcggggtacctcaacgggtggctgtcgcagccgacgcccatcttcgggctccgcctctgggtgctcatcggcatcgccgtcggcgccgccatcgtgctcgtgctcctcctcatcctcgtctgcctctcccgccgccgccgccgccgcggcgacctgctcgccgccaacctctaccccgccgccgacaccaagctgctcaagcagcacctgcatcagcaggccacgtccacgcccaccaaggacatccaggagatcgtccgccgccagcaggcgcagacgccgccgcctccgccggcggcgccgcagcccgcggtgcagctcgccaaggccgtggcggagccacagactccgccgccgccgccgcaacagcagcacaggccacccgcgcggaagacgccgggcagcggcatgtcggccacaactagcggcgggagcgaacgggacggtgccacgcctaggagcaccggcagcgcggggatgccggaggtttcgcacctcgggtggggccactggttcacgctccgtgagctggaggaggccaccgacgggctcgccgaggagaatgtgatcggggagggtggctacgggatcgtgtacaagggcacgttgcacgactccactttgatcgccgtcaaaaatctgctcaataataggggccaggccgagaaggagttcaaggtggaagtcgaagcaattggtcgtgttcggcacaaaaatctcgtcaggttgcttggctactgcgtagagggtgcttacaggatgcttgtgtatgagtatgtggacaatggtaatcttgatcagtggcttcacggtgatgttggggaagtgagcccactaacatgggacatcaggatgaacattatgcttgcaaccgctaaagggctggcctatcttcacgaggggctggaaccgaaggttgttcaccgtgacatcaaagctagcaatattcttcttgaccagcagtggaacgctaaagtatcagattttgggcttgcaaagctattgtgctcagagaaaagctatgttacaacccgtgttatgggaacctttggttatgtggcacctgaatatgccagcaccggaatgttgaacgagaggagtgatgtatatagctttggtgtactcataatggagatcatcactggtagatctcctgtagattatacaagagcagctggagaggtgaacttggttgagtggctcaagaccatggttgcagagaggaaagcggaggaagtagtggaccctaagatgactgaaaagccttctcccaaaacactgaagcgagcgcttctggttgcgcttcgctgcgtcgaccctgatgcgaacaagaggcctaaaatggggcatgttattcacatgctcgagatggatgatcttctattccgagatgataagaagcccgggagagatgtccatcctcagggttcagacagatacagttccaaggaggaagggagcttcagcaagcgtgagcaccaccatcatcggtacagatga

SEQ ID NO: 20439 - protein, 526 aa, Sorghum bicolor
  misc_feature: Ceres ANNOT ID no. 8643447
  misc_feature: Up-regulated in shoot tissues in response to methyl jasmonate treatment
  misc_feature: Up-regulated in root tissues in response to methyl jasmonate treatment
  misc_feature (188)..(490): SWISSPROT Homolog: EC 2.7.11.1 Non-specific serine/threonine protein kinase
  misc_feature (211)..(482): Pfam ID: Pkinase_Tyr Pfam Description: Protein tyrosine kinase
MGARRRLLADAPPEHHHRQGAPPSDWSAGYLNGWLSQPTPIFGLRLWVLIGIAVGAAIVLVLLLILVCLSRRRRRRGDLLAANLYPAADTKLLKQHLHQQATSTPTKDIQEIVRRQQAQTPPPPPAAPQPAVQLAKAVAEPQTPPPPPQQQHRPPARKTPGSGMSATTSGGSERDGATPRSTGSAGMPEVSHLGWGHWFTLRELEEATDGLAEENVIGEGGYGIVYKGTLHDSTLIAVKNLLNNRGQAEKEFKVEVEAIGRVRHKNLVRLLGYCVEGAYRMLVYEYVDNGNLDQWLHGDVGEVSPLTWDIRMNIMLATAKGLAYLHEGLEPKVVHRDIKASNILLDQQWNAKVSDFGLAKLLCSEKSYVTTRVMGTFGYVAPEYASTGMLNERSDVYSFGVLIMEIITGRSPVDYTRAAGEVNLVEWLKTMVAERKAEEVVDPKMTEKPSPKTLKRALLVALRCVDPDANKRPKMGHVIHMLEMDDLLFRDDKKPGRDVHPQGSDRYSSKEEGSFSKREHHHHRYR

SEQ ID NO: 20440 - DNA, 5769 bp, Sorghum bicolor
  misc_feature: Ceres ANNOT ID no. 8643495
  misc_feature: Up-regulated in root tissues in response to salicylic acid treatment
  misc_feature: Encodes the peptide sequence at SEQ ID NO 20441
atggcgggagcgccaggaggcggcgatgccggcggcgagcacgcggcggcgtcgtactggtacgacgcgtgcgaggacggcgcctccctgctctgcggcatcgacttcgccgcgtccgccgacttcgacccgggcctcataccggccatggactgcggtgccgacgacggcttcgtcgccgagatcgaccggatactcgagagcatcaacgccgaggtcgcccccgcgccgctgccgccgcctcctgtgcctgcgcctgcgccagcgccagcgctcgtggctccgctgcagccacagccgcagttgcaggaggcggctgcgaccgtggcccacaatgcggtggtggtggccgacgtgccacagagggcccaggccgtggaggcgaggaaggagcccaggagggagtccccggtcaccgcggccaatggcggcggggagtgcagggacggcaagcgccagcgtctcactgctggtgggaccgtgggaccgcgacacgactggcggcggcgtccgatgccgcccccgcctccatcccgtgggtgggaggaccggcgcggaaggcgggactacgacaggtctcgtaagcgcgaccgcgaccgcgacggtcactacggccatgatcaccaccgacgcgacgctcggggtttctgggagcgtgaccgtggcggcaagatggtgttccgccatggcatgtgggagtctgagacggaccgccatggaaagcgtgccaggacgcaggatggatcccctgccgcggagaataaggcggaggtggatcggacggggaacgagaagcctgtcactgaggagaaggcgaggcagtaccagctcgaggtccttgagcaagcaaagagcaggaacacaattgctttccttgaaactggtgcggggaagactctcatagctgtgttgctcatcaaaagcatctgtgacaaaatgctcaaggagaacaagaagatgctcgcggttttcttggtgcctaaggtgcctcttgtgtatcagcaagctgaagtgatacgtgacaggactgggtatcgggttgggcactactgcggcgagatggggcaggatttctgggattctagaaagtggcagcgtgagtttgagtcaaaacaggtacttgttatgacagctcaaattttgttgaacatccttaggcacagtattattaaaatggatgccatacatcttttgattttagatgagtgccatcatgcagtgaaaaagcacccatattctctagtgatgtcagaattctatcacaccactccaaaggacaagaggccagctgtgtttggcatgactgcttcacctgtcaacttgaagggagtgactagccaagaagattgtgctatcaagatacgaaatcttgagagtaaactggattgcgtagtctgtacgatcaaagatcggaaagagctggagaaacatgttcccatgcctttggaagtcattgtgcactatgacaaagcagccactcttttgtctttccatgaacaaatcaaacaaatggaggctgcagttgaagaagctgcactttctagttctaagagaactaaatggcagttcatgggagctagggatgcagggtctagagatgagctacgccttgtctatggtgtttctgagcgtacggaaagtgatggtgcagctaatttaattcagaagttgagagctataaactatgctctgggtgaactaggacagtggtgtgcttacaaggttgcacagtcattcttgacagcactccagaacgatgaaagggccaactaccaggtcgatgttaagtttcaagagtcatacttgaaaaaagtagttgatttgttacactgccagttgactgaaggggctgcaatgaaaagtgatagtaatgatgttgaaacgcataattctgaaaacccgaagccaaatgaacttgaggagggagagctgcctgacagtcatggtgaacatgtagatgaagtcattggtgcagcagtggctgatggaaaagttactcctagggtgcaagctttgataaaaatacttctcaagtatcagcacactgaggattttcgtgctatcatatttgtagagcgagtggttacagcattagtccttcctaaggtctttgcagaacttccatcattgggctttatacggtgtgcaagcttgataggtcataacaataaccaggagatgcggtcatgccaaatgcaggatacaatcgcaaaatttcgtgatggacgtgttacactgttagttgcaactagtgttgcagaggaaggacttgatattcggcagtgcaatgttgtcattcgctttgaccttgcaaagactgttttggcctacattcagtctcggggtcgtgctagaaagcctggatctgactacatattgatgcttgaaagaggaaatttgtctcatgaagctttcttgagaaatgctcggaatagtgaagagacattgagaaaagaagctattgagagaactgatctcagtcatcttgatggcacttctatgctaagccctgttgatacatcacctgattctatgtaccaggttgaatcaacaggggctgttgtcagtctgaactctgcagttggactcatacatttttactgctcacagctgccgagtgacagatactctattcttcgaccggaatttattatgcaaaagcatgagaagccagggggttcaacagaatattcttgcaaacttcaacttccttgtaatgctccattcgagaagcttgaaggtcctatatgcagttcaatacgcctggctgtttgtttagctgcttgtaagaagctacatgagatgggtgccttcacagatatgcttttacctgacagaggaagtggggaaggagaaaagactgaacaaaatgacgaaggtgatccactgcctggaacagcacgccacagagagttctttcctgaaggggttgctgaaattctgcggggagaatggattttatctggaagagatggttaccaaacttcacagtttattaagttatatttgtattctgtgaactgtgtaaacattgggacttcaaaggaccctttcgttacacaactttcaaattttgctcttgtttttggcaatgagctggatgcagaggttttatcgacgacgatggatctctttgttgctaggacaataataacaaaggcatctctcgtattccgtggaccaattgaaattacagaaagtcagctgatcctgctgaagagctttcatgttaggctcatgagcatagtacttgacgttgatgttgatccctcaacaactccttgggatccagcaaaagcatacctctttgttcctgtgggagctgagaaatgtatggatcttttaagagagatagattggactctagttaacagcattgtgaattctgatgcctggaacaaccctcttcagagggcacgcccagatgtctatctaggcacaaatgaaaggacacttggcggagataggagggaatatgggttcgggaagctgcgtaatggaactgcatttggacagaaagcccaccctacgtatggtattagaggagccattgctgaatttgatgttgtcaaagcatctggattagttcctggtcgtgggcggggacattttaatgattatcaaaaccaaggcaagttgttcatggcagattcatgttgggatgctaaagatcttgctggaatggttgtaactgccgcccactcaggaaaaaggttctatgtggacagtatttgcgacaacatgaatgcagaaaattcgttccctaggaaagagggttatctgggtcccttggagtacagctcgttcgctgattactacaagcagaagtatggtgtggagttaatttataagaaacaacctcttatacgggcacgtggtgtttcatactgcaaaaatctactttctcctagatttgagcattctgaagctggcaatggagagttctcagagaatcttgacaaaacatactatgtgtatttaccacccgaattgtgccttgtgcatcctcttcccggatcacttgttcgtggagctcagaggttaccctcaataatgagaagggtggagagcatgcttcttgcaattcaactgaaggacataattggttatccagttcctgcaaataagatattggaagccttgactgctgcgtcatgccaggagacattctgctatgaaagagcagagctgctgggcgatgcatacttgaaatgggttgtgagtagattccttttcctaaaatatcctcaaaagcacgagggacagctcacaaggatgcggcagcagatggttagcaacatgatcctgtatcaatacgctttggataaaaacctccaatcttatatccaagcagatcggtttgctccatcaagatgggcagctccaggagtgttacctgtatttgatgaagaaacaagagattctgaaccatccatctttgatgaggaatttgctcctagcagagagttagaaaagagctcgtatgatgactatgaggaggatagcatgcaagaagacggtgaaattgagggagattctagctgctatcgtgttctatcaagcaaaacattagcagatgttgtggaagcacttattggtgtctattatgtagctggagggaaaattgctgcaaaccatctgatgaaatggatcggtattaatgcagagttggatcctcaagagatcccttcttcaaagccatataacatacctgagagcataatgaaaagcatcaattttgacacattagagggtgcattgggtatcaagtttcagaataaaggcttacttgttgaagctataacgcatgcatcaagaccatcatcaggtgtttcctgttaccagcgcttggaatttgttggtgatgctgtattggatcatctcattacgaagcacttattttttacttataccgacctacctccgggccgcttgactgacttgagagctgcagctgttaataatgagaactttgcaagggttgcagttaagcataagctgcatgtacatcttcgccatggatcatctgcattggagacacagattcgagagtttgtgaaggatgtccaggtggagcttttgaaaccaggtttcaattcttttgggcttggggattgtaaggctcctaaggttctcggagacatttttgagtctattgctggcgcaatattcctggatagtgggtgtgatacctctgtagtctggaaggtttttcagcctctacttgatccaatggtgacaccggacacccttccaatgcaccctgtaagggagctccaagagcgctgtcaacagcaagctgaaggattagaatacaaagcatcacgaacaggcaatgtagctacagttgaagtctttgttgatggtattcagattggtgtagctcagaacccacagaagaagatggcacaaaagttggcggctagaaatgcactggttgtcttgaaagagaaggaaactgcagcaaagaaagatactgagaaggatggcgagaagaaaaacggttcacagttcactaggcagaccctgaacgatatctgcttgagaaggcaatggccgatgccacagtacaggtgtataaacgagggtggccctgcccatgccaaaagatttgtttatgcggtaagggtaaatacatctgaccgtggatggactgacgagtgcattggagagccaatgccgagtgtgaaaaaggccaaggactctgccgccgttcttctgctcgagctgctgaatcgaaattactgtgacaagcctgatggcaaataa

SEQ ID NO: 20441 - protein, 1922 aa, Sorghum bicolor
  misc_feature: Ceres ANNOT ID no. 8643495
  misc_feature: Up-regulated in root tissues in response to salicylic acid treatment
  misc_feature (1575)..(1671): SWISSPROT Homolog: EC 3.1.26.3 Ribonuclease III
  misc_feature (1615)..(1728): Pfam ID: Ribonuclease_3 Pfam Description: RNase3 domain
  misc_feature (1393)..(1540): Pfam ID: Ribonuclease_3 Pfam Description: RNase3 domain
  misc_feature (1198)..(1359): Pfam ID: PAZ Pfam Description: PAZ domain
  misc_feature (1839)..(1911): Pfam ID: dsrm Pfam Description: Double-stranded RNA binding motif
  misc_feature (1755)..(1815): Pfam ID: dsrm Pfam Description: Double-stranded RNA binding motif
  misc_feature (273)..(444): Pfam ID: DEAD Pfam Description: DEAD/DEAH box helicase
  misc_feature (707)..(787): Pfam ID: Helicase_C Pfam Description: Helicase conserved C-terminal domain
MAGAPGGGDAGGEHAAASYWYDACEDGASLLCGIDFAASADFDPGLIPAMDCGADDGFVAEIDRILESINAEVAPAPLPPPPVPAPAPAPALVAPLQPQPQLQEAAATVAHNAVVVADVPQRAQAVEARKEPRRESPVTAANGGGECRDGKRQRLTAGGTVGPRHDWRRRPMPPPPPSRGWEDRRGRRDYDRSRKRDRDRDGHYGHDHHRRDARGFWERDRGGKMVFRHGMWESETDRHGKRARTQDGSPAAENKAEVDRTGNEKPVTEEKARQYQLEVLEQAKSRNTIAFLETGAGKTLIAVLLIKSICDKMLKENKKMLAVFLVPKVPLVYQQAEVIRDRTGYRVGHYCGEMGQDFWDSRKWQREFESKQVLVMTAQILLNILRHSIIKMDAIHLLILDECHHAVKKHPYSLVMSEFYHTTPKDKRPAVFGMTASPVNLKGVTSQEDCAIKIRNLESKLDCVVCTIKDRKELEKHVPMPLEVIVHYDKAATLLSFHEQIKQMEAAVEEAALSSSKRTKWQFMGARDAGSRDELRLVYGVSERTESDGAANLIQKLRAINYALGELGQWCAYKVAQSFLTALQNDERANYQVDVKFQESYLKKVVDLLHCQLTEGAAMKSDSNDVETHNSENPKPNELEEGELPDSHGEHVDEVIGAAVADGKVTPRVQALIKILLKYQHTEDFRAIIFVERVVTALVLPKVFAELPSLGFIRCASLIGHNNNQEMRSCQMQDTIAKFRDGRVTLLVATSVAEEGLDIRQCNVVIRFDLAKTVLAYIQSRGRARKPGSDYILMLERGNLSHEAFLRNARNSEETLRKEAIERTDLSHLDGTSMLSPVDTSPDSMYQVESTGAVVSLNSAVGLIHFYCSQLPSDRYSILRPEFIMQKHEKPGGSTEYSCKLQLPCNAPFEKLEGPICSSIRLAVCLAACKKLHEMGAFTDMLLPDRGSGEGEKTEQNDEGDPLPGTARHREFFPEGVAEILRGEWILSGRDGYQTSQFIKLYLYSVNCVNIGTSKDPFVTQLSNFALVFGNELDAEVLSTTMDLFVARTIITKASLVFRGPIEITESQLILLKSFHVRLMSIVLDVDVDPSTTPWDPAKAYLFVPVGAEKCMDLLREIDWTLVNSIVNSDAWNNPLQRARPDVYLGTNERTLGGDRREYGFGKLRNGTAFGQKAHPTYGIRGAIAEFDVVKASGLVPGRGRGHFNDYQNQGKLFMADSCWDAKDLAGMVVTAAHSGKRFYVDSICDNMNAENSFPRKEGYLGPLEYSSFADYYKQKYGVELIYKKQPLIRARGVSYCKNLLSPRFEHSEAGNGEFSENLDKTYYVYLPPELCLVHPLPGSLVRGAQRLPSIMRRVESMLLAIQLKDIIGYPVPANKILEALTAASCQETFCYERAELLGDAYLKWVVSRFLFLKYPQKHEGQLTRMRQQMVSNMILYQYALDKNLQSYIQADRFAPSRWAAPGVLPVFDEETRDSEPSIFDEEFAPSRELEKSSYDDYEEDSMQEDGEIEGDSSCYRVLSSKTLADVVEALIGVYYVAGGKIAANHLMKWIGINAELDPQEIPSSKPYNIPESIMKSINFDTLEGALGIKFQNKGLLVEAITHASRPSSGVSCYQRLEFVGDAVLDHLITKHLFFTYTDLPPGRLTDLRAAAVNNENFARVAVKHKLHVHLRHGSSALETQIREFVKDVQVELLKPGFNSFGLGDCKAPKVLGDIFESIAGAIFLDSGCDTSVVWKVFQPLLDPMVTPDTLPMHPVRELQERCQQQAEGLEYKASRTGNVATVEVFVDGIQIGVAQNPQKKMAQKLAARNALVVLKEKETAAKKDTEKDGEKKNGSQFTRQTLNDICLRRQWPMPQYRCINEGGPAHAKRFVYAVRVNTSDRGWTDECIGEPMPSVKKAKDSAAVLLLELLNRNYCDKPDGK

SEQ ID NO: 20442 - DNA, 2268 bp, Sorghum bicolor
  misc_feature: Ceres ANNOT ID no. 8643524
  misc_feature: Down-regulated in shoot tissues in response to aminocyclopropane carboxylic treatment
  misc_feature: Encodes the peptide sequence at SEQ ID NO 20443
atgaggaccccaaggagcctccttcccctcctcctcgtcctgctgtccgccgccgcgctgctcaccgtcgccgattcgcaggagcgcaagaactacgtggttcatctcgagccaagggacgacgccggcggcgacagcgccggttcgctggaggagtggcaccggtccttcttgccggaggccacgctggactcggcggcggatgacggcccgaggatcatccactcgtacagccacgtgctgacggggttcgccgcccgcctcaccgacgcggaggcggaggcgctgaggagcaaggaggggtgtctgcggctctaccccgaggagttcctgccgctggcgaccacccactcgccgggcttcctcggcctccacatgggcaaggacggcttctggagccgctccgggttcggccgcggcgtagtgattgggctcctcgacaccggcatcctgcccagccacccgtccttcaacgacgccgggctgccgccgccgcccaagaagtggaagggcacctgccagttcaggtcgatcgccggcggcgggtgcagcaacaaggttattggcgcgcgcgcgttcgggagcgcggccatcaacaacacggcgccgcccgtggacgacgccggccacggcacgcacacggccagcacggcggcgggcaacttcgtgcagaacgccgacgtgcgcggcaacgcgcacggcacggcgtccgggatggcgccgcacgcgcacctggccatctacaaggtgtgcacgcggagccggtgttccatcatggacatcgtcgccgggctggatgccgccgtcaaggacggcgtggacgtgctctccttctccatcagcgccacggacggcgcgcagttcaactacgacctcattgccatcgccacgttcaaggccatggagcacggcatcttcgtcagcgctgcggccggcaacgacggccccaccgcgggatccatcaccaacggcgcgccgtggatgctgacggtcgcggcgggcaccatggaccgcgcgatacgcactaccgtcaggctcggcaacgggcaggagttcgacggcgagtcgctgttccagccccggaacaacaccgcggggcgcccgctgccgctcgtcttccccggccgcaacggcgacccggaggcccgcgactgcagcacgctggtggagaccgaggtgaggggcaaggtggtgctgtgcgagagccgctccatcaccgagcacgtcgagcaggggcagatggtgtccgcgtacggcggcgccggcatgatcctgatgaacaaggcggcggaggggtacaccaccttcgccgacgcgcacgtgctgccggcgtcgcacgtgagctacgccgcggggtccaagatcgcggcgtacgtcaagtcgacgcccaagcccacggcgaccatcacgttccggggcacggtgatgagctcgtccccggcaccgtccgtggccttcttctcgtcgcgcgggccgaacaaggcgagcccgggcatcctgaagccggacatcaccggtcccggcatgaacatcctggcggcgtgggcgcccagcgagatgcacccgcagttcgcggacgacgtgagcctgaccttcttcatggagtccgggacgtcgatgtcgacgccgcacctgagcggcatcgcggccatcatcaagagcctgcacccgagctggtcccccgccgcgatcaagtcggcgatcatgacgtcgtcgaacacggcggaccacacgggcgtgccgatcaaggacgagcagtaccggcgggcgagcttctacggcatgggcgccgggtacgtgaacccgtcccgcgccgtcgacccggggctggtgtacgacctcagcgccggcgagtacgtcgcctacctctgtggtctgggcctcggggacgacggcgtgaaggagataacggggcgccgcatcgcctgcgccaagctgaaggccatcaccgaggcggagctcaactacccgtcgctggtggtgaagctgctgtcccatccgatcaccgtccgccgcaccgtgaccaatgtcgggaaggccaactcggtgtacaaggccgtggtggacatgcccaagggcgtgtccgtggtggtgcggcccccgatgctgcggttcaccaaggtgaacgagaagcagagcttcaccgtgacggtgcggtggaacgggccgccggccgtgggcggcgccgaggggaacctgaagtgggtgtcgagcgagcacgaggtccggagcccgatcgtgataccgccggccaaggccgccgcgtag

SEQ ID NO: 20443 - protein, 755 aa, Sorghum bicolor
  misc_feature: Ceres ANNOT ID no. 8643524
  misc_feature: Down-regulated in shoot tissues in response to aminocyclopropane carboxylic treatment
  misc_feature (25)..(748): SWISSPROT Homolog: EC 3.4.21.25 Cucumisin
  misc_feature (362)..(459): Pfam ID: PA Pfam Description: PA domain
  misc_feature (30)..(114): Pfam ID: Subtilisin_N Pfam Description: Subtilisin N-terminal Region
  misc_feature (121)..(596): Pfam ID: Peptidase_S8 Pfam Description: Subtilase family
MRTPRSLLPLLLVLLSAAALLTVADSQERKNYVVHLEPRDDAGGDSAGSLEEWHRSFLPEATLDSAADDGPRIIHSYSHVLTGFAARLTDAEAEALRSKEGCLRLYPEEFLPLATTHSPGFLGLHMGKDGFWSRSGFGRGVVIGLLDTGILPSHPSFNDAGLPPPPKKWKGTCQFRSIAGGGCSNKVIGARAFGSAAINNTAPPVDDAGHGTHTASTAAGNFVQNADVRGNAHGTASGMAPHAHLAIYKVCTRSRCSIMDIVAGLDAAVKDGVDVLSFSISATDGAQFNYDLIAIATFKAMEHGIFVSAAAGNDGPTAGSITNGAPWMLTVAAGTMDRAIRTTVRLGNGQEFDGESLFQPRNNTAGRPLPLVFPGRNGDPEARDCSTLVETEVRGKVVLCESRSITEHVEQGQMVSAYGGAGMILMNKAAEGYTTFADAHVLPASHVSYAAGSKIAAYVKSTPKPTATITFRGTVMSSSPAPSVAFFSSRGPNKASPGILKPDITGPGMNILAAWAPSEMHPQFADDVSLTFFMESGTSMSTPHLSGIAAIIKSLHPSWSPAAIKSAIMTSSNTADHTGVPIKDEQYRRASFYGMGAGYVNPSRAVDPGLVYDLSAGEYVAYLCGLGLGDDGVKEITGRRIACAKLKAITEAELNYPSLVVKLLSHPITVRRTVTNVGKANSVYKAVVDMPKGVSVVVRPPMLRFTKVNEKQSFTVTVRWNGPPAVGGAEGNLKWVSSEHEVRSPIVIPPAKAAA

SEQ ID NO: 20444 - DNA, 1608 bp, Sorghum bicolor
  misc_feature: Ceres ANNOT ID no. 8643539
  misc_feature: Down-regulated in root tissues in response to salicylic acid treatment
  misc_feature: Encodes the peptide sequence at SEQ ID NO 20445
atggccgccgccgccgccgccaccgcgccatcccgcaagacggagacctacaccgacaccaagcgccgcgacgatgtgcgcggcgccaacatcgccgccgcgcgcgccgtcgccgacgccgtgcgcacctcgctgggcccccgtggcatggacaagatgatctcctcgggcgaccaggcgcaggaggtcatcatcaccaacgacggcgccaccatcctctcccgcatggcgctcctccagcccgccgcgcgcatgctcgccgagctatcccgctcgcaggacgccgccgctggggacggcaccacgaccgtcgtcgtcctcgctggatccctcctccgccgcgcccagtcgctcctctccgccggggcccaccccaccgccgccgccgacgccctccaccgcctcgccacgcgcgctgttgagatcctccacgccatggccatccccattgagctatccgaccgggagtccctcgtcaagtccgcgtccactgctctcaactccaaggtcgtctcccagtactccaccctcctctcgcccctcgccgtcgacgccgccctctctgtggtggatcccgctcaccctgaccttctggacctccgtgacatccgcatcgtcaagaagcttggtggcaccgtggacgatactgagctcgtccgtggcctcatctttgacaagaaggctagccatgctgctgggggcccaagtcgggtggagaatgccaagatcgctgtcatacagttccaaatctcaccacctaagactgacattgagcagagcgtcattgtatcggactatgcacagatggaccgcatcctacgtgaggagcgcaattacatcctcgggatggtcaagaagatcaaggcagctggatgtaatgtcttgctcattcagaagagcatcttgcgggatgcggtcactgacttgtctctgcactatcttgctaaggcaaagattctggtggtgaaggacgtggagagggatgagatagagttcatcaccaagaccctaaactgccttcccattgccaacattgagcacttccgcacggataagcttgggtatgcagatgttgttgaggaaatctctgttggggagggcaaggttgtgaagatcactggtatcagagacatgggtaggaccgcaactgtacttgtcaggggatcgaaccagttggttattgatgaagctgaacgcagtctccatgacgccctctgtgtcataaggtgcttggtcaacaagaggtttttgattgctggtggtggtgctccagaaatagagatgtcaatgcagctggctgcttgggcaaaggaacttcgagggatggagagttactgcatcaaggagtttgctgaggcacttgaggtcattccttacacacttgctgagaatgctgggctcaacccaatctccatcgtcactgaactcaggaatcgccatgccagaggtgagaagaacgctggcatcaatgtgaggaaagggcagatcacaaacatcctggaggagaatgtcgtgcagcctttgctggtgagcacaagtgccattacgctagcctgcgagtgtgtcagaatgatcttgaagattgatgacattgtcactgttaggtaa

SEQ ID NO: 20445 - protein, 535 aa, Sorghum bicolor
  misc_feature: Ceres ANNOT ID no. 8643539
  misc_feature: Down-regulated in root tissues in response to salicylic acid treatment
  misc_feature (37)..(535): Pfam ID: Cpn60_TCP1 Pfam Description: TCP-1/cpn60 chaperonin family
MAAAAAATAPSRKTETYTDTKRRDDVRGANIAAARAVADAVRTSLGPRGMDKMISSGDQAQEVIITNDGATILSRMALLQPAARMLAELSRSQDAAAGDGTTTVVVLAGSLLRRAQSLLSAGAHPTAAADALHRLATRAVEILHAMAIPIELSDRESLVKSASTALNSKVVSQYSTLLSPLAVDAALSVVDPAHPDLLDLRDIRIVKKLGGTVDDTELVRGLIFDKKASHAAGGPSRVENAKIAVIQFQISPPKTDIEQSVIVSDYAQMDRILREERNYILGMVKKIKAAGCNVLLIQKSILRDAVTDLSLHYLAKAKILVVKDVERDEIEFITKTLNCLPIANIEHFRTDKLGYADVVEEISVGEGKVVKITGIRDMGRTATVLVRGSNQLVIDEAERSLHDALCVIRCLVNKRFLIAGGGAPEIEMSMQLAAWAKELRGMESYCIKEFAEALEVIPYTLAENAGLNPISIVTELRNRHARGEKNAGINVRKGQITNILEENVVQPLLVSTSAITLACECVRMILKIDDIVTVR

SEQ ID NO: 20446 - DNA, 1446 bp, Sorghum bicolor
  misc_feature: Ceres ANNOT ID no. 8643527
  misc_feature: Up-regulated in root tissues in response to salicylic acid treatment
  misc_feature: Up-regulated in shoot tissues in response to salicylic acid treatment
  misc_feature: Encodes the peptide sequence at SEQ ID NO 20447
atgtctccatccgacgacggcgaggagaccctcgccgcgctcatagaagcctccaggaccccggagggccgggagggcctctccgacgtgctcgacgacaccctcttcctcctcccggcctccccgtcgcgcctcctgctcctgcgcctccgcctcctccgcaacctccttgcgggccacgagctcaaccagtacgccttcatcgagcgctgcggccccgccgccgtcgccgcctccgtgctctccttcccctcgctcgcccccgacgtggcgcgcgccgcgctccaggcgctcgggaacgccgcgctcgccggggagttccaccgcaacgccgtctgggaggcgctcttccccgaggtgctgcaggagttcgcggggctcagggaccagggagtcctggatcccctgtgcatggtcctcgacacgtgctgcggcggggaaggcggtcgtgggaggctcgaggagctgtgccacgaggagctaggcctgccaatcctcgtccaagttgtcactacggcctcgcaagtggggcacaaggaagagtggttagagtggcttctgttcaaagtctgtgttgaggagcagaagttcgagagcttgttctatgccttatgctccactaatgatgtcgagcacacagacagtggcgagtataatgccaagcatgtttttcttctgggtacactgtcaaggtgtttgaacagccaccccaaagaagttactgtctcggacggttttgcacatgatgttttcaatctacacaagcatgctgccgaaactgtgaattttactcaccgaggtacgtcccctcttccaactgggagccctgcaatcgatgtccttggatatacactgcagctcctgagggacatttgtgcctgggaatccacctcatcagatactcaacgtcctgttgactcgctattgcagactggctttgtacagcgccttctgagatacctaggtgagcttgagccaccaagtacaatcagaaaatcaatggcaggaggacaaggagataaccatccagctcttgaaaatgcaaaggtctgcccatacattggttacaggagagatttgattgcggtcattgctaattgcttaaacggaaggaagaaggtgcaagatgagattaggcagttaggtgggatcatgttgctactgcagcaatgtgtcatcgatgaagataatccatacttgagggagtggggtctgctggctgttaagaacttgcttgaagaaaatgaagaaaatcagaaggaggtttctgaacttgagatgcaagaacctgttataactccagagattgctaacataggtctcaaggtggagatagacaaggaaacaggtcgtccaaaactggtcaatacttctgatttgcatcgagttgttgtaagctctttgctcatcgtttcacatgaatatagacatatagttgagttctag

SEQ ID NO: 20447 - protein, 481 aa, Sorghum bicolor
  misc_feature: Ceres ANNOT ID no. 8643527
  misc_feature: Up-regulated in root tissues in response to salicylic acid treatment
  misc_feature: Up-regulated in shoot tissues in response to salicylic acid treatment
MSPSDDGEETLAALIEASRTPEGREGLSDVLDDTLFLLPASPSRLLLLRLRLLRNLLAGHELNQYAFIERCGPAAVAASVLSFPSLAPDVARAALQALGNAALAGEFHRNAVWEALFPEVLQEFAGLRDQGVLDPLCMVLDTCCGGEGGRGRLEELCHEELGLPILVQVVTTASQVGHKEEWLEWLLFKVCVEEQKFESLFYALCSTNDVEHTDSGEYNAKHVFLLGTLSRCLNSHPKEVTVSDGFAHDVFNLHKHAAETVNFTHRGTSPLPTGSPAIDVLGYTLQLLRDICAWESTSSDTQRPVDSLLQTGFVQRLLRYLGELEPPSTIRKSMAGGQGDNHPALENAKVCPYIGYRRDLIAVIANCLNGRKKVQDEIRQLGGIMLLLQQCVIDEDNPYLREWGLLAVKNLLEENEENQKEVSELEMQEPVITPEIANIGLKVEIDKETGRPKLVNTSDLHRVVVSSLLIVSHEYRHIVEF

SEQ ID NO: 20448 - DNA, 2292 bp, Sorghum bicolor
  misc_feature: Ceres ANNOT ID no. 8643578
  misc_feature: Up-regulated in shoot tissues in response to salicylic acid treatment
  misc_feature: Encodes the peptide sequence at SEQ ID NO 20449
atggtgaggaccgggagcatgcggcggtcctcggcgcccacgcccacccgggtggcggcgccggcgttcaccgtgtctcccgccgactaccggctgctggaggaagttggctacggcgccaacgccgtcgtctaccgcgcggagttcattcccaccggccggacggtcgctgtgaagtgcttggatctcgatcgggtcaacagtaacctcgatgatgtaagaaaggagactcaaactatgagcttgatagatcaccctaatgtcatcaggtcttactgctcatttgttgtgggtcataatctttgggtggtaatgccgttcatgtcagagggttcatgtttgcacctaatgaaggttgcatatcccgatggttttgaggagccagttatcgcctctattctaaaggaaacactcaaagctctagactacctccataggcaaggacatattcatcgtgatgtgaaggcaggtaatatccttattgataatcctggtgtagtcaagcttggggactttggtgtctctgcttgcatgtttgacaggggtgataggcaaagggctaggaatacatttgttggaacaccatgctggatggctccagaagttctccagcctggaactggatataatttcaaagctgatatatggtcatttggaataactgcactggagctggcacatggacatgctcccttttcgaagtaccctcccatgaaggttcttctcatgacgctccaaaatgctcctccaggtcttgactatgaccgtgataaaaggttctcaaagtccttcaaggaaatggttgcgatgtgcttggtgaaagatcaaacaaagaggccaacagccgaaaaattacttaagcattcttttttcaagaatgtaaaacctccggagctaactgttaagagcattttgactgatttgccccctctttgggaccgtgtaaaggcactccagttaaaggatgctgcacagctagctttgaagagaatgccttcttcagaacaagaagcactttctatgagtgagtaccaacgaggtgtcagtgcatggaacttcgatattgaggatctgaaggctcaggcatcactgatttgtgatgatgatccacctgaaataaaagaagacgatgacactggtagaataactgacattgataaggatacatcttctgacggttattttggaaagccaacaccatcgaatggtaataactgcagtaagcgttcttctgcggcagcaaatccatgtccaaatggccccgaaacaagcgaagtattgtcttccaacaatgggagtacctatagtgaaaggaaggctgatggacctaaaaacccaggaccggaaaatgattcattgccctctacatcgaagcatgatcctgatgggaaagattacagaagtgaagtcggacaaaaacaaaggacatactcaggtccagttctgcaatctggtccgcatgatagttcgatgactgaaaggggccacattattgaaagggatgctggagttcgatctgtatctgataaacaaaagaatggtacaagaagagccaataatcttagtggtcctttgtcactttcaactcgtgcttctgcaaatagtctttctctttcaagaacgaataatcttagtggtcctctgtcactttcaactcgcgcttctgcaaatagtctttctgctcctattcgatcatctgcaggctatgtaggctctttgggtgataagcctaagcgcactatggtggaaattaaaggccgcttctcagtgacatctgagaatgtggatcttgcaaaggttcaagaaattccagggagcagtaccccacgtaaattgcaagaggggccttcactgagaaaatcagccagtgttggtgattggtcagtgaatgataagacaacgtctactaatcatcaacggaaggaactctgcaatagctctgtatctacatcaattctgattccccatcttcaaaaccttgtgaagcagactgcattccagcaagatctgattacgaacctactaagtagcttgcagcaaaatgagagagtcgatgcagctcagtcaagagttcagagcacagggagtgatacagtggttgaagctgctactgctgagagagaacactcgttacttgttaaaatttttgagttacaatctaggatgatttctttaaccgacgaattaattgcgacaaagctgaagcatgttcagctgcaagaagagctaaatgcactgtactgccaagaagaaatcgtggacatgagagaggacgaaaacgaagaagcatga

SEQ ID NO: 20449 - protein, 763 aa, Sorghum bicolor
  misc_feature: Ceres ANNOT ID no. 8643578
  misc_feature: Up-regulated in shoot tissues in response to salicylic acid treatment
  misc_feature (10)..(314): SWISSPROT Homolog: EC 2.7.11.1 Non-specific serine/threonine protein kinase
  misc_feature (30)..(291): Pfam ID: Pkinase Pfam Description: Protein kinase domain
MVRTGSMRRSSAPTPTRVAAPAFTVSPADYRLLEEVGYGANAVVYRAEFIPTGRTVAVKCLDLDRVNSNLDDVRKETQTMSLIDHPNVIRSYCSFVVGHNLWVVMPFMSEGSCLHLMKVAYPDGFEEPVIASILKETLKALDYLHRQGHIHRDVKAGNILIDNPGVVKLGDFGVSACMFDRGDRQRARNTFVGTPCWMAPEVLQPGTGYNFKADIWSFGITALELAHGHAPFSKYPPMKVLLMTLQNAPPGLDYDRDKRFSKSFKEMVAMCLVKDQTKRPTAEKLLKHSFFKNVKPPELTVKSILTDLPPLWDRVKALQLKDAAQLALKRMPSSEQEALSMSEYQRGVSAWNFDIEDLKAQASLICDDDPPEIKEDDDTGRITDIDKDTSSDGYFGKPTPSNGNNCSKRSSAAANPCPNGPETSEVLSSNNGSTYSERKADGPKNPGPENDSLPSTSKHDPDGKDYRSEVGQKQRTYSGPVLQSGPHDSSMTERGHIIERDAGVRSVSDKQKNGTRRANNLSGPLSLSTRASANSLSLSRTNNLSGPLSLSTRASANSLSAPIRSSAGYVGSLGDKPKRTMVEIKGRFSVTSENVDLAKVQEIPGSSTPRKLQEGPSLRKSASVGDWSVNDKTTSTNHQRKELCNSSVSTSILIPHLQNLVKQTAFQQDLITNLLSSLQQNERVDAAQSRVQSTGSDTVVEAATAEREHSLLVKIFELQSRMISLTDELIATKLKHVQLQEELNALYCQEEIVDMREDENEEA

SEQ ID NO: 20450 - DNA, 6489 bp, Sorghum bicolor
  misc_feature: Ceres ANNOT ID no. 8643596
  misc_feature: Up-regulated in shoot tissues in response to salicylic acid treatment
  misc_feature: Encodes the peptide sequence at SEQ ID NO 20451
atggaggacgccgcgcccgatggggcagcgcaggcgtctccgacccccgcggaggccgactggccgcccgagctccgcctcccgccgcccccgccccccgcggacccgccgccgcctgcggggacggacgatccgcacttcctgagctcgatcatcggggacgcggcggccccacccccacccccgcccccgctcccgccgccgatgccgctgccgctcgggcagaagcggaagcgggggaggccgcccaagaggaaggacggcgcgggcgcgggggcggtggtaccggcgccgccgcccgcccgggccgccaggaggagggaggacgaggaggaggtcgtctgcttcatctgcttcgacggcggcaacctcgtcgtctgcgatcggaggggttgccctaaggtctaccatccggcgtgcatcaagcgtgatgaggcattcttccagtcccggagcaagtggaactgcggctggcacatatgcagcagctgtgaaaaggcagtgcactacatgtgctacacttgtacatactccctctgcaaagtgtgcatcaagcagggtaaattcttcagtgtcagggggacaaagggcttctgcgacacatgttatgggactatacttttgatagaatccaaagatgaaagtgcaacaaaggttgattttgatgacatactcagctgggagtacctgtttaagctatattggttagatctgaaagggaagctttcattaacattggaagaacttactactgccaagaacagatggaatgttcctagcacttctgctaggaaagaaaaagaggagtcgtctgatgacctgtatgacgctaatgatgatgatgatgctggttctgactgctcctcaagaaaacgaagacgaactaattcaaggaaaaagggtcaaaaacgccgaaaagtacccttgccagtagacaccaaagtaccaaatgaaccagtgcccttgccaccaaacatgaaatgggcatcaccagagctattggagtttataggacacatgagagatggcgatcaatctttcatttctccatttgatgttcagactcttctgcttgattatatcaagaagaataaccttcgcgatcctcagaggaaaagccaaattatttgtgactcgagacttcaccgcttgttcaggaaagcacgagttgctcattttgagatgttgaagcttttggaaatgcattttcctatgaatgagacttcaacagtaactgatagtagccaagtgacaatcaatctcaattcagctcatgtagataccaatggatacaatgacatggctgcaaaattttcacctgataagaggagaaggatccatagaaagatggaaagagatacacaagttaattttgaggattatgcagcaattgacatgcataatataaatttgatttacatgaggcgcagcctgatggaggatttaattgatgatgccaaattctcagacaaaattcatggtggttttgtgaggataaaaatttctgatgtgtgccagaagcaagacatatatcgtctagtaaaggttattggaacacacaaggttccggaaaagtacagcattggaaagaagatgacaaattttgcacttgagatattgaatttaaacaaaaaggagattattacaatggatacaatatctaatcatgattttacagaggaggagtgcaaacgtttaaggcagagcatgaagtgtggtgtaattagcagactaaaagtgggggatgtcctagagaaagccatggtattgcaatctgtaagagtgaatgattggtttgaaaatgaaaagcagaggcttgggcatctccgtgaccgtgcaagtgaaactgggcgcagaaaagaatatcctattgactatagtatgatagaatatgtagaaaagctgcagcttctcgacaattctgaggaaagaactcgtaggattaatgaagttctggaagtgcatgttgactcacatatggatcctaattatgagtctgctgaagaaacagatgagaaaagaactgtcgcaaaattggtaaatcggacaagaccagatacaaccatatcgcgaagaatatcaagatatagtactaaacaaaaccatcctcaaaaagtttctgattctagccaccatccaaaaagcttgtccacagaaagtacaatttgtgaatcaggggcaagaagtttggagaacagcacagcaaacagaactatgtctgaagctggatcactttcatcttctggagtaacaatgtcaaatgacacagagccagagaaagtctggcactacaaggatccttctgggaatgttcagggtccatttactcttttgcaactatcaaagtggacaagttatttcccacgtgatctgagagtatggcttacatttgagagtgaagagagatcattgctgttgactgaagtgctttcaaaacagcagaaagatttcactcaggctgcatcacatacaagtagcaaggcaacattggttggcactggagatacaaggaacagccctagtgtggatcagaccaatgctttctctcctgttggtcatagcgtggttagttcttctggaataactgttcagtataataagtattctgttccagaaagggaaagtgtgtactctccagatgatagcttgtcactgtcaactagttcggttccactgaaggatgcgtatactgtgaacagccaagcacactgccagaataagcattttgttttgattcagtctcctgggagttcatatgggcacacagacttgaaccatgatgcaatacagggatgctctggtgaatcaaatcatcatcacagcagtggagccctatggagtcctaccgtggcacatatgagttgtagtggacgtggtaatgtggaatctcatcagaatcagcatgtttcctggtcacaaagacagcatgaatctaaaaatagttcacaaagaggacctgttaaagatctgatgaattcagggcaggatctatcgaaaaatctacctactcaacgtatcgggaaagatgtatccagtcctttgtttgcttggagtccggccgagtcgaggacagcttcaagtcaacatgaaggctcttgcttaagttcaacaactaatccaagctttctcgatgaacttcattcttctatagcttctgcaaagcctaagagccatgctccagcaacccctattgaagacagaggttctagttcaccatctggcatgctgagtcatgcagaaagagttccaatctgcagtccacaatcagccccttcagcatctgtttctgatatgtccaagatggaggagatcatgaatcagcaaagaacactcgaggcggatacatcgaatgcttcagttaaccagtctccagaatcaaagattttccctgtatcctctcctgataaccaagatactgaccgtgagtttcctagtccagttccaagatctgagaataaggacactgcagtttacagctcaggattaacaccagcatcacatgaaaatattactatgaatctgcctggttcagatacatgcaagatggaggccgtgagtcagcaacaagtaattgggactgttgtattgaattcttcagatagtcattctcctcaatccaaggtttcccctgtatcttctcctaataacgaagatatgaaacatgaataccccagttcaaccccaaggtccgagaataagattcctgctgtggacagtttactttcaacatcagctgctcctgaaaatctcataacagcttctgcccatgattctgatacatgcaaaatggagtttgtgaatcagccaaaaacacttgaagcggatgcatcaaatgctccactttgtcagtctcactctcacattttcccggtaccttctgacaatcaagatataaagcgtgaatgtccatgtccaactccaaattctgacattaaggaacctcttgtgaacaactcagcaacaacttctgcatcagcctctgatacaagcaaaatggaggagtttgtgaatcagcaaaaaacacttgaagcagatgcatcaaattctccacttaatcagtctcattctcacattttcccagtaccttctgacaatcatgatattgagcgtgaatgtccaggttcaactccaagatctgacactaaggaacttgttgtggacaactcagtgttaacatcagcagcacctgaaattctaacaacaacctctgcagcctctgattcatgcaaaatggagtcagtgaatcagcaaaaaacgcttgaagcagatgcatcaaatgctccacttaatcaccatcctcattctcacagtgttcctgtatcttctgataatcaagacattcagcgtgaatgtcctagcccaactccaaaatctgacagtaaggaacctcttgtggacaactcaatattaacatcagtggcgcctgaaatgctagcgacaacttctgcctctgatacatgcaaaatggaggagtttgtgaatcagcaaaaagcacttgaagcggatgcaacaaatgcttcacttaatcagcctcctcacattttcaatgtatcttctgataatcaagatattgagcatgaatgtcctagcccaactccaaggtctgactgtaaggaacctcttatggacaactcagtatttacatcagcggcgcctgaaattctagcaacatctgcttctggtacatgcaaaatggaggagtttgtgaatcagcaaagaccaattaaagcggatgcatcaaatgcttcacttaatcagcctcctcattgtcacattttcactgtatcttccaataatcaagatattgagtgtgaatgtcctagcccaactccaagatctgacagtaaggaacctctcgtggaaaacttagtgttaacatcagcagtacctgaaaatctactgagaagttctgcagttgcctgtgcctctgatacatgcaagatggagatcttgaataagaaaagaacatttgaagcagatgcttcacttaatcagcctcctcactctagtattttcgcttcatcttctggtgataaccaagataatgtgtgtgaacatcctagtccaagtccaagacctgagggtgagcagcctctcatggataactcagggttaacatcaacagtgcctcaaaatctaacttcttctgcatctgcttccaagatgtgcaaaatggaggagatcttgaatgagaaaagaatacttgaagcaaacccatcaaatggttcgattactcaatctcctcaatccaaggttttccttgtaccatctcctgatatcctagagcgtgaattttctagtaaagcgcctaggcctgagtttaaggaacctgctgtggacagctctgggttaacatcagcagcacctgaaaatttaatgactaagcaacatgtccactcaccagatgcctttgtgccaccaaagtcttgtgctccaactggggaattaggtgacacgaaatcagattttaaaggtgaagaaattattcaaaaagaacaatattgtgagagtgaatctattgttgctacaagagagaatttgttaattgatccgtcctgtggtgctgagtcgatagatgtgtcagatgtattggaatcgttgatggaagaaaggggtgaaacttcgtacatgccaggatcagtagaggacttcctagctgcttcagccgaggaagaagtacaatactctagccctatcgcattatctccttggggtgaacctaattactaccaaggtgatgctgttgattctgcattatggggtattcaagatgatatatggtcattgctttcaccaagacctatgctccaaccttcatctggtattggaactgagaaggaaacttatgatatcaacgaggtggctgtgacccatgttaatagtgaattgtttcaaagaggatcaatgatcacagaggaaaatgtgaaccaggcaaacttgagtgctcttgcagattggatgctgtctgatcaggtcccatcaatactaaatggtatgtcaacatcatcggtagatgagagcaccatagttttaggttctcaagcatcaaacaatcagagcttagactggggtactacgtggactaatcagaatatcagcatgcatagcaatgaaaaggcagagccctcgagtaaaagctatcgagaagaatcaaggaagcaggaaaccaccaattccagtgtttctatttctggagaggccattggaaacaagggcttgaactctcctgataatgctaatcggggcagccaactgagtcatcaccaccgtggcaggtactcccaaatcagtgaatcttggctacttagttcaaatcactctaggacggtgggtcatcaagatcaacttcaaaggggcaaagtaggggctaatgtatattctcaagtgcgggagaaagggtgcatctttgtagctacctgcatccttgatctcacagcaggaataggttttaaaattctttgtcatatctttgcagtttgtataggctaa

SEQ ID NO: 20451 - protein, 2162 aa, Sorghum bicolor
  misc_feature: Ceres ANNOT ID no. 8643596
  misc_feature: Up-regulated in shoot tissues in response to salicylic acid treatment
  misc_feature (115)..(190): SWISSPROT Homolog: EC 2.1.1.43 Histone-lysine N-methyltransferase
  misc_feature (467)..(573): Pfam ID: Plus-3 Pfam Description: Plus-3 domain
  misc_feature (329)..(404): Pfam ID: SWIB Pfam Description: SWIB/MDM2 domain
  misc_feature (760)..(813): Pfam ID: GYF Pfam Description: GYF domain
  misc_feature (114)..(167): Pfam ID: PHD Pfam Description: PHD-finger
MEDAAPDGAAQASPTPAEADWPPELRLPPPPPPADPPPPAGTDDPHFLSSIIGDAAAPPPPPPPLPPPMPLPLGQKRKRGRPPKRKDGAGAGAVVPAPPPARAARRREDEEEVVCFICFDGGNLVVCDRRGCPKVYHPACIKRDEAFFQSRSKWNCGWHICSSCEKAVHYMCYTCTYSLCKVCIKQGKFFSVRGTKGFCDTCYGTILLIESKDESATKVDFDDILSWEYLFKLYWLDLKGKLSLTLEELTTAKNRWNVPSTSARKEKEESSDDLYDANDDDDAGSDCSSRKRRRTNSRKKGQKRRKVPLPVDTKVPNEPVPLPPNMKWASPELLEFIGHMRDGDQSFISPFDVQTLLLDYIKKNNLRDPQRKSQIICDSRLHRLFRKARVAHFEMLKLLEMHFPMNETSTVTDSSQVTINLNSAHVDTNGYNDMAAKFSPDKRRRIHRKMERDTQVNFEDYAAIDMHNINLIYMRRSLMEDLIDDAKFSDKIHGGFVRIKISDVCQKQDIYRLVKVIGTHKVPEKYSIGKKMTNFALEILNLNKKEIITMDTISNHDFTEEECKRLRQSMKCGVISRLKVGDVLEKAMVLQSVRVNDWFENEKQRLGHLRDRASETGRRKEYPIDYSMIEYVEKLQLLDNSEERTRRINEVLEVHVDSHMDPNYESAEETDEKRTVAKLVNRTRPDTTISRRISRYSTKQNHPQKVSDSSHHPKSLSTESTICESGARSLENSTANRTMSEAGSLSSSGVTMSNDTEPEKVWHYKDPSGNVQGPFTLLQLSKWTSYFPRDLRVWLTFESEERSLLLTEVLSKQQKDFTQAASHTSSKATLVGTGDTRNSPSVDQTNAFSPVGHSVVSSSGITVQYNKYSVPERESVYSPDDSLSLSTSSVPLKDAYTVNSQAHCQNKHFVLIQSPGSSYGHTDLNHDAIQGCSGESNHHHSSGALWSPTVAHMSCSGRGNVESHQNQHVSWSQRQHESKNSSQRGPVKDLMNSGQDLSKNLPTQRIGKDVSSPLFAWSPAESRTASSQHEGSCLSSTTNPSFLDELHSSIASAKPKSHAPATPIEDRGSSSPSGMLSHAERVPICSPQSAPSASVSDMSKMEEIMNQQRTLEADTSNASVNQSPESKIFPVSSPDNQDTDREFPSPVPRSENKDTAVYSSGLTPASHENITMNLPGSDTCKMEAVSQQQVIGTVVLNSSDSHSPQSKVSPVSSPNNEDMKHEYPSSTPRSENKIPAVDSLLSTSAAPENLITASAHDSDTCKMEFVNQPKTLEADASNAPLCQSHSHIFPVPSDNQDIKRECPCPTPNSDIKEPLVNNSATTSASASDTSKMEEFVNQQKTLEADASNSPLNQSHSHIFPVPSDNHDIERECPGSTPRSDTKELVVDNSVLTSAAPEILTTTSAASDSCKMESVNQQKTLEADASNAPLNHHPHSHSVPVSSDNQDIQRECPSPTPKSDSKEPLVDNSILTSVAPEMLATTSASDTCKMEEFVNQQKALEADATNASLNQPPHIFNVSSDNQDIEHECPSPTPRSDCKEPLMDNSVFTSAAPEILATSASGTCKMEEFVNQQRPIKADASNASLNQPPHCHIFTVSSNNQDIECECPSPTPRSDSKEPLVENLVLTSAVPENLLRSSAVACASDTCKMEILNKKRTFEADASLNQPPHSSIFASSSGDNQDNVCEHPSPSPRPEGEQPLMDNSGLTSTVPQNLTSSASASKMCKMEEILNEKRILEANPSNGSITQSPQSKVFLVPSPDILEREFSSKAPRPEFKEPAVDSSGLTSAAPENLMTKQHVHSPDAFVPPKSCAPTGELGDTKSDFKGEEIIQKEQYCESESIVATRENLLIDPSCGAESIDVSDVLESLMEERGETSYMPGSVEDFLAASAEEEVQYSSPIALSPWGEPNYYQGDAVDSALWGIQDDIWSLLSPRPMLQPSSGIGTEKETYDINEVAVTHVNSELFQRGSMITEENVNQANLSALADWMLSDQVPSILNGMSTSSVDESTIVLGSQASNNQSLDWGTTWTNQNISMHSNEKAEPSSKSYREESRKQETTNSSVSISGEAIGNKGLNSPDNANRGSQLSHHHRGRYSQISESWLLSSNHSRTVGHQDQLQRGKVGANVYSQVREKGCIFVATCILDLTAGIGFKILCHIFAVCIG

SEQ ID NO: 20452 - DNA, 6363 bp, Sorghum bicolor
  misc_feature: Ceres ANNOT ID no. 8643679
  misc_feature: Down-regulated in root tissues in response to salicylic acid treatment
  misc_feature: Encodes the peptide sequence at SEQ ID NO 20453
atgcagaggtacgccggcaacagcgctggcttcagcagcggcagggacgccgcgaggtcggaatcctccccgttttcgtcctcctcctctggttaccccgtcagctccaggcggcagcaacagctagctccatacaagctaaagtgtgacaaagaggcacttaataacaagcttgggccacctgacttctatccacaaacaccaaactgtcctgaagagacattaaccaaagagtatgcgcaagctgggtataaggagactgttgaaggaattgaggaagcaagagagattgtactcagccagatcccatacttctgtaagccagatgcaatcataaagtgcaaggaggcattaaagaagcgtttaagagcgatcaacgaatctcgtgctcaaaagagaaaggctggccaagtttatggagttcctctttctggatctctattgatcaagcctggagtttacccagagcaaaggccatgtaatgaagacgcacgcagaaaatgggctgaggcccttgctcagccaaacaagcgactgcgttcattgtctgagcacgttcctcatggttaccgtaggaaatcactttttgagggtctcattcgatataatgtcccattactaagagcaacatggtttattaaagtcacgtacctgaatcagctacagacccgacagacacctaacagtatttcagtagctgcttctgataatcaacgatctaatcagtggacaaaggatgttgttgaatatttacagcagattttggacgaattttgttctaaagagggtgctgttgtacctccatcttttagagagcagtcatcaccaggacttactgctggaaccaatcaaataaaaattaaaacagaagcatctccagctgctggagacagtgaagaaccattggtgcacttcaaatggcgttatatggttcgtctcatccaatggcatctcacagaagaattgcttgttccctcggtacttatcgaatggctatctaaccaactccaggagagagactcggttgatgtttttgagcttcttttgcctattatgcttggtctggttgacaccattactctctcacaaacatatgtgcgcatgtttgtggaacttctagtgagacgtctcaatgacgcttctgttgctgatagtccaaaaaggccttcagtttcttctgttatagcagagttactgcgatacatggtacttgcagtaccagatacatttgtttctttggattgctttcctctcccatcatttgtggttcctgatgtatatggtagaggtgctttgttgaagataactagtggtggcggaatttcaagttctaagaggcgtgatgcttatcggtatttgtcctgtggttatgctgtttgttcaattcagaaacgtgcatatgatctcgcaactgttgctaaccctaatcttcaagcacgtggtgcagccaaagtggtacaggctttggacaaagctcttgtcacaggaaatttgtcagtggcatattcttcactctttaatgatttatctgacgctttaatggaagagagatggattaaagaagtcagcccctgtttgcagtcttctctgatgtggattgggactgttgagctatcccttatctgttctatatttttcctttgtgaatgggcgacatgtgattaccgtgattgccgagcatctccctctcagaatgtaaaatttacaggaagaagagatttgtctcagatacatatagcagtgtctatcttgaagaataaaatggatgagatgaataatttgtctcgttctaagagtagcactcgcgttaccctgaatactatcaccaaaggttcttcattgactgatgcttgtttgacagcagctactgcggatgattcttctggattgcgaagtaaggcaaagaatgtggatgataagaaggatacaaatgatatctttgaaagccctggtccactgcatgatatcatcgtgtgttggttggatcagcatgaagttagcagtgttgcaggttttacccgggtggatcttctcatcgtagaacttatccgcaatggtatattttttcctcaggcttatgtcaggcagctaattattagtggaattactgacaagaatgacacaatgttggatgttgaaagaaaaaggaggcatcatagaactttaaagcagcttcctgggtcttctttatttgatattcttgaggaaactaggactgcagaagagcaacagttatatgagatgatgtcaacatactccagcgagcgacgccttgttctctcagagctttcatgtggtcactcattttatgcaagtggcagaggtgggtatgctgcaagttcctgcattcggaagcagagtgatcttccagttgcatcaggaggtgataagcatggaagagcgccagaacaagtagaagatgtcaaagctctattgtcaagtctgttgggttttacatatcctcccctagtggaatcagaacctggccaaatcaaaacaagctatcaagaatcagcaacgtcaacgctctcacaagttgagactggagaagcaaaaagtggatgcgaggattgtatgaggttcaaggggcagaaattggatgatagcgccacccctttccaagggtttccattgattcagtcggacgaggaagatatttggtgggtgaggaaaggcacaaagttacaagaatctttcaacattgaacctgtacagaaatctattaagcaaacttctaggggtagggcaaaagtggttcgtaaaacacaaagtcttgcacaacttgcagctgctagaatcgaaggaagccagggggcatctactagtcatgtctgtgaaagcaaggtgagctgtccccatcataaacctaatatcgatggcgataatgttaaagattttgatcacacgagggcagcaaatctgactgaaattgggaagtcactaaaaagacttagattgcttgaaagacgatctgtctcttcgtggttgttgaaatcagtaagacaacttgttgaaggaaatgaaatgacagctgctaaagctaccaattctataagcatcctttctctgcagcctgatgataaaacggcatccaaatggagactaggtgatgaagaactgctgtcagttctctatgtactggatacatgctgtgatttagtctctggtgcgaggttccttgtatggttactagcgaagattcgtggtggaatgggctcttccggccaacctgggaggagttctatgcatacgaggaacagagatcaccaagtttgtcaggtcagcgaggcacttgtgttctcatctctgcttaggtatgagaacatacttcttgcgactgacatcttgcctgatgttctaagtgctttagtgaacagaaattctgtctcagcaactgtcaggcatcctggttcaacagcttttgcttatgtcagatattttttgaagaaatacagagatgtgtctggtgtggccaagtgggaaaaaagctttcggaccacttgtgatcagcgcctgttagctgagcttgataatgggcggtccattgatgattgtatcaggcaaaatggaggtgcaaatccagatggagacctttcaacagttgcttctgctgtttctgcaattgttgtgaatgctgggcatgtgatagcaaaacatttggactttgcaggaggtaactatcaaggtgttaattctgtgagtaattcgctaaattttgttcgccacactttgcgtgtccacatcaattctctttgcttactgaaagaaacccttggggaccgcttcagccgtgcatttgaaatagctctggccgttgaaacttctgcagctgttacagcagcttttgctcctccaaagatgcaccgcaatcagtttcaaccatctcctgaggtccatgatgcatatggaaatcatacgagtgatctcagcaactcagggaaaggctttgttgggagagctgcaaaagtatctgctgctgtttctgctcttcttgtgggggccgttgttcatggagctgttagtcttgagcggatggttgctgctttaaaaataaaagatggtttggatattctgcagctcctgagaggtttgaaatcaagtacgaatggtgtatcccgtcctactggaacttttaggattgagaactccacagaagtttcggtacattggtttaggattctattggggaactgcagaactgtctatgatgggcttattgcagatattcttggagattcatacattcttgcactctcaaggttgcagcagatgcttcctctaagtgtaatctttcctccggcctactcaatttttgccatggttctttggagacgatatatttttaaccgtgaagatccacagctttatcagtctctgtcaaacgcaataagtgatattaccagacatcaaccttttcgggagatctgcttccgtaatacacatcgtctgtataaccttctggcttctgatgttggtgattcagagtttgcagcaatgcttgaaagccatagcccggacaggaattcaaaaatattgccatttatacctctccgtgcccggctttttctggatgctcttattgattgcaacacaccaactattcagggggatggtgcttcagagccttgtgaccccaaagataatgaattaaagctttcagagaggcttatgcaacttcttgatactcttcaacctgcaaagttccattggcaatgggttgagatgaggcttcttttagatgaacaggctcttatggaaaaagttgcagcaggcaagacagcacttgaatcacttcggtcattatccccaaatgctgagggttttgccctttctgatagtgaaaaagggtttactgaagtgattctatcaaggctacttgctagacctgacgccgctcctctctattcagaagttgtccaccttcttggaaagcttcaggagtcgcttgttatggatgtaaaatggattttacaagggcaagacgctattcttggccgcaggtcaacaagacagcagcttgttcatattgcccaacgaaaagggctttcaacaaaggcacaggtttggaaaccatggggttggtccagcttgcttagcgatgtcattgctaataaagctgcaaaaaggaagttggaagtcacgtcaattgaagagggagaagttgtggatgacactgttgatgctaaaaggcctagcaaaactccccctcataatgttgatagaagctttgatgcgattagatcaattaataaatatttaactgagaaagcccttgctgaattagtattgccatgcattgacagaagttctgctgatatccgcggtatactttctgttgatttgatcaaacagatgggggctattagtgaacatatcaaagcaatagcaaggaatggtgctaaacaagctggttcagttcctttaggaaatgaagtgccatcaaacaaatcaagtggtcgtaaaggaattcgaggtggaagcccaaacattggcagaagagctccggttggtaatgacccaagtcctccttcggcttctgctctgcgggcagcattgtggttacgcctccaattcatcattagattgcttccagtaatcatggcagacaggagcatgagacaaacacttgcttctgcaattctaggcctgcttgcaacgcggatgatttatgaagatgcagatttgccccttcctcctaccaatgcaaatgctttaaggagggagatggattccttgctggaacctcccctggatgtcctgcttgatcggcctggtgaaagtctttttgagaggcttttatgcgttctccatgcgctgcttggcagctataaaccaagttggctgaagtcgaggtcagcctctaggtcgacaaatagaactcaacgagatttctccgcatttgataatgaagcagccgaaggcttacagtctgcgctggatcacatggaattgcctgaaacaatcaggcggaggatccaagcagccatgcctcttcttccaccatcccggcacccttctatgcaatgtcaacctcctcagttgtcgttggctgcattaacaccactccagagcagtacatctggtgcaggtcctcaacagaaaagttctgtgagttgggtgcccactaatgtctcgagcagaagcaaggcagcattgccttctcatgatcctgaaatggaggtagatccatggaacttgctcgaagatggcacaagctgcccctccacaacatctggaagcaatggtgcaagtggagtgacgggtgaccatgctaatctgaaagcgtgcagctggctcaagggtgctgtgagggtgaggaggacagaactgacctacattgggtctttagatgatgacagctga

SEQ ID NO: 20453 - protein, 2120 aa, Sorghum bicolor
  misc_feature: Ceres ANNOT ID no. 8643679
  misc_feature: Down-regulated in root tissues in response to salicylic acid treatment
MQRYAGNSAGFSSGRDAARSESSPFSSSSSGYPVSSRRQQQLAPYKLKCDKEALNNKLGPPDFYPQTPNCPEETLTKEYAQAGYKETVEGIEEAREIVLSQIPYFCKPDAIIKCKEALKKRLRAINESRAQKRKAGQVYGVPLSGSLLIKPGVYPEQRPCNEDARRKWAEALAQPNKRLRSLSEHVPHGYRRKSLFEGLIRYNVPLLRATWFIKVTYLNQLQTRQTPNSISVAASDNQRSNQWTKDVVEYLQQILDEFCSKEGAVVPPSFREQSSPGLTAGTNQIKIKTEASPAAGDSEEPLVHFKWRYMVRLIQWHLTEELLVPSVLIEWLSNQLQERDSVDVFELLLPIMLGLVDTITLSQTYVRMFVELLVRRLNDASVADSPKRPSVSSVIAELLRYMVLAVPDTFVSLDCFPLPSFVVPDVYGRGALLKITSGGGISSSKRRDAYRYLSCGYAVCSIQKRAYDLATVANPNLQARGAAKVVQALDKALVTGNLSVAYSSLFNDLSDALMEERWIKEVSPCLQSSLMWIGTVELSLICSIFFLCEWATCDYRDCRASPSQNVKFTGRRDLSQIHIAVSILKNKMDEMNNLSRSKSSTRVTLNTITKGSSLTDACLTAATADDSSGLRSKAKNVDDKKDTNDIFESPGPLHDIIVCWLDQHEVSSVAGFTRVDLLIVELIRNGIFFPQAYVRQLIISGITDKNDTMLDVERKRRHHRTLKQLPGSSLFDILEETRTAEEQQLYEMMSTYSSERRLVLSELSCGHSFYASGRGGYAASSCIRKQSDLPVASGGDKHGRAPEQVEDVKALLSSLLGFTYPPLVESEPGQIKTSYQESATSTLSQVETGEAKSGCEDCMRFKGQKLDDSATPFQGFPLIQSDEEDIWWVRKGTKLQESFNIEPVQKSIKQTSRGRAKVVRKTQSLAQLAAARIEGSQGASTSHVCESKVSCPHHKPNIDGDNVKDFDHTRAANLTEIGKSLKRLRLLERRSVSSWLLKSVRQLVEGNEMTAAKATNSISILSLQPDDKTASKWRLGDEELLSVLYVLDTCCDLVSGARFLVWLLAKIRGGMGSSGQPGRSSMHTRNRDHQVCQVSEALVFSSLLRYENILLATDILPDVLSALVNRNSVSATVRHPGSTAFAYVRYFLKKYRDVSGVAKWEKSFRTTCDQRLLAELDNGRSIDDCIRQNGGANPDGDLSTVASAVSAIVVNAGHVIAKHLDFAGGNYQGVNSVSNSLNFVRHTLRVHINSLCLLKETLGDRFSRAFEIALAVETSAAVTAAFAPPKMHRNQFQPSPEVHDAYGNHTSDLSNSGKGFVGRAAKVSAAVSALLVGAVVHGAVSLERMVAALKIKDGLDILQLLRGLKSSTNGVSRPTGTFRIENSTEVSVHWFRILLGNCRTVYDGLIADILGDSYILALSRLQQMLPLSVIFPPAYSIFAMVLWRRYIFNREDPQLYQSLSNAISDITRHQPFREICFRNTHRLYNLLASDVGDSEFAAMLESHSPDRNSKILPFIPLRARLFLDALIDCNTPTIQGDGASEPCDPKDNELKLSERLMQLLDTLQPAKFHWQWVEMRLLLDEQALMEKVAAGKTALESLRSLSPNAEGFALSDSEKGFTEVILSRLLARPDAAPLYSEVVHLLGKLQESLVMDVKWILQGQDAILGRRSTRQQLVHIAQRKGLSTKAQVWKPWGWSSLLSDVIANKAAKRKLEVTSIEEGEVVDDTVDAKRPSKTPPHNVDRSFDAIRSINKYLTEKALAELVLPCIDRSSADIRGILSVDLIKQMGAISEHIKAIARNGAKQAGSVPLGNEVPSNKSSGRKGIRGGSPNIGRRAPVGNDPSPPSASALRAALWLRLQFIIRLLPVIMADRSMRQTLASAILGLLATRMIYEDADLPLPPTNANALRREMDSLLEPPLDVLLDRPGESLFERLLCVLHALLGSYKPSWLKSRSASRSTNRTQRDFSAFDNEAAEGLQSALDHMELPETIRRRIQAAMPLLPPSRHPSMQCQPPQLSLAALTPLQSSTSGAGPQQKSSVSWVPTNVSSRSKAALPSHDPEMEVDPWNLLEDGTSCPSTTSGSNGASGVTGDHANLKACSWLKGAVRVRRTELTYIGSLDDDS

SEQ ID NO: 20454 - DNA, 1626 bp, Sorghum bicolor
  misc_feature: Ceres ANNOT ID no. 8643785
  misc_feature: Up-regulated in root tissues in response to methyl jasmonate treatment
  misc_feature: Encodes the peptide sequence at SEQ ID NO 20455
atggaagcagcagaagctgtcactgtgggtgtggggggcagcatcggcgccccttccgcgcccggcggcgtcctgctcctcttcctcctcgcgctctccaccctcatcatcatcatcagatggagatggaataataaccgcaacagcaggctgccccctagcccgatggcgctcccgctcgtcggccacctgcacctcatccggtcgccgccgcacaggtccttggaccgcatcgtgaagcgctacgggcccctcgtctacctccgcctcggcccctccacgcactgcgtcgtcgccggcaccgcggacgccgcacgggacctcctcaagcacgaggccagcatcccggagcggccgatcacggtcgtcgcgcaccacctcgcctatggcgacgccggcttcgccttcgcgccctacggcgcgcactggcgcttcatgaagcgcctctgcatgtccgagctgctgggcccgcgcaccgtcgaccagctgcggcccgtgcgggaggccgagctggcggccgtgctgggggcggcgcggcaggcgtcagccagcggggagcgcatcgacgtcagccgctacctcatcagcatgtccaacaacgccatcatgcgcatggtggccagcgcgctgccgggccacatgacggaggcggcgagggactgcgccaagcacgtcgccgagctcgtgggggccttcaacatcgaggactacgtcgggatctgccggggctgggacctgcaggggatcacgcggaggacgcgcgaggtgcgagacaagttcgacgcgctcatggagatcatgatcacggccaaagaggagaagcggcggagtcagggggacgacggggccgagacccccaccaaggacctgctggacatcctcatggacgccgccgcagacgagaacgccgaggtcaggctcaccagggagaacatcaaggcgttcgtcatcgacatcttcaccgccggctccgacaccaccgccaccagcgtggagtggatgctggcgtacctcatcaaccacccggcctgcatggacaagctgcgcgcggagctggacgccgtggtgggcacgtcgcgcctggtcggggagaacgacgtcccgcgcctgccctacctgcaggccgtcttcaaggagacgctgcgcctgcagccgcccgccgtgttctcgcagcgggagaccatcgagccggtgcacgtccgcggctacgtcatcccgcgcaagaccaccgtcttcttcaacatcttctccatcggccgcgacccggcctggtgggaggaccccctcgagttccgcccggagcgtttcatgcccggcggcgccggagcagccgtcgaccccaaggggcagcacatgcacttcttgccgttcgggagcggccgccgcgcatgccccggcatgggcctcgccatgcaggccgtgccggccttcctcgccgcgctggtgcagtgcttccactgggcggtgcccatcccgcagggccagtccacggcgccgcccttggacatggaggaggaagcggggctcgtcaccgctcggaagcaccacctcgtcctcatcccaacaccgcgcctcaacccactgccggtgccggtgccggtgccggcaacaggaaaagctacctag

SEQ ID NO: 20455 - protein, 541 aa, Sorghum bicolor
  misc_feature: Ceres ANNOT ID no. 8643785
  misc_feature: Up-regulated in root tissues in response to methyl jasmonate treatment
  misc_feature (58)..(520): SWISSPROT Homolog: EC 1.14.13.87 Licodione synthase
  misc_feature (52)..(520): Pfam ID: p450 Pfam Description: Cytochrome P450
MEAAEAVTVGVGGSIGAPSAPGGVLLLFLLALSTLIIIIRWRWNNNRNSRLPPSPMALPLVGHLHLIRSPPHRSLDRIVKRYGPLVYLRLGPSTHCVVAGTADAARDLLKHEASIPERPITVVAHHLAYGDAGFAFAPYGAHWRFMKRLCMSELLGPRTVDQLRPVREAELAAVLGAARQASASGERIDVSRYLISMSNNAIMRMVASALPGHMTEAARDCAKHVAELVGAFNIEDYVGICRGWDLQGITRRTREVRDKFDALMEIMITAKEEKRRSQGDDGAETPTKDLLDILMDAAADENAEVRLTRENIKAFVIDIFTAGSDTTATSVEWMLAYLINHPACMDKLRAELDAVVGTSRLVGENDVPRLPYLQAVFKETLRLQPPAVFSQRETIEPVHVRGYVIPRKTTVFFNIFSIGRDPAWWEDPLEFRPERFMPGGAGAAVDPKGQHMHFLPFGSGRRACPGMGLAMQAVPAFLAALVQCFHWAVPIPQGQSTAPPLDMEEEAGLVTARKHHLVLIPTPRLNPLPVPVPVPATGKAT

SEQ ID NO: 20456 - DNA, 1617 bp, Sorghum bicolor
  misc_feature: Ceres ANNOT ID no. 8643831
  misc_feature: Down-regulated in shoot tissues in response to salicylic acid treatment
  misc_feature: Encodes the peptide sequence at SEQ ID NO 20457
atggacctagaccccgagggcatcttccgcgacgacagcgatgaagacgaagacaacgtccaggagagggaggctaacaaggatatggttgtctaccttgtcgacgcctcgcccaaaatgttcacccctgctaccacccaggacaatgaaaagcaggagacatattttcataccattgttaactgcatcacagagtctctcaagacacaaattattggtagatcttatgatgaagtcgcaatatgtttctttaacactaaagagaagaagaatttacaggactcagctggtgtttatgtttataatgttggagacagagagcaacttgatagacccactgcaaaactcatcaaagatttttcttgcatagaagattcttttatgagcaccattggaagtcgatttggaataacagctggatctcgggagaataccctgtataatgctctttgggttgctcaggcgctgctgcgcaaggggaggattccccacgagttgccgcgggtagttgcatccactactgaaaccatttgtgagtgggcacttaattgcatgcggcagcaggagaagtggaggatgacgtggcgcaaggaggatgcacaagatcttggcctgtctattgaacttcttccacttagccagcctgatgagcagttcgacatgtccctattttatgcaagggcaagagctttgcaattaattgaacacactgggaataaacaccaaccacaaaccactatgcaccacagcttcatagcagtatctcatgtagacttgttcttgacctctatcaaaaagtctgtcatggagggcacttttgcacagagttttgtgattgtgtctgttgtagggttttttttgttggggaaaatcacatggcttgattcactaagtaaccttccattaaaggatccacagacacgtttccagatgtacaatgacacaattgtcaaattttctgtacttgaactctctgaggttaaaagggttgcaagccatcatcttcgccttttaggtttcaagccattggattgcttgaaagattaccataacttaagaccatcggcatttatttatccgagtgatgagtttcatgtgacttctgatgatgcaccgcgtgcaacaaatgaacaaatcaagaaagctttgaatcttttgaaacgtattgatctgaaaaagttctctgcatgccaatttgctaacccagctttgcaaagacactatgggatcttggaggctttagctttaggcgaagatgagatgcctgatataaaggatgataccctgcctgacgaagaaggcttatctaggccaggggtagtcaatgctattgaggaattcaagacttcagtctatggtgaaaattatgaccaagaggaggcagaagcagcagcagggaaagcttcccgtggtgatgcttcaaaaaagcggaagcaaatcactgatgcagctgtgcagatgagtgctgcttatgattgggcagaacttgcagacaatggaaaactgaaggaaatgactgtggtagaattgaaatcctacctgaccgcgcatggcctcccggtttctggtaagaaagaggtacttgtcagcaggatcttgactcatctaggcatgtga

SEQ ID NO: 20457 - protein, 538 aa, Sorghum bicolor
  misc_feature: Ceres ANNOT ID no. 8643831
  misc_feature: Down-regulated in shoot tissues in response to salicylic acid treatment
  misc_feature (29)..(264): Pfam ID: Ku_N Pfam Description: Ku70/Ku80 N-terminal alpha/beta domain
  misc_feature (390)..(482): Pfam ID: Ku_C Pfam Description: Ku70/Ku80 C-terminal arm
  misc_feature (502)..(536): Pfam ID: SAP Pfam Description: SAP domain
MDLDPEGIFRDDSDEDEDNVQEREANKDMVVYLVDASPKMFTPATTQDNEKQETYFHTIVNCITESLKTQIIGRSYDEVAICFFNTKEKKNLQDSAGVYVYNVGDREQLDRPTAKLIKDFSCIEDSFMSTIGSRFGITAGSRENTLYNALWVAQALLRKGRIPHELPRVVASTTETICEWALNCMRQQEKWRMTWRKEDAQDLGLSIELLPLSQPDEQFDMSLFYARARALQLIEHTGNKHQPQTTMHHSFIAVSHVDLFLTSIKKSVMEGTFAQSFVIVSVVGFFLLGKITWLDSLSNLPLKDPQTRFQMYNDTIVKFSVLELSEVKRVASHHLRLLGFKPLDCLKDYHNLRPSAFIYPSDEFHVTSDDAPRATNEQIKKALNLLKRIDLKKFSACQFANPALQRHYGILEALALGEDEMPDIKDDTLPDEEGLSRPGVVNAIEEFKTSVYGENYDQEEAEAAAGKASRGDASKKRKQITDAAVQMSAAYDWAELADNGKLKEMTVVELKSYLTAHGLPVSGKKEVLVSRILTHLGM

SEQ ID NO: 20458 - DNA, 1161 bp, Sorghum bicolor
  misc_feature: Ceres ANNOT ID no. 8643942
  misc_feature: Down-regulated in root tissues in response to methyl jasmonate treatment
  misc_feature: Encodes the peptide sequence at SEQ ID NO 20459
atggcggcactgccgcagcagcgcgcgtcgtcgtcggccttggcgcccgtcttcttgccggcgctgggctcgccgctcggccccacgagtcgtgccctcacctccttcttcatcggcggcggcggcggcaccttcgactatgccgagcccctagcggcgcgccgcggcatcgtgctgctgtggctcgcgccccgcacgcctgaggaaatggactgccacctgctcggcgtctgcaacctcgtcaccggcgaccgccacgttctcccgccgttgcagtgcagccggaacgggaagcttgtcggttgcagacaggtcgtcggctacgcgatcatcacagccgccgacgagagcagccggaacgggaggccgccgccgcgtcatccgtggacgttctcgcagctgctcgtcatcacccaagatggagattgtcccctcaggttcggcggcggcgcggcgtacctgcactcgtactccgccgccacgcgccgctggagcacgcccaccaggtgcctggacaggagcgccttctccctggtggacgccagatccaccgtcgaccaccacggtgcggcgcactggctgtgcatcgacgatggccgtttgcccaacgcgcgcggcggcggcggcggcgatcaccacctgtacaggctcagcgtggacgtggccaccgcgagcgtctccctgacgaggctccccgtccgtgtcggaggcaaacagctcctgtgcgtcaacagcgacggcaagctcgcagtcgcctccgtgtatcctctgcacgtgactgtttggactcagccagccggagccggagacgacggcgacggcgacaccactgctgcggcgtggccccgcacttcttttagaatagccccgcaacagaacgaggaccatgagaggtggtgcaactcggaccatggatcgtcgtcgttgctggcgctgttcatgggcaggggcgtcttcgtcctcgaccttgacaccaaggtgatggagaaagtcttcatcctcgacttcaacaataagactagggaattggctggtgatgctaagcaatatctgaggtgtgtgccctatgagatggacttggtggagttcttcacgctccagcttggtggcatacgagagcgacttggaactactactatctcagaaactgaatcgccataa

SEQ ID NO: 20459 - protein, 386 aa, Sorghum bicolor
  misc_feature: Ceres ANNOT ID no. 8643942
  misc_feature: Down-regulated in root tissues in response to methyl jasmonate treatment
MAALPQQRASSSALAPVFLPALGSPLGPTSRALTSFFIGGGGGTFDYAEPLAARRGIVLLWLAPRTPEEMDCHLLGVCNLVTGDRHVLPPLQCSRNGKLVGCRQVVGYAIITAADESSRNGRPPPRHPWTFSQLLVITQDGDCPLRFGGGAAYLHSYSAATRRWSTPTRCLDRSAFSLVDARSTVDHHGAAHWLCIDDGRLPNARGGGGGDHHLYRLSVDVATASVSLTRLPVRVGGKQLLCVNSDGKLAVASVYPLHVTVWTQPAGAGDDGDGDTTAAAWPRTSFRIAPQQNEDHERWCNSDHGSSSLLALFMGRGVFVLDLDTKVMEKVFILDFNNKTRELAGDAKQYLRCVPYEMDLVEFFTLQLGGIRERLGTTTISETESP

SEQ ID NO: 20460 - DNA, 2199 bp, Sorghum bicolor
  misc_feature: Ceres ANNOT ID no. 8644345
  misc_feature: Down-regulated in root tissues in response to methyl jasmonate treatment
  misc_feature: Up-regulated in shoot tissues in response to methyl jasmonate treatment
  misc_feature: Up-regulated in shoot tissues in response to salicylic acid treatment
  misc_feature: Encodes the peptide sequence at SEQ ID NO 20461
atggacctcgcgtcgttcatcacgtccgtgctgacgtcgttcgtcatcttcgtggcgctggtgctggtgttcacctggctgtcgcgccgccccgggaacgcgcccgtgtactaccccaacctcctcctccgcggggtcgacccgtgggagggccgcgggcgcggcacgcggagccccgtcgggtggatccgcgacgccatctccgcgtcggagcctgacgtcgtcgccgccggcggggtcgacgccgccgtctacctcgtcttcctctcctctgtgctgtcgatcttggtgtactctgggattgtgctgcttccagttctcctcccagttgctgcaactggtggtgccctagttggcatccctcccaatcccaacaattcatctgaatcgactcaggacttctcggcgattgaaaggctaggagtgggcaatgttcctgaaggaagtatgaggctgtgggcatttcttttgtcagtctattgggtttcctttgtcacctatttcgtcctatggaaatcctacaagcatgtgtcaaatttgagagctactgcaaggtcaacaccagatgttaaaccagaggagtttgcggtgttggtgagagatatccctagatcatctccagatgaaactataaaagactttgttgactcatatttccgagcacttcacccaaatactttctacagatcaatggttgtgacagatcacacaaaggctgataaaatataccaagagatcgaaggtcacaagcagaaaattgctcgtgctgaagccatatatgcaaactcaaaaactgaaagtaatcctgagggcacaaagcctactcataggactggattccttggtcttattggtaaaaaggttgacacaattgaatactgtagtgagcagattaaggaattactgccgaaactggaggctgaacagaagactacccttcatgagaaacagcagcgggctgccattgtcatcttcaatagtagatctgccgcagcttctgcatctcagactctccatgctcaggtgtatgataaatggacagttatggaagctcctgaaccatgtcagatactatggcccaaccttccgaggaatctatatgagaggcaaatcagacagtcagtggtctatgctattgtctttctggttgttgttttctatatggttcctattgctgctatctctgctgttacaactctggaaaacctggagaagaagctgcccttcctgaaggtagtggtggaaaaaccagcaatcaagacggtcttggaggcttaccttccccagattgtgctcattgtgtttctggctttgctacctactcttcttatgtttctctcaaaacaagaggggatcccttcgcagagccatgcagtcagggcagcatcaggaaaatatttctatttcattgttttcaatgtcttccttggttatacactcggaagcacattgttcaagtctttgacaaccattatcgatcaccctgctgggattgtgactatgcttgccaatagcctgcctggaagtgcaacgttcttcctcacatttgttgcgctgaaattctttgttggctatgggcttgagctctctcgcttggttcccctcatcattttccatctgaaaaggaagtacctatgcaagacggaggaggatgtgaaagcagcatgggctccaggagatctgggatataacaccagggtcccaaatgacatgctcattgcaacagttgttctgtgctactcagtcattgcacctttgattataccattcggtgttgcatactttgcccttgggtggcttatagcaaaaaatcagattctgagagtttatgttccgagctacgagagctacggacgaatgtggccacacatgcacacgaggatcatcacagctctgatggtttaccagactaccatgatcggcttcatccccctgaaaaagttttactatgtacctgttcttgtgcccctgcttccaataagcatcatcttcgcctatgtctgccatatgcgcttttacccagcatttgccaagactcctctggaggtggtggcacagcacgacctgaaggaaactccaaacatggaaaccatctatacctcatacatacctccgtgcttgaagcctgaaaaacttgaagatttggacgcatttgaggatgctcagtcacacaaaacctccagagccccatctgtttag

SEQ ID NO: 20461 - protein, 732 aa, Sorghum bicolor
  misc_feature: Ceres ANNOT ID no. 8644345
  misc_feature: Down-regulated in root tissues in response to methyl jasmonate treatment
  misc_feature: Up-regulated in shoot tissues in response to methyl jasmonate treatment
  misc_feature: Up-regulated in shoot tissues in response to salicylic acid treatment
MDLASFITSVLTSFVIFVALVLVFTWLSRRPGNAPVYYPNLLLRGVDPWEGRGRGTRSPVGWIRDAISASEPDVVAAGGVDAAVYLVFLSSVLSILVYSGIVLLPVLLPVAATGGALVGIPPNPNNSSESTQDFSAIERLGVGNVPEGSMRLWAFLLSVYWVSFVTYFVLWKSYKHVSNLRATARSTPDVKPEEFAVLVRDIPRSSPDETIKDFVDSYFRALHPNTFYRSMVVTDHTKADKIYQEIEGHKQKIARAEAIYANSKTESNPEGTKPTHRTGFLGLIGKKVDTIEYCSEQIKELLPKLEAEQKTTLHEKQQRAAIVIFNSRSAAASASQTLHAQVYDKWTVMEAPEPCQILWPNLPRNLYERQIRQSVVYAIVFLVVVFYMVPIAAISAVTTLENLEKKLPFLKVVVEKPAIKTVLEAYLPQIVLIVFLALLPTLLMFLSKQEGIPSQSHAVRAASGKYFYFIVFNVFLGYTLGSTLFKSLTTIIDHPAGIVTMLANSLPGSATFFLTFVALKFFVGYGLELSRLVPLIIFHLKRKYLCKTEEDVKAAWAPGDLGYNTRVPNDMLIATVVLCYSVIAPLIIPFGVAYFALGWLIAKNQILRVYVPSYESYGRMWPHMHTRIITALMVYQTTMIGFIPLKKFYYVPVLVPLLPISIIFAYVCHMRFYPAFAKTPLEVVAQHDLKETPNMETIYTSYIPPCLKPEKLEDLDAFEDAQSHKTSRAPSV

SEQ ID NO: 20462 - DNA, 2604 bp, Sorghum bicolor
  misc_feature: Ceres ANNOT ID no. 8644450
  misc_feature: Up-regulated in shoot tissues in response to methyl jasmonate treatment
  misc_feature: Encodes the peptide sequence at SEQ ID NO 20463
atggccaccgccgccaccgcctcccacccggcctccgcctccacctccggccgcgacgccctcgccgcatcatcctcctcccacgccgccgtctgcctcgtcccgttcaggtggtgggcgcgggtgcgggaggaggaggcggcgggcggggtgcagtacgcggctaccgccgccgcgtccccgtcctactacggcctcaggctgctccacagcttcctgcacccggatctcgtcctgcgcctcgagcgcggggacttccgcgccggtgacggaggcggaggcggccgcagctacgcgctcgtcccggccgacgagctctccagggcgcttgctaggcaaaactctggtttgggtttacaaaataagcattcgtttgctggagatagtgctggtgcttatcctttagtgcttaggatctctgtccgagaaacaagtatattgacactgaagatcagcaaaaaggacaatccagttgagaactacaaacgggctaacaagatttttaatgttgattctcaaccagttcatgtttgggatttttcagggcagacaaacctaatattaatgaatgaatggaatagactacatgactgctgccatgcagatcaagagaatcttctggaagtgcaagtctatgcaatgtctgactccttaacatccaaaattggtggtgatatgaattctgatttgtcctacagaagctttggaagagctggttctatggggttaataggattggagaatcttggaaatacttgctttatgaacagttcaattcaatgtttggctcacacaccaaagcttgttgattacttccttggtgattatgccaataatataaaccggactaatccattgggactgaatggtgaacttgctttggcgtttggagaactgttgaggagcttatggactgacagaaaacccattccacctcatcatttcaaggaaaaaattgcgtgttttgctcctcagttcagtggctttaatcagcatgattcacaggagcttcttgcttttttattggatggtcttcatgaagatcttaaccaggttaaatgtaaaccgtatgaagaagcaaaagatgcaagtggccgtcctgacgaagaagtagcagatgagtattggagcaaccatctagctcgaaatgattctgttatagttgatacatgccatggacaatataaatctacattaacttgtcctacttgcagtaaaacatctgtcacatttgacccatttatgtacttatctttgcctgtaccttccacggcaaagagggtaatgaccgtaacagttttcagcactgatggtagcagagagccatgctcatatgatgtcagtgtgccaaaatttgggactctgagtgatcttgttcaggctttaagcattgcttgcttacttggagatgatgagatcctgctggttacggaggtctacaataactgcatcattcgatacttggaggagccttcagattcagtttcattgctgagggatggagataaactggcagcataccgtctacccaaaagacatgagaaatccccctttgtggtttttacacatcaatattttgatgagcattctagtgatgataatttaactcgacaaatgagggagtttgaggccccacttttggcagcacttccagagacaattaatggattatcccttcaggatatctacctaaagttgttgagtccatttcgactttccaacagggctggttcacttaatgtttgtatggagtctaatagtgactccatcgatctgacggatgcaacgtcttctgattcaggcagtaatagttttcagaacagccaatcggaagacggccctgaaagcagccactgtagtgctagtgaatgtgaaataatgaaaagacctgatgatttatgtgatgggggttctgattctaacaaggaggcacagatggaggagtttgaattttatttaaaaaatgaaaggggtgatggccagcttcagaagatagaaatcaatgagctcgatttacttgagacagcaccaagccggttgcatgtgaatgtccactggctacgaaacgcttcaaaaaaatatgctacctcaatgctgagcaatctacctgagattcacaagcttgagcttatcccgaaaggaactgaagattctgttgcactacatggttgtctggaagcctttctaaaagaggaaccattgggaccagaggacatgtggtattgcccctgctgcaagaagcatcaacaagcaatgaagaaacttgatctctggaggctgcccgaagttctggtgatccacctcaaaaggttctcctacactcagttcacaagaaacaagctggagacattcgttgacttccccaccaccgatttggatctgtcatcctacatcgctgacaagagcaagcagccaagcagccattatcgcctgtatgctattagcaaccactacggaaacatgggagggggccattataccgccagcatctatcacgaggaagggaaggggtggtataagttcgatgatgactacgtgactcctatgagcgaagacagtataaagacctcggctgcttacgtgctgttctacagacgagagtga

SEQ ID NO: 20463 - protein, 867 aa, Sorghum bicolor
  misc_feature: Ceres ANNOT ID no. 8644450
  misc_feature: Up-regulated in shoot tissues in response to methyl jasmonate treatment
  misc_feature (224)..(594): SWISSPROT Homolog: EC 3.1.2.15 Ubiquitin thiolesterase
  misc_feature (241)..(864): Pfam ID: UCH Pfam Description: Ubiquitin carboxyl-terminal hydrolase
MATAATASHPASASTSGRDALAASSSSHAAVCLVPFRWWARVREEEAAGGVQYAATAAASPSYYGLRLLHSFLHPDLVLRLERGDFRAGDGGGGGRSYALVPADELSRALARQNSGLGLQNKHSFAGDSAGAYPLVLRISVRETSILTLKISKKDNPVENYKRANKIFNVDSQPVHVWDFSGQTNLILMNEWNRLHDCCHADQENLLEVQVYAMSDSLTSKIGGDMNSDLSYRSFGRAGSMGLIGLENLGNTCFMNSSIQCLAHTPKLVDYFLGDYANNINRTNPLGLNGELALAFGELLRSLWTDRKPIPPHHFKEKIACFAPQFSGFNQHDSQELLAFLLDGLHEDLNQVKCKPYEEAKDASGRPDEEVADEYWSNHLARNDSVIVDTCHGQYKSTLTCPTCSKTSVTFDPFMYLSLPVPSTAKRVMTVTVFSTDGSREPCSYDVSVPKFGTLSDLVQALSIACLLGDDEILLVTEVYNNCIIRYLEEPSDSVSLLRDGDKLAAYRLPKRHEKSPFVVFTHQYFDEHSSDDNLTRQMREFEAPLLAALPETINGLSLQDIYLKLLSPFRLSNRAGSLNVCMESNSDSIDLTDATSSDSGSNSFQNSQSEDGPESSHCSASECEIMKRPDDLCDGGSDSNKEAQMEEFEFYLKNERGDGQLQKIEINELDLLETAPSRLHVNVHWLRNASKKYATSMLSNLPEIHKLELIPKGTEDSVALHGCLEAFLKEEPLGPEDMWYCPCCKKHQQAMKKLDLWRLPEVLVIHLKRFSYTQFTRNKLETFVDFPTTDLDLSSYIADKSKQPSSHYRLYAISNHYGNMGGGHYTASIYHEEGKGWYKFDDDYVTPMSEDSIKTSAAYVLFYRRE

SEQ ID NO: 20464 - DNA, 996 bp, Sorghum bicolor
  misc_feature: Ceres ANNOT ID no. 8644480
  misc_feature: Down-regulated in root tissues in response to methyl jasmonate treatment
  misc_feature: Down-regulated in shoot tissues in response to methyl jasmonate treatment
  misc_feature: Down-regulated in shoot tissues in response to salicylic acid treatment
  misc_feature: Encodes the peptide sequence at SEQ ID NO 20465
atgccgtcgtcggcgccggagccgcacgtggtggaggactgccgcggcgtgctgcagctgatgagcgacggcacggtgcggcgcagcgcggtgccagcgctcccggtggacgtccccgacgacgaagactgcggcgtggagtggaaggacgtgacgtgggaccggcagcacgacctgaacgcgcgcctgtaccggccggggcacctgggcgcggccaacgacgcgcggatccccgtggtggcctacttccacggcggcggcttctgcatcgggtccgggcggtggcccaactaccacgcctggtgcctccgcctgtgctccgagctccccgccgtggtgctctccttcgactaccgcctggcgcccgagcaccgcctgcccgccgcgcaggaggacggcgccagggccatggcctggctgacgcgctccgccgccaccgacccctggctcgccgacgcggccgacttcgcgcgcgccttcgtcgcgggcgactcggcgggcggcaacatcgcgcaccacgtcgccgcggagctcggcaagggcggcggacggcggctcgcccccgccgtccggatccgcggcgcgctcctcctcgcgccggccttcgccggcgaggcccgcacgcgcgcggagctggagtgcccgcgcgacgcgttcctcaccaccgagatgttcgacaggtacgcgcgcctcgccctgccggacggcgccgacagagacgaccccgtgctcagcccggcggggccgcgcgcgcctgcgctggaggccgtggagatggcccctgtgctggtggtggcgggaggccgcgacgtgctgagggaccggaacaagcagtacgcgcggcggatgaaggaggagtggggcaaggaggtggagtacgtggagatcgccggcgccgatcatggcttcttccaggtcgacccgtggtcggagcgcgccgacgaggtcgtccgcgtcgtgcggcggttcgtcgtcgagcacatggactcggagtag

SEQ ID NO: 20465 - protein, 331 aa, Sorghum bicolor
  misc_feature: Ceres ANNOT ID no. 8644480
  misc_feature: Down-regulated in root tissues in response to methyl jasmonate treatment
  misc_feature: Down-regulated in shoot tissues in response to methyl jasmonate treatment
  misc_feature: Down-regulated in shoot tissues in response to salicylic acid treatment
  misc_feature (37)..(306): SWISSPROT Homolog: EC 3.1.1.3 Triacylglycerol lipase
  misc_feature (80)..(305): Pfam ID: Abhydrolase_3 Pfam Description: alpha/beta hydrolase fold
MPSSAPEPHVVEDCRGVLQLMSDGTVRRSAVPALPVDVPDDEDCGVEWKDVTWDRQHDLNARLYRPGHLGAANDARIPVVAYFHGGGFCIGSGRWPNYHAWCLRLCSELPAVVLSFDYRLAPEHRLPAAQEDGARAMAWLTRSAATDPWLADAADFARAFVAGDSAGGNIAHHVAAELGKGGGRRLAPAVRIRGALLLAPAFAGEARTRAELECPRDAFLTTEMFDRYARLALPDGADRDDPVLSPAGPRAPALEAVEMAPVLVVAGGRDVLRDRNKQYARRMKEEWGKEVEYVEIAGADHGFFQVDPWSERADEVVRVVRRFVVEHMDSE

SEQ ID NO: 20466 - DNA, 4878 bp, Sorghum bicolor
  misc_feature: Ceres ANNOT ID no. 8644502
  misc_feature: Up-regulated in shoot tissues in response to methyl jasmonate treatment
  misc_feature: Up-regulated in root tissues in response to methyl jasmonate treatment
  misc_feature: Encodes the peptide sequence at SEQ ID NO 20467
atggcatctgatatgagagcacctagcagtggcaaaaagagtgagacctcccatggcatgaagtgtggggtctctgatcaagcttgtcatggcaaatgccaaagctgtgacattgctgcaaaacctatttgttctggagtggatggagtctcctcgttgactggtagtcatactgatgtgaaggcctcaaaagagaactgtggagcatgcagtctgaacaatgatcgtgctgattctttagaagaagaggtaaagggttccacagcgaggataggtcatgttgagagtgctgatcctgatggctgtgtggatgtaaaaaaggaaagtttcatggctgttgatgatctaccacaggagtttgagggggagcaagttggggcaacactggaggatctgtttttctttaatggtgaagaggaagatgacagtgattgggaacctgctagtcgccttgttgaggatagatggttttgctttaactgcacaatgccgattgtggaccagattacacattgcatgaattgccgtgagcttaaggaatctgcagtagatggatatgatgttttcaaaaaacaaattgcacagacagctttgttatctgccgacacagagttgctgccagtatctacagcgattggttttgatgaaagaatgctgctccacagtgagctagaagttaaaccaaatccgcatccagaaagaccggatcgccttcgcgccattgctgcaagtcttgctgctgcagggatctttccctcaaaatgtgctttggtacctcctcgagaaatcacgaaggaggaactccttatggttcatagtccagaccacattgaaagtgtcgagcagacaaagaacatgctttacagttacttcacttcggatacttatgcaaatggacattcagcatgtgctgccaaacttgcagctggattatgtgctgatcttgctagtttgatggtatctgggcgtgttcgtaatggttttgctctggtaagacctcctgggcatcatgcaggggtgaagcaagcaatgggtttttgtcttcacaacaatgcagcagtggctgctttagctgcaaaaagagcaggtgccaagaaagtcctcatagttgactgggatgtgcaccatggaaatggcacacaagagatattcgaaggggataaaacagtcttgtacatatcattacatcgtcatgaggatggaaacttttaccctggaactggagcagctcatgaggtgggagttctggatggtcaaggattctcagttaatataccttggagccgtggtggtgttggagacaatgactacatctttgcttttcagactgtggtgcttccaatagctgcagagtttgccgcagacatcactataatatctgcaggattcgatgcagctagaggtgaccctctaggtggttgtgatgtcactccagttggatactcttggatgacatccctgctagctgattgctcaaatggaagattgttggtgatacttgagggaggatacaatctccagtcgatatcctcatcagctactgaagttgttaaggtcctacttggggatggtccaaatcgtgcttcatttgtaggttcaccatcaagagaggccttgaagactgtttctcaagtcctgaagattcaacaacgattttggccagttttaggtccaacatatgcatcactacaggcacagcaggggtcggtttcttccaatcatagaggattagggcccttctggtggaagttgggaagcaaaaggcttctgtacgaagcgctttttgagcaccgtcgtcagaggaaaatcaaggggtccggagaaggaaaagcaactgttccaacttccaagttcccagaaactctcctcccctttcttcccttcgtctggctggcctcgggggggtttaacgctttaacccctcccctcccctcccctccgattcctctaatccgcgatcacccaacccctcgccgccgatcccccccaaccctcgccgcccgattccgctcccgttcccgcggggcccaatccctccgcgcgggcgcgatgccggcggcggcgccgacgcccaaggcggtggtgcaccagcggttcggcgccaaggcgcggtacacggtggaggaggtgcgggaggccgtgggcggctgcccgggcctcgcgccgcagaccaggagcgtctaccgctgcgcgctcgacctcccgggcctctccgtcgccacgcctggcaccttcctcaggaagaaggacgccgagcaggccgccgcgcagatcgcgctcgacaagcttggtattcagcccacggcaaatattcccagtacaccccaagaagcttgggatgaactgattgctcgcatatctggttttttcatagatgagagcttcctatcatctacccatcctcttgttggccacttgtgtgtgactctcaggagaactggagatctcattgggaggatacctctgccggctattgctgcatgtgatgtgaaggtcaatacattgtgtaaagtgattgaccatagggcagaatttgatcctctcttgattttgtcattgatgtacaatgctgcgaaacaatctcctggagtctctgttagtgacagaaacttctggattcagagtgaaaagccctattctacggaggctgttgacttggcacttgagcgttggtctggtacaacacatcccgtagaagtagaagcgattcttgttcctcacgtgttggaggatgaactgaagacagtaagaattaatctacaagataatgaacattatatgagttatgttgcagcagagctctcagcaagtgattcctctcatgttcttgtatcgagaacaattggaaaagcatcctcagagataaggctgtattttgcagccccaaatatacatgttgtttctgatatatcaaaaaatgtgcttgcttgtcatggagatggtgacatcaactggcaagtaaataagcgagcttcctatatttgtggccaaacaatttatggagatgcactcttggcaaatatcggatacacaaggagagattcgaaacttcaaactgaagatgtcaatctatgtacctattacaggatacttctgggcaagttacctgatggaaattgtaagatgtctagggactcaattcttgcagcggagcttccatctgcatactctcgttttagttggaaaggcctctctccacgagatctcctttgctcattttgtcgccttcagaggttgccagagccccagtttgctgtcagtaggatctcctatgatacgttaatgtcagctgtgagctctgaagaaagaggagcaccagcaggcagtgtagaaaatcagtacaccaatgatgtcaggatcaacaaggaaaacccagatctttttaaatgtgaagtgaacatacgttcacggaagcaagagcttttactagagtattctgcagctgacacttggagcaaggaatctgatgctattcagaatgctgcattgaaggtcttgatttggttcaatgattattttaagaaactaacctcaaaaacagacaaactttatctttttgactgtactgatggtgtcaagatacattcaaatatttttctgcaagagtttgcaatgtgcctatctgtttatggcaagaccagaggcaatgattcagcaatgtgcagtgcagttggaccattttctatggatacacaaaagaagcgccttgagagcactgcaaagttaacacacattgagggtccggactctggtgttttcccgtcccacggatcattgacttgtataagttatactgcttcccttgtgacgaaggataaagcaaaaacatatttgttggagagccgcaatgagtttgagtttgagattgggacgggtgctgttagtaatcagcttgaatcatgtgtaactcagctgtcagtgaatcaaactgcacgttttgtagctgaactgcctcctagggatttaatcatggctgcagcttttgaggtctcgcatgacctctctaatgtatctatcgagaactgcttcctggagttcactgtaaaggttctgcaggtaactgaacccttagaagatagaatggagaaagccttgttcagtcctccattatctaaacaaagagttgaatttgctgtacggcacatcaacgagctgcacgctaccacacttgttgattttggctgtggatctggtagccttcttgattcattgttagagcatccaaccacgctagaaaagcttgtcggtgttgatatttctcgaaaaggactcacacgtgcagcaaagagccttcatcagaagctgagcaagaaatcgatgatgcagacaaatgttccaactgctgtgctctatgacggatcaataatggaatatgattctcgcttatatgggttcgatattggcacttgtcttgaggtgatcgaacacgttgaggaggaccaagcaactttatttggcaacgtcgtcttgagctcattccgcccaacggtgctcattgtttccacacccaactacgaatacaaccctatcctccaggggtcagctatgcccagcaaggatgacgaggcagacgaaagcgttggtccctgcaagttccgcaatcacgaccacaagttcgagtggaccagggcacagttccagtgctgggctactggcctcgcggtgaagcataactacagcgtggaattctctggcgtcggtggctcaggcgaggaaccaggctacgcttcccagatcgctgttttcagaagaatgatgcaggggcacgaagcaatgtgcctggacaaaggtggtgatcaaccttacgagcttctctgggagtggcctaacgcgtgtgaggagaaggagatcggcactgactgtgaactaggagtctag

SEQ ID NO: 20467 - protein, 1625 aa, Sorghum bicolor
  misc_feature: Ceres ANNOT ID no. 8644502
  misc_feature: Up-regulated in shoot tissues in response to methyl jasmonate treatment
  misc_feature: Up-regulated in root tissues in response to methyl jasmonate treatment
  misc_feature (209)..(522): Pfam ID: Hist_deacetyl Pfam Description: Histone deacetylase domain
  misc_feature (1391)..(1499): Pfam ID: Methyltransf_12 Pfam Description: Methyltransferase domain
MASDMRAPSSGKKSETSHGMKCGVSDQACHGKCQSCDIAAKPICSGVDGVSSLTGSHTDVKASKENCGACSLNNDRADSLEEEVKGSTARIGHVESADPDGCVDVKKESFMAVDDLPQEFEGEQVGATLEDLFFFNGEEEDDSDWEPASRLVEDRWFCFNCTMPIVDQITHCMNCRELKESAVDGYDVFKKQIAQTALLSADTELLPVSTAIGFDERMLLHSELEVKPNPHPERPDRLRAIAASLAAAGIFPSKCALVPPREITKEELLMVHSPDHIESVEQTKNMLYSYFTSDTYANGHSACAAKLAAGLCADLASLMVSGRVRNGFALVRPPGHHAGVKQAMGFCLHNNAAVAALAAKRAGAKKVLIVDWDVHHGNGTQEIFEGDKTVLYISLHRHEDGNFYPGTGAAHEVGVLDGQGFSVNIPWSRGGVGDNDYIFAFQTVVLPIAAEFAADITIISAGFDAARGDPLGGCDVTPVGYSWMTSLLADCSNGRLLVILEGGYNLQSISSSATEVVKVLLGDGPNRASFVGSPSREALKTVSQVLKIQQRFWPVLGPTYASLQAQQGSVSSNHRGLGPFWWKLGSKRLLYEALFEHRRQRKIKGSGEGKATVPTSKFPETLLPFLPFVWLASGGFNALTPPLPSPPIPLIRDHPTPRRRSPPTLAARFRSRSRGAQSLRAGAMPAAAPTPKAVVHQRFGAKARYTVEEVREAVGGCPGLAPQTRSVYRCALDLPGLSVATPGTFLRKKDAEQAAAQIALDKLGIQPTANIPSTPQEAWDELIARISGFFIDESFLSSTHPLVGHLCVTLRRTGDLIGRIPLPAIAACDVKVNTLCKVIDHRAEFDPLLILSLMYNAAKQSPGVSVSDRNFWIQSEKPYSTEAVDLALERWSGTTHPVEVEAILVPHVLEDELKTVRINLQDNEHYMSYVAAELSASDSSHVLVSRTIGKASSEIRLYFAAPNIHVVSDISKNVLACHGDGDINWQVNKRASYICGQTIYGDALLANIGYTRRDSKLQTEDVNLCTYYRILLGKLPDGNCKMSRDSILAAELPSAYSRFSWKGLSPRDLLCSFCRLQRLPEPQFAVSRISYDTLMSAVSSEERGAPAGSVENQYTNDVRINKENPDLFKCEVNIRSRKQELLLEYSAADTWSKESDAIQNAALKVLIWFNDYFKKLTSKTDKLYLFDCTDGVKIHSNIFLQEFAMCLSVYGKTRGNDSAMCSAVGPFSMDTQKKRLESTAKLTHIEGPDSGVFPSHGSLTCISYTASLVTKDKAKTYLLESRNEFEFEIGTGAVSNQLESCVTQLSVNQTARFVAELPPRDLIMAAAFEVSHDLSNVSIENCFLEFTVKVLQVTEPLEDRMEKALFSPPLSKQRVEFAVRHINELHATTLVDFGCGSGSLLDSLLEHPTTLEKLVGVDISRKGLTRAAKSLHQKLSKKSMMQTNVPTAVLYDGSIMEYDSRLYGFDIGTCLEVIEHVEEDQATLFGNVVLSSFRPTVLIVSTPNYEYNPILQGSAMPSKDDEADESVGPCKFRNHDHKFEWTRAQFQCWATGLAVKHNYSVEFSGVGGSGEEPGYASQIAVFRRMMQGHEAMCLDKGGDQPYELLWEWPNACEEKEIGTDCELGV

SEQ ID NO: 20468 - DNA, 924 bp, Sorghum bicolor
  misc_feature: Ceres ANNOT ID no. 8644695
  misc_feature: Down-regulated in shoot tissues in response to aminocyclopropane carboxylic treatment
  misc_feature: Up-regulated in root tissues in response to methyl jasmonate treatment
  misc_feature: Up-regulated in shoot tissues in response to methyl jasmonate treatment
  misc_feature: Up-regulated in shoot tissues in response to salicylic acid treatment
  misc_feature: Up-regulated in root tissues in response to salicylic acid treatment
  misc_feature: Encodes the peptide sequence at SEQ ID NO 20469
atggcggtgacaagaagcaagagaccagctagctccctcctgcccgccgtggcggccctcgtcgccgtcgccggcctcctctccctcgccggcccagccgcggccacagggaaaaccggccaggtgacggtcttctggggccggaacaaggccgagggcacgctccgcgaggcctgcgacacgggcacctacaccatcgtcgtcatctccttcctcagcgtcttcggccaaggcggcaacaagccgcccactctagacctctccggccaccccatcgccggcatcggcgacgacatcaagcactgccagtccaagagcatcatggtgttcctctccatcggcgggttcggcgaccactactccctccccagcgccaaggccgccacggacctcgccgactacctctggtacgcctacttcccagcgcccacgccgcgcgccggcgtgcaccgcccgttcggcgacgcctacgtcgacggcctcgacttcttcctcgaccgcggctcgccggcgtactacgacgtgctggccaagcgcctgtggagctacaacaagcagttccgcgcccggacgcccgtgcagctgtcggcgacgccgcggtgcgcgttcccggaccgccaggtgcagcgggtgctcgccacggggctcgtcaccagaatcaacgtcaggttctacggcgacgcgcactgcgccgcgtactggcagcaggagtgggacaagtggacggcggcgttcccggaagactccatctacgtcggcctgccggcgtcggagcagacggtcgggtacgtccaccccaagaacctctactacggcgtcgtccccgtggtgcagaaggcggccaactacggcgggttcatgatctgggaccgatacgccgacaagaagaccaattacagtagctacgccattgaatgggcttga

SEQ ID NO: 20469 - protein, 307 aa, Sorghum bicolor
  misc_feature: Ceres ANNOT ID no. 8644695
  misc_feature: Down-regulated in shoot tissues in response to aminocyclopropane carboxylic treatment
  misc_feature: Up-regulated in root tissues in response to methyl jasmonate treatment
  misc_feature: Up-regulated in shoot tissues in response to methyl jasmonate treatment
  misc_feature: Up-regulated in shoot tissues in response to salicylic acid treatment
  misc_feature: Up-regulated in root tissues in response to salicylic acid treatment
  misc_feature (38)..(307): SWISSPROT Homolog: EC 3.2.1.14 Chitinase
  misc_feature (40)..(294): Pfam ID: Glyco_hydro_18 Pfam Description: Glycosyl hydrolases family 18
MAVTRSKRPASSLLPAVAALVAVAGLLSLAGPAAATGKTGQVTVFWGRNKAEGTLREACDTGTYTIVVISFLSVFGQGGNKPPTLDLSGHPIAGIGDDIKHCQSKSIMVFLSIGGFGDHYSLPSAKAATDLADYLWYAYFPAPTPRAGVHRPFGDAYVDGLDFFLDRGSPAYYDVLAKRLWSYNKQFRARTPVQLSATPRCAFPDRQVQRVLATGLVTRINVRFYGDAHCAAYWQQEWDKWTAAFPEDSIYVGLPASEQTVGYVHPKNLYYGVVPVVQKAANYGGFMIWDRYADKKTNYSSYAIEWA

SEQ ID NO: 20470 - DNA, 1737 bp, Sorghum bicolor
  misc_feature: Ceres ANNOT ID no. 8644721
  misc_feature: Down-regulated in shoot tissues in response to salicylic acid treatment
  misc_feature: Encodes the peptide sequence at SEQ ID NO 20471
atggacctggacccagagggcatcttccgcgacgacagcgatgaggacgaagacaacgtccaggagagggaggcgaacaaggagatggttgtctaccttgtcgatgcctcgcccaaaatgttcacccctgctaccacccaggacaatgaaaagcaggagacacattttcgtaccattgttagctgcatcactgagtctctcaagacgcaaattattggtagatcttatgatgaagtcgcaatatgtttctttaacactaaagagaagaagaatttacaggactcagctggtgtttatgtttataatgttggagacagagaagaacttgatagacccactgcaaaactcatcaaagatttttcttcaatagaagattcttttatgagcaccattggaagtcgatatgggataacatctggatctcgggagaataccctgtataatgctctttgggttgctcaggctttgctgcgcaaggggtatgacacttcccttcttttggcctttgagcagtgtcatgatgcacaagatcttggcctgtctattgaacttcttccactgagccggcctgatgaacagttcgacatgtccctattttatgcagcatgctatgactttggtttatttcatgctttgttacaaactattggtgttgaaacatctaagtatacgctggttattttttcagggacaatcacatggcttgattcactaagtaaccttccattaaaggctgagaggtctttcatatgcaatgatactggggctctacttcaggatgcacagacacgtttccagatgtacaatgacacaactgtcaaattttctgtacgtgaactctctgaggttaaaagggttgcaagccatcatcttcgccttttaggtttcaagccattggattgcttgaaagattatcataacttaagaccatcgacatttgtttatccgagtgatcagcgtatatttggaagcactcgtgttttcgttgctttacatagctcaatgttacgtcttggaaggtttgcacttgcattttatgggaatccaactcgaccacagctcgtagcccttgttgctcaagaagaggttacttcctctggtggccagtttgaaccacctggcatgcacatgatctatcttccatactccgatgatattagatatcctgaagaagtaaggactggcgttgtatttaaccttaccatcagcgttcatgtgacttttgatgatgcaccgcgcgcaacagatgaacaaataaagaaagcttcaaatctattcaaacgtattgatctgaaaaatttctctacatgccaattagctaacccagctttgcaaagacactatgggatcttggaggccttagctttaggcgaagatgagatgcctgatataaaggatgagaccctgcctcacgaagaaggcttgtctaggccaggggtagtcaaagctattgaggaattcaagacatcagtatatggtgaaaattatgaccaagaggaggcagaagcagcagcagggaaagcttcccgtggtgatgcttcaaaaaagcggaaggaaatcactgatgcagctgcgcagatgagtgctgtttatgattgggcagaacttgcagacaatggaaaactgaaggaaatgacggcggcggaattgaaatgctacctgaccgcgcatgacctcccggtttctggtaagaaagacgtacttgtcagcaggatcttgactcatctgggcaagtga

SEQ ID NO: 20471 - protein, 578 aa, Sorghum bicolor
  misc_feature: Ceres ANNOT ID no. 8644721
  misc_feature: Down-regulated in shoot tissues in response to salicylic acid treatment
  misc_feature (204)..(422): Pfam ID: Ku Pfam Description: Ku70/Ku80 beta-barrel domain
  misc_feature (29)..(251): Pfam ID: Ku_N Pfam Description: Ku70/Ku80 N-terminal alpha/beta domain
  misc_feature (430)..(522): Pfam ID: Ku_C Pfam Description: Ku70/Ku80 C-terminal arm
  misc_feature (542)..(576): Pfam ID: SAP Pfam Description: SAP domain
MDLDPEGIFRDDSDEDEDNVQEREANKEMVVYLVDASPKMFTPATTQDNEKQETHFRTIVSCITESLKTQIIGRSYDEVAICFFNTKEKKNLQDSAGVYVYNVGDREELDRPTAKLIKDFSSIEDSFMSTIGSRYGITSGSRENTLYNALWVAQALLRKGYDTSLLLAFEQCHDAQDLGLSIELLPLSRPDEQFDMSLFYAACYDFGLFHALLQTIGVETSKYTLVIFSGTITWLDSLSNLPLKAERSFICNDTGALLQDAQTRFQMYNDTTVKFSVRELSEVKRVASHHLRLLGFKPLDCLKDYHNLRPSTFVYPSDQRIFGSTRVFVALHSSMLRLGRFALAFYGNPTRPQLVALVAQEEVTSSGGQFEPPGMHMIYLPYSDDIRYPEEVRTGVVFNLTISVHVTFDDAPRATDEQIKKASNLFKRIDLKNFSTCQLANPALQRHYGILEALALGEDEMPDIKDETLPHEEGLSRPGVVKAIEEFKTSVYGENYDQEEAEAAAGKASRGDASKKRKEITDAAAQMSAVYDWAELADNGKLKEMTAAELKCYLTAHDLPVSGKKDVLVSRILTHLGK

SEQ ID NO: 20472 - DNA, 3153 bp, Sorghum bicolor
  misc_feature: Ceres ANNOT ID no. 8645135
  misc_feature: Down-regulated in shoot tissues in response to salicylic acid treatment
  misc_feature: Encodes the peptide sequence at SEQ ID NO 20473
atggagctcattgagcattttcttcgtgataaagtttggggaggtgatggcaatacatatggagaaactaaacataatatgcgtaaaagattccacccaacagtggcttctaaccctctatcttcaccaaatggacgatgccttggtgctggctattcttcactatggattcctatcgatatgtatcttgaggattgtctagatggttcaatcgctgcaacaaattccattgagattttaagtggtttggtcaaggctcttcaagcagtcaataggtcgacttggcatgatgctttcttggccctctgggtagcttcacttcgccttgtacaaagagaaagagaaccaattgaaggtcctgtacctcacctagacacacggctgtgcatgttgttgtctatcacaacacttgcgattgctgacataattatggaagcagatttactttgcaatgaaacagaactcaacagtcatgtgaatgggaagaaagcaattggtaatctacgcaacgaattgatgctaagcttacagatacttggtgattatgaaagcttgcttgttcctcctccatgtgtcatcccagcagctaatcaggctgctactaaagctgcaatattcatttcgggaatcagtataaacaatggctacatggataatgtcaatgggatgaactataccggaaatatgcgacatttgattgtggagtcatgtatttcaaggcagttgctggatacatcagcttactattggcctggttatatcagtaatcatgccaactctgcatctcatacactgcctagccaacttgctgggtggtcatctttcatgaacggtgcaccactgactcaaccactggttaatatgttggtatcaactcctgcttccagcttggcagaggtggacaagttatttgaagttgcaactgatgggtcggatgacgacagcatttctgctgccactgttttatgtggagccacccttttacgaggttggaattttcaggaacatactgttcggttagttgttaaactgctctcaccatctgatccaatcgattattctggaagagagagccaattgataaagcttggtccaatgctcaatgttattctttcaggaatatcagccgtggactacgcgccaatattctcattccatggcctgattccagagcttgctgctgctcttatggcaatctgtgaagtatttgggtctctttctccaagtgtttcctggacactgagaactggagaggaaatatctgctcacacagtcttctcgaatgcattcattcttctgttgagactctggaagtttaaccatccaccacttgagtattgcataatgggagatggtgctccagttggctcgcagctaactcctgagtatcttctgctgttgcggaattcccaggttctatcttccagcagtttgacaaaacaacgaaacggacaaaggcaatcacacatatcaacttcacacctatcatctgggaatcctatttttatggactcgtttccaaagttgaagttatggtaccggcaacaccaagcttgtctggcctcaactctctctggacttgctcatgggacacctgtacgtaacaatgtggacagccttcttaatcagatgttcagaaaggctaataaaggaggcacatctataggttctttatctggaagtagcagcataagtaattcttccggtcctggtgtggatgattcacatctttggcctcagttgccagcttgggagatactggaagctgttccatttgtggttgatgctgctctaactgcttgttcccatggaagactatttccacgtgaattggccacaggcctgaaggatctggctgatttcctgcctgcatctcttgctacaatagtaagctacttttccgctgaggtaacacggggtgtctggaagcctgcatccatgaatggatcagattggcctagcccctctgtgaacctttccatggttgatgagcacatcaagaaaatcgtagctgctaccggtgttgatgttccaaggctagttacaggaggaagttcttcgggtacacttccgttgccattggctgcttttgtgagtctcacaatcacatacaagcttgacaaggcatcagagcgtttcctcaaccttgctggtccagctctagagaacctcgctgcaagctgcccttggccaagcatggcaatcgttgcagcactgtggacccagaaggtgaagcgatggactgatttcctaatattttcagcttcgcgcacggtgttccaccacaacaacgatgcagtcgtccagctcctccgaagctgctttgctgctacccttggcatgtcttcgacatcagtatgcagctgtggaggcgtcgccagccttctgggccatgggtactgccccggtggtttctcaccagttgcaccaggaatactctacctccggatattccggtgcatcaaggactgctccatactggccgaggacatactctctcttctgatgctttcagtgaaggatatcgcggaaacaactgtgcccagacatcggtcagacaaactaaagaagaccaagtatgggatgaggcatggccaggtatctctttcggctgcaatgacgcaggtgaaggtggcggcatcgctgggagcgacactcgtctggctatctggtggcacggctctcgtccagtccctgatccaggagatgctgccgtcttggttcctggccgtgcagaacctggaccagggcggtgccagtggaggcatggtgtacaagctgggcgggcacgcgctggcctaccttgcagtgtactcggggatgttcgcctggggcattgacccaacgcccgtgtcccggcgccgcgagagggtcatgcggtcgcacctggggttcctggcgagcgcactggacggcaagatctccctgggctgcgacctctccctgtggcgtgcctacgtctctgggttcctggggctggtggtggagtgcaccccgtgctgggtgcaggaggtggacctaagggtgctcaagcgcctgagcagcggcctccggcactggggcgaggatgagctcgcggtggcgctcctccgccgtgccgggccggaggctatgggcacggccgccgagatgatcctgggcagggagtggtga

SEQ ID NO: 20473 - protein, 1050 aa, Sorghum bicolor
  misc_feature: Ceres ANNOT ID no. 8645135
  misc_feature: Down-regulated in shoot tissues in response to salicylic acid treatment
MELIEHFLRDKVWGGDGNTYGETKHNMRKRFHPTVASNPLSSPNGRCLGAGYSSLWIPIDMYLEDCLDGSIAATNSIEILSGLVKALQAVNRSTWHDAFLALWVASLRLVQREREPIEGPVPHLDTRLCMLLSITTLAIADIIMEADLLCNETELNSHVNGKKAIGNLRNELMLSLQILGDYESLLVPPPCVIPAANQAATKAAIFISGISINNGYMDNVNGMNYTGNMRHLIVESCISRQLLDTSAYYWPGYISNHANSASHTLPSQLAGWSSFMNGAPLTQPLVNMLVSTPASSLAEVDKLFEVATDGSDDDSISAATVLCGATLLRGWNFQEHTVRLVVKLLSPSDPIDYSGRESQLIKLGPMLNVILSGISAVDYAPIFSFHGLIPELAAALMAICEVFGSLSPSVSWTLRTGEEISAHTVFSNAFILLLRLWKFNHPPLEYCIMGDGAPVGSQLTPEYLLLLRNSQVLSSSSLTKQRNGQRQSHISTSHLSSGNPIFMDSFPKLKLWYRQHQACLASTLSGLAHGTPVRNNVDSLLNQMFRKANKGGTSIGSLSGSSSISNSSGPGVDDSHLWPQLPAWEILEAVPFVVDAALTACSHGRLFPRELATGLKDLADFLPASLATIVSYFSAEVTRGVWKPASMNGSDWPSPSVNLSMVDEHIKKIVAATGVDVPRLVTGGSSSGTLPLPLAAFVSLTITYKLDKASERFLNLAGPALENLAASCPWPSMAIVAALWTQKVKRWTDFLIFSASRTVFHHNNDAVVQLLRSCFAATLGMSSTSVCSCGGVASLLGHGYCPGGFSPVAPGILYLRIFRCIKDCSILAEDILSLLMLSVKDIAETTVPRHRSDKLKKTKYGMRHGQVSLSAAMTQVKVAASLGATLVWLSGGTALVQSLIQEMLPSWFLAVQNLDQGGASGGMVYKLGGHALAYLAVYSGMFAWGIDPTPVSRRRERVMRSHLGFLASALDGKISLGCDLSLWRAYVSGFLGLVVECTPCWVQEVDLRVLKRLSSGLRHWGEDELAVALLRRAGPEAMGTAAEMILGREW

SEQ ID NO: 20474 - DNA, 1716 bp, Sorghum bicolor
  misc_feature: Ceres ANNOT ID no. 8645270
  misc_feature: Down-regulated in root tissues in response to methyl jasmonate treatment
  misc_feature: Encodes the peptide sequence at SEQ ID NO 20475
atgtcatccctcatagagcatatattatcgtcaacattgggggctggcggcggcggcgactgggcgagccgcgagcgcgccgcccttcgccaggccttcgtcggccgcttcgccggcgaccaccgacgggcatccaccaggttgctgaagatgtccgcgggcgaaatcctgagggcggagttatcttccaggacgccgccgttcggcctgcggctatgggttgtgattggcatctgtatctgggcgctaatcctgtgcgtcctgggcttcatgtgtttctggtccgtacaccggaggaacaagaagcctggcaacggcaacaagccctgctgcgataagatcccggtgtcccaaatcccggacgtctccaaagagattgcggtggacgaggtgcgggagcagcaccacgccgttgtccacaacctccgtgtgcagcaggaaagccatcacacgctggccgttcaggagaagccccaccacgagaaggattcggggaagatgctggggcacctggttaggagcaagtcgagcgacgctgataacctgagccagtgcagctccgcggcgtaccagtgcgaaagggctgggagctcatactctggcgacgaaggtagctcgggcaatgcgaggaggcagtatgctcagtatgcgaccgtctccgcgtcgccgctggttggtctcccggagttctcgcacctgggttggggccattggtttactttgagggatttggagcatgcgacgaatcggttttctaaggagaatgtcattggggaaggtgggtatggagttgtttaccgtggtcgcctcataaatggtactgatgttgcagtaaagaagctccttaataacatgggtcaagctgaaaaggagttcagggttgaagttgaggcaattggacatgtcaggcataagaatcttgtccgccttcttggatattgcgtcgagggaatacacaggatgcttgtgtatgagtacgtgaataatggaaatttagaacagtggcttcatggtgcaatgcgtcaacatggtgttcttacttgggaagctcggatgaaaatcgttcttggaattgctaaggcgcttgcttatttacatgaagccatagaaccaaaagttgtgcaccgtgatatcaaatctagtaatatactaattgatgaagaattcaatggcaagctttctgattttggattggccaagctcttgggtgcaggaaagagccatatcacaactcgagttatgggaacttttgggtatgtcgcccctgaatatgccaacacaggcctgttaaatgagaggagcgatgtctacagttttggggtgctactactggaatcagtaactgggagggatccagttgactatggtcggcctgctaatgaggtgcatctggttgagtggctcaaaatgatggttggctcgagaagagctgaggaggtggtggatcctgacatggagttgaaacctaccactcgggctctgaagcgtgcccttctagtggcactgcggtgtgttgacccagactctgagaaaagacccactatgggacaggttgttcggatgctcgaggcagaagatgtcccatcgcgggaggaccgtcggagccggagggcccacagcagtaacgcagacagcgagtctaaggcaagctcaagtgaattcgagataagcagtgatcgaagagagttgggaccgtccgcgaggtttcagtcctaa

SEQ ID NO: 20475 - protein, 571 aa, Sorghum bicolor
  misc_feature: Ceres ANNOT ID no. 8645270
  misc_feature: Down-regulated in root tissues in response to methyl jasmonate treatment
  misc_feature (228)..(530): SWISSPROT Homolog: EC 2.7.11.1 Non-specific serine/threonine protein kinase
  misc_feature (251)..(522): Pfam ID: Pkinase Pfam Description: Protein kinase domain
MSSLIEHILSSTLGAGGGGDWASRERAALRQAFVGRFAGDHRRASTRLLKMSAGEILRAELSSRTPPFGLRLWVVIGICIWALILCVLGFMCFWSVHRRNKKPGNGNKPCCDKIPVSQIPDVSKEIAVDEVREQHHAVVHNLRVQQESHHTLAVQEKPHHEKDSGKMLGHLVRSKSSDADNLSQCSSAAYQCERAGSSYSGDEGSSGNARRQYAQYATVSASPLVGLPEFSHLGWGHWFTLRDLEHATNRFSKENVIGEGGYGVVYRGRLINGTDVAVKKLLNNMGQAEKEFRVEVEAIGHVRHKNLVRLLGYCVEGIHRMLVYEYVNNGNLEQWLHGAMRQHGVLTWEARMKIVLGIAKALAYLHEAIEPKVVHRDIKSSNILIDEEFNGKLSDFGLAKLLGAGKSHITTRVMGTFGYVAPEYANTGLLNERSDVYSFGVLLLESVTGRDPVDYGRPANEVHLVEWLKMMVGSRRAEEVVDPDMELKPTTRALKRALLVALRCVDPDSEKRPTMGQVVRMLEAEDVPSREDRRSRRAHSSNADSESKASSSEFEISSDRRELGPSARFQS

SEQ ID NO: 20476 - DNA, 1176 bp, Sorghum bicolor
  misc_feature: Ceres ANNOT ID no. 8645305
  misc_feature: Up-regulated in root tissues in response to salicylic acid treatment
  misc_feature: Up-regulated in shoot tissues in response to salicylic acid treatment
  misc_feature: Encodes the peptide sequence at SEQ ID NO 20477
atgccgtgccgtgccgtgccgtgccgggcagccccgttcggccaaccaccaaaggcaccaacaaagtcaaattacgcacgccgtgtccattgtcaaactagtccagatcttcctctgttgtttcctctgcttttctcccttccttcccctgcgggctggagcgcggcggcgaggagcgccgaggtcaccggtgacgctctcctaacctactccctgccgccttccgcttatctactcctgccttcgcaagctcccgcgcctacgtcgagccctccctccctccctccccgcgctctcccagcgccccaggccgcctcccaccgacgcgcggcaggcacgccgcccagctcggagggattcggggccctcgtgttcccccgccgcacccccgctctactggcctggagggggaagcgggggatccatcaggaattgattggatcgccttctcctttttcttggatatacttggaccgctgctcgcaaacacggggttggcagggcaatccctctttccaaagtgagctcggacaggtttactttggctctgagatggctgatgaggactcatccgacttcaccttctgcaaggttatttctgcagaaaatgacggtcaaccagaatctcctaaagccattcctgtagaaagtatgacactcgaggatgttcatgttgatagtgcaaatacttcaaagaacaatgggttggaaactgttgactcagaaaaagataggtctggtaacaatgtcagtgtttcaacaaaagacaataacatgcaagcaccagttacacagacaagtggtggagcagaatcaaatgtgccatcacaggcaaagcgttcatcgaagaaacctgcagcacgggcaaaggttccttttgagaaaggctatagtcaaatggattggctaaagctgacacaaacacatcctgatctagctgggcttaaggggcagtcaaaccgaaagttaatttctttagaagaggttaagcagcacaaagcaggagattgtatttggacagttctcaaaggccgcgtgtacaacattgctccatacatgaaatttcatcctggaggtgttgatatgcttatgaaagctgctgggaaagactgcactgctttgttcaagttcctcttggagaagtgccttgtcggattccttgatcccaacgagtag

SEQ ID NO: 20477 - protein, 391 aa, Sorghum bicolor
  misc_feature: Ceres ANNOT ID no. 8645305
  misc_feature: Up-regulated in root tissues in response to salicylic acid treatment
  misc_feature: Up-regulated in shoot tissues in response to salicylic acid treatment
  misc_feature (273)..(385): SWISSPROT Homolog: EC 1.6.2.2 Cytochrome-b5 reductase
  misc_feature (323)..(388): Pfam ID: Cyt-b5 Pfam Description: Cytochrome b5-like Heme/Steroid binding domain
MPCRAVPCRAAPFGQPPKAPTKSNYARRVHCQTSPDLPLLFPLLFSLPSPAGWSAAARSAEVTGDALLTYSLPPSAYLLLPSQAPAPTSSPPSLPPRALPAPQAASHRRAAGTPPSSEGFGALVFPRRTPALLAWRGKRGIHQELIGSPSPFSWIYLDRCSQTRGWQGNPSFQSELGQVYFGSEMADEDSSDFTFCKVISAENDGQPESPKAIPVESMTLEDVHVDSANTSKNNGLETVDSEKDRSGNNVSVSTKDNNMQAPVTQTSGGAESNVPSQAKRSSKKPAARAKVPFEKGYSQMDWLKLTQTHPDLAGLKGQSNRKLISLEEVKQHKAGDCIWTVLKGRVYNIAPYMKFHPGGVDMLMKAAGKDCTALFKFLLEKCLVGFLDPNE

SEQ ID NO: 20478 - DNA, 1350 bp, Sorghum bicolor
  misc_feature: Ceres ANNOT ID no. 8645464
  misc_feature: Up-regulated in root tissues in response to methyl jasmonate treatment
  misc_feature: Up-regulated in shoot tissues in response to methyl jasmonate treatment
  misc_feature: Up-regulated in shoot tissues in response to salicylic acid treatment
  misc_feature: Encodes the peptide sequence at SEQ ID NO 20479
atggccgccgccgccaccgccaccgccaccgccgtctcttcctccactttccccctcctcctcctactaccgctcctgctctgctcctgctcgcacctcaccctcgcctcggcagaagaggcggcgccggcgtcggcggcggcggagctcctgggagaggcgcgcgcgccggggttcgcggagtggctgcgcggcgtgcggcggcgcatccacgagcggcccgagctggccttccaggagcaccggacaagcgagctcgtgcgggccgagctcgacgccatcggcgtcccctacacgtggcccgtcgcccagaccggcgtcgtggccaccatcgtcggcgccgccgccgccgacggccccgtcgtcgcgctccgggccgacatggacgcgctccccgtgcaggagttggtggattgggaacacaagagccaggaaagtgggaaaatgcatgcttgcggacatgatgcacacacaacaatgcttctgggggctgctaggatacttcaagatcgcaagaatgacctaaagggcactgtaaagcttatattccagccggcagaggagggtcagggtggtgcatattatgtgttacaggaaggtgttcttgacgatgtgtcagccatatttggcttgcatgttgacccagcccttcctgtaggtgttgtttcatctaggccaggaccctttgcagcaacatcaggtcgattcctagcaacggttactggtaaaggtgggcatgctgcaatgccccatgattccatcgaccctgttgtagctgcagccactactatcgtcagccttcaacaaattatcgctcgggaaatagatcccctgcagggtgcagttgtatccatcacttttatgaaaggaggagaagcttacaatgttattccagagtctgtggcctttggtggcaccttgaggagcatgacaaatgaaggtttatcatatctcaagaagaggatcaaagagatcgtagaaggacagtcactggtacatcattgcactgcctctgtggacttcatggaggacacgatgaggacatatccggctgtgatcaatgatgaaaggatgtatgctcacgcaaaggaagtggctgagagcctccttggggacaagaacgtcaagcttggtccccaggtaatgggtgcagaggatttcgggttctatgcgcagagaatggcgggcgccttcttcaccattggagttggcaacaaaagcaccatggagacaatccattccactcactcaccctactttgtgatcgatgaggatgtgcttcccatcggagctgcgttccatgccggtgtggcaattgaatatgtgaagaagaatcatgcatcaatctaa

SEQ ID NO: 20479 - protein, 449 aa, Sorghum bicolor
  misc_feature: Ceres ANNOT ID no. 8645464
  misc_feature: Up-regulated in root tissues in response to methyl jasmonate treatment
  misc_feature: Up-regulated in shoot tissues in response to methyl jasmonate treatment
  misc_feature: Up-regulated in shoot tissues in response to salicylic acid treatment
  misc_feature (66)..(443): SWISSPROT Homolog: EC 3.5.1.32 Hippurate hydrolase
  misc_feature (123)..(440): Pfam ID: Peptidase_M20 Pfam Description: Peptidase family M20/M25/M40
MAAAATATATAVSSSTFPLLLLLPLLLCSCSHLTLASAEEAAPASAAAELLGEARAPGFAEWLRGVRRRIHERPELAFQEHRTSELVRAELDAIGVPYTWPVAQTGVVATIVGAAAADGPVVALRADMDALPVQELVDWEHKSQESGKMHACGHDAHTTMLLGAARILQDRKNDLKGTVKLIFQPAEEGQGGAYYVLQEGVLDDVSAIFGLHVDPALPVGVVSSRPGPFAATSGRFLATVTGKGGHAAMPHDSIDPVVAAATTIVSLQQIIAREIDPLQGAVVSITFMKGGEAYNVIPESVAFGGTLRSMTNEGLSYLKKRIKEIVEGQSLVHHCTASVDFMEDTMRTYPAVINDERMYAHAKEVAESLLGDKNVKLGPQVMGAEDFGFYAQRMAGAFFTIGVGNKSTMETIHSTHSPYFVIDEDVLPIGAAFHAGVAIEYVKKNHASI

SEQ ID NO: 20480 - DNA, 4083 bp, Sorghum bicolor
  misc_feature: Ceres ANNOT ID no. 8646029
  misc_feature: Down-regulated in root tissues in response to aminocyclopropane carboxylic treatment
  misc_feature: Up-regulated in shoot tissues in response to methyl jasmonate treatment
  misc_feature: Up-regulated in root tissues in response to methyl jasmonate treatment
  misc_feature: Up-regulated in shoot tissues in response to salicylic acid treatment
  misc_feature: Encodes the peptide sequence at SEQ ID NO 20481
atggcggcagagatgccgcaagtatcgatctccttcagtgcgttcagtcttgtgctctgtagtgcgacttctgattcaggtattaggaagttgtttggcaaggctcttaaaagttcatggaaaaggtcactaaagtacaatgtcaaaagtggttgtggggcttgtgttgtccttatagcaaagtataacccaaagacggatgaagtgactgagtttactgcaagttcatgcctgacacttctttacactataaatttatgttcagtaatcactaccgagggtcttgggaatagccaagatggctttcatgctgttcagaaaaggatgtctgggtttcatgcctctcagtgtggcttctgcactcctggaatgtgcatgtctattttcacttcccttatcaatgctgacaaatccaataggcctgaaccaccaaaggggttctcaaaactaaaagtatcagaagcagaaaaggctttctctggcaacatgtgcagatgcactggttaccgtccaattgttgatgcctgcaaaagttttgcatcagatgttgacttggaggatttgggccttaatatattctggaagaaaggtgataggaaccccgatgttagtgacttgccatgttacactcttggtggcggagtctgcaccttcccagactttctaaaaactgagattaaatcttcgcttgatcatctgagtaatcgttgtattgcagcctccgtggagggttggtatcatccgagaagtatcaaagagtattatgagttaataaattcttgtttttttagtgactcagtcaaagtggttgttgggaatactagtagtggtataccaggatacaaggatcaagacctctatagtaagtatattgacataggaggcattcctgaactttcaaatattgtaaggagggagtctggctttgaaattggagcagctacaccaatctctagaaccattgagatacttgaggaagaatgtgaatctgtatcctctccaaatggaaatgtcgttttgagaaaacttgcgaaccacatgagcaaagttgctacaccttttgttcgcaacacagctagtattggaggaaacatagttttggcacaaaaattcccatttccatcagacattgcaaccatactcctcggtgctggtgcaactgtttgtcttcaggtcgttgcagaacggagacaaattactttggaagagttcctagagcagcctcctatacatgctactactttactcctgagcatatttattccacactggatttcagattctgggacaaatacaagtttgttatttgaaacatacagagcagcgcctcgtcctcttggcaatgctgtttcatatgtaaattgtgctttcctggggcatgcttctgtggataaacaatcagatactcttgtattaagtaatctgcgcttggcttttggtgcatatggaacagaacatgctattagagcaaagaaggtggaggaattccttactggtaaatcactgactgcatcggttgtacttggtgcaattcaattacttagagaaacggtcgtaccaatggtgggaacatctcatcctgaatatagagtcagtgcagctgttggatttctcttcagttatctatctccgctttctaaaggcatcccagagcctggaaagtctctgaccagtagttgtgctgattcagcagatacagatgatgtctgtaacctgccattatcaacatgtcgagaaacactttccagtggcgaatataaaccagttggtgaaccgattaagaagtatggtgttgaactccaatcttctggggaggcagtatatgtggatgatattcctgctccaaagaattgcctctatggagaatttatttacagcacacgaccccttgcttatgtgaaaagtgtaaaattcaagtcttcattagcatcagagaagatcatctcttttgtttctgcaaaggatattccaagtggagggcaaaatattgggtcatccttgatgtttggtgatgaaccactatttggtgatccgattgctgagtatgctggtcaagctcttggcattgtgattgcagaaacacaaaggtatgctgacatggcagccaaacaggttattgtcgaatatgacacagaagatttgagcccaccgatcataactgtggagcaagcagtggaaaagagtagctactttgatgtcccccacgaattgtatcctaaagaagttggtgatgtttccaagggcatggcagaagcagatcacaagatcccatcaacagaagtaaaacttgcctctgagtactacttctacatggaaacacagacagcactagcagttccagatgaggataacactttggtagtctatagttcgtcacagtaccctgaacatgcacaaagtgtcatagcaaggtgcctaggtattccattcagcaatgtgcgtgtcattacaagaagggttggaggaggctttggtggaaaggcattcagatcattccaagttgcaacagcagctgcactttgtgcgtacaagttacgacgtcctgtgcgaatgtaccttaatcgcaacactgatatggttatgattggtggtagacacccagtgaaagctcattattccattggattcaagtctgatgggaaaattacggccttgcatctagatttgttaattaatgctgggatatctccagatgcaagccccattatgccaggctatattatatctagtgtcaagaagtataattggggtgctctgtcatttgacattaagctctgcaaaacaaataattcatctaaatctgtaatgcgtgctcctggagatacacaaggctctctaattgcagatgctgtaattgagcatgttgcatctgtcttgtcagtggatgctaacagcgtgagggaaaagaattttcacacctatggtactcttcagttattctacccagatagtgcaggcgaagcttctacgtacacattgcattctatttttgataggttggtctcaacttcaagctacctggatcgagctgaatccataaaggaatttaacagtaataacaagtggcagaaacggggcatctcttgtgtgcccctcattttcaaagtagagccatgggcggccccaggaagggtttctgtgctcagtgatggctccatagtggtggaggttggaagaattgaaatagggcaaggcctgtggactaaagtacagcagatgactgcctttggtctgggaaaattgtggcctgatggaggtgaaagtcttcttgagagagtgcgtgttctgcaggctgacaccttgaacttaatacaaggtggacttactgctggcagtacttcttctgaatctagttgtgctgccacccttcaggcatgcaatatgctgtttgacagattaaagccagtcttggataggctgcagcagcaatcagaaaatgtctcatgggatactttgatttcacaggcctctgaagataatgttaatttatctgcaagtgcatactgggtacctggccaagtttctaataagtacattaactatggagctggtataagtgaggtggagattgatcttcttacaggagcaattactttaatgaggggcgatcttgtgtatgactgtgggaagagcttgaaccctgcgatagacttaggacagattgaaggttcctttatacagggaattggttttttcgtatatgaagagtatattacaaacagtgatggcctgatgattagcaacagcacatgggactacaagatcccaagtgtcgacataatcccaaagcagtttaatgctgaagtgctgaacactggataccataagaaccgtgtgctttcttccaaagctgctggtgaacctgccttggttcttgcctcatccgttcattgtgcactgagagaagctatccgagcagcaagaatggagtttgcaaacagcactgtatctggacgctcaccgctggaattcaagatggatgtcccagcaccaatgacactggtgaaacaactatgcggtttagatattgtggagaagtacttagaaagtctatctacctatgaacgtgaagctgggttgtaa

SEQ ID NO: 20481 - protein, 1360 aa, Sorghum bicolor
  misc_feature: Ceres ANNOT ID no. 8646029
  misc_feature: Down-regulated in root tissues in response to aminocyclopropane carboxylic treatment
  misc_feature: Up-regulated in shoot tissues in response to methyl jasmonate treatment
  misc_feature: Up-regulated in root tissues in response to methyl jasmonate treatment
  misc_feature: Up-regulated in shoot tissues in response to salicylic acid treatment
  misc_feature (42)..(1349): SWISSPROT Homolog: EC 1.2.3.1 Aldehyde oxidase
  misc_feature (724)..(1262): Pfam ID: Ald_Xan_dh_C2 Pfam Description: Aldehyde oxidase and xanthine dehydrogenase, molybdopterin binding domain
  misc_feature (241)..(424): Pfam ID: FAD_binding_5 Pfam Description: FAD binding domain in molybdopterin dehydrogenase
  misc_feature (603)..(713): Pfam ID: Ald_Xan_dh_C Pfam Description: Aldehyde oxidase and xanthine dehydrogenase, a/b hammerhead domain
  misc_feature (91)..(178): Pfam ID: Fer2_2 Pfam Description: [2Fe-2S] binding domain
  misc_feature (437)..(550): Pfam ID: CO_deh_flav_C Pfam Description: CO dehydrogenase flavoprotein C-terminal domain
MAAEMPQVSISFSAFSLVLCSATSDSGIRKLFGKALKSSWKRSLKYNVKSGCGACVVLIAKYNPKTDEVTEFTASSCLTLLYTINLCSVITTEGLGNSQDGFHAVQKRMSGFHASQCGFCTPGMCMSIFTSLINADKSNRPEPPKGFSKLKVSEAEKAFSGNMCRCTGYRPIVDACKSFASDVDLEDLGLNIFWKKGDRNPDVSDLPCYTLGGGVCTFPDFLKTEIKSSLDHLSNRCIAASVEGWYHPRSIKEYYELINSCFFSDSVKVVVGNTSSGIPGYKDQDLYSKYIDIGGIPELSNIVRRESGFEIGAATPISRTIEILEEECESVSSPNGNVVLRKLANHMSKVATPFVRNTASIGGNIVLAQKFPFPSDIATILLGAGATVCLQVVAERRQITLEEFLEQPPIHATTLLLSIFIPHWISDSGTNTSLLFETYRAAPRPLGNAVSYVNCAFLGHASVDKQSDTLVLSNLRLAFGAYGTEHAIRAKKVEEFLTGKSLTASVVLGAIQLLRETVVPMVGTSHPEYRVSAAVGFLFSYLSPLSKGIPEPGKSLTSSCADSADTDDVCNLPLSTCRETLSSGEYKPVGEPIKKYGVELQSSGEAVYVDDIPAPKNCLYGEFIYSTRPLAYVKSVKFKSSLASEKIISFVSAKDIPSGGQNIGSSLMFGDEPLFGDPIAEYAGQALGIVIAETQRYADMAAKQVIVEYDTEDLSPPIITVEQAVEKSSYFDVPHELYPKEVGDVSKGMAEADHKIPSTEVKLASEYYFYMETQTALAVPDEDNTLVVYSSSQYPEHAQSVIARCLGIPFSNVRVITRRVGGGFGGKAFRSFQVATAAALCAYKLRRPVRMYLNRNTDMVMIGGRHPVKAHYSIGFKSDGKITALHLDLLINAGISPDASPIMPGYIISSVKKYNWGALSFDIKLCKTNNSSKSVMRAPGDTQGSLIADAVIEHVASVLSVDANSVREKNFHTYGTLQLFYPDSAGEASTYTLHSIFDRLVSTSSYLDRAESIKEFNSNNKWQKRGISCVPLIFKVEPWAAPGRVSVLSDGSIVVEVGRIEIGQGLWTKVQQMTAFGLGKLWPDGGESLLERVRVLQADTLNLIQGGLTAGSTSSESSCAATLQACNMLFDRLKPVLDRLQQQSENVSWDTLISQASEDNVNLSASAYWVPGQVSNKYINYGAGISEVEIDLLTGAITLMRGDLVYDCGKSLNPAIDLGQIEGSFIQGIGFFVYEEYITNSDGLMISNSTWDYKIPSVDIIPKQFNAEVLNTGYHKNRVLSSKAAGEPALVLASSVHCALREAIRAARMEFANSTVSGRSPLEFKMDVPAPMTLVKQLCGLDIVEKYLESLSTYEREAGL

SEQ ID NO: 20482 - DNA, 4083 bp, Sorghum bicolor
  misc_feature: Ceres ANNOT ID no. 8646036
  misc_feature: Down-regulated in root tissues in response to aminocyclopropane carboxylic treatment
  misc_feature: Up-regulated in shoot tissues in response to methyl jasmonate treatment
  misc_feature: Up-regulated in root tissues in response to methyl jasmonate treatment
  misc_feature: Up-regulated in shoot tissues in response to salicylic acid treatment
  misc_feature: Encodes the peptide sequence at SEQ ID NO 20483
atggatcccggcgaggccacaccgaggcctgaccctgcaggagcagctcccccggtatggcctgcccctacgggagaggatccgacagcggcctcatggagaccgatgtatagtagccttctcatagcaaagatcgattcccccgcgaggcgtgcccctacagggcaggatctgctggcagcctcgataagactgatgatagaaaatgacaattgggtattaggaagttttttggcaaggctcttaaatgttcatggaaaggccactaaaatacaatgcggttgtggggcttgtgttgtccttatagcaaagtataacccaaagacggatgaagtgactgaatttacagcaagttcatgcctgacacttctttacacattaaatttctgttcggttatcactactgagggtctggggaattcccgggatggctttcatgctgttcaggaaaggatgtcggggtttcatgcttctcagtgtggcttctgcactcctggaatgtgcatgtctattttcacttcccttatcaatgctgacaaatccaatagtcctgaaccaccaaaggggttctcaaaactaaaagtatcagaagcagaaaaggctttctctggcaacatgtgcagatgcactggttaccgtccaattgttgatgcctgcaaaagttttgcatcagatgttgacttggaggatttgggccttaatatattctggaagaaagtctccagggagggttggtatcatccaagaagtatcaaagaatattatgagttaataaattcttgtttatttagtgactcagtcaaagtggttgttgggaatactagcagtggtgtaccaggatacaaggatcaagacctctatagtaagtatattgacataggaggcattccagaactttcaaatatcatacggagggagtctggctttgaaattggagcagctacaccaatctctaggaccattgagatacttgaggaagaatgtgaatctacatcctctgcaaagggaagcgtggttttcagaaaacttgcgaaccacatgagcaaagtttctacaccttttgttcgtaacacagctagtattggaggaaacatagttttggcacaaaaattcccatttccatcagatattgcaaccatactcctcggtgctggtgcaacagtttgtcttcaggtagttgcagaacgaagacaaattactttggaagagttcctagagcagcctcctatagatgctactactttactcctgagcatatttattccacagtggatcccagattctgggacaaagacaagtttgttgtttgaaacttacagagcagctcctcgtcctcttggcaatgctgtttcatatgtaaattgtgctttcttggggcatgcttctgtggatgaacaatcagatactcttgtattgagtaatctgcggttggcttttggtgcatatggaacggaacatgctattagagcaaagaaggtggaggaattccttactggtaaagcactcactgcttcggttgtacttggtgcaattcaattacttagagaaacggttgtaccaatggagggaacatcacatcctgaatatagagtcagtgcagctgttggatttctcttcagtttcctatctccgctttctaaatgcatcccagatccgggaaagtctctgaccagtagttctgctggttcagcagatacagatgatgtccataatctgccattatcatcacgtcgagaaacattttccagtgacgagtataaaccagtcggtgagccgattaagaagtacggtgttgaacttcaagcttcaggggaggcagtatatgtagatgacattcctgttccaaagaattgcctctatggagaatttatttacagcacacaaccccttgcttatgtcaaaagtataaaattcaaatcttctttagcatcagagaagatcgtctcttttgtttctgcaaaggatattccaagtggaggacaaaatattggatcatccttcacgtttggtgacgaaccactatttggttatccaattgctgagtatgctggtcaagctctaggcattgtgattgcagaaacacagagatatgctgacatggcagccaagcaggttattattgaatatgacacagaagatttgagcccagcgatcataactgtggagcaagcagtggaaaagagtagctactttgatgtccccccagaattgtatcctaaagaagttggtgatgtttccaagggcatggcagaagctgatcacaagatcccatcaacagaagtaaaacttgcctctgagtactacttctacatggaaacacagacagcactagcagttccagatgagcataacactttggtagtctacagttcgacacagtaccctgaacttgcacaaagtgtcatagcaaggtgcctaggtattccattcagcaatgtgcgtgtcattacaagaagggttggaggaggtttcggtggaaaggcattcagatcattccaagttgcaacggcagctgcactctgtgcgtacaagttacaacgccctgtacgaatgtaccttaatcgcaacactgatatggttatgattggtggtaggcacccagtgaaagctcattattctgtcggattcaagtctgatgggaaaattacagccttacatctagatttattaattaacgctgggatatctccagatgcaagccccataataccaggcactattatatctagtgtcaagaagtacaactggggtgctctgtcatttgacatcaagctctgcaaaacaaataattcatctaaatctgttatgcgtgctcctggagatacacaaggctctctaattgcagatgctgtaattgagcatgtcgcgtctgtcctgtcagtggatgcgaacagcgtgagggaaaagaattttcatacctatggcactcttcagttgttctacccagatagtgcgggtgaagcttctacgtacacattgcattctatttttgataggctggtctcaacttcaagctacctggatcgagctgaatccataaaggaatttaatagtaagaacaagtggcggaaacgtggcatctcttgtgtacccctcattttcaaagtagagccaaggccggccccaggaagggtttctgtgctcaatgatggctccatagtagtcgaggttggtggaattgaaatcggacaaggtctgtggacgaaagtacagcagatgactgcttttgctctgggaaaattatggcctgatggaggtcaaagtcttcttgagagagtgcgtgttctacaggctgacaccttgaacttaatacaaggtggacttactgctggcagcacttcttctgaatctagttgtgcagccacccttcaagcatgcaatatgttgtttgatagattaaagccagtcttggataggctgcagcagcaatcagaaaatgtctcatgggatactttgatttcccaggcctcgaaagataatgttaatttatctgcaagtgcgtactgggtacctggccaagtttctaataagtaccttaactatggagctggtataagtgaggtggagattgatcttcttacaggagcaattactttaataaggggcgatcttgtgtatgactgtgggaagagcttgaaccctgccgtagacttaggacagattgaaggttcctttatacagggaattggttttttcgtatatgaagagtatattacgaacagtgatggcctgatgattagcaacagcacatgggactacaagatcccaagtgtggacataatcccaaagcagtttaatgctgaggtgctgaacactggataccataagaaccgtgtgctttcttcaaaagcttctggtgaacctgccttggttcttgcctcatccgttcattgtgcactgagagaagctatccgagcagcgagagtggggtttgctaacagcactgtatctggatgctcaccgctggagtttcagatggatgtcccagcaccaatgacagtggtgaaagaattatgtggtttagatattgtcgagaagtacttagaacgtctatctacctatgaacgtgtggctggggcgtaa

SEQ ID NO: 20483 - protein, 1360 aa, Sorghum bicolor
  misc_feature: Ceres ANNOT ID no. 8646036
  misc_feature: Down-regulated in root tissues in response to aminocyclopropane carboxylic treatment
  misc_feature: Up-regulated in shoot tissues in response to methyl jasmonate treatment
  misc_feature: Up-regulated in root tissues in response to methyl jasmonate treatment
  misc_feature: Up-regulated in shoot tissues in response to salicylic acid treatment
  misc_feature (87)..(1349): SWISSPROT Homolog: EC 1.2.3.1 Aldehyde oxidase
  misc_feature (724)..(1262): Pfam ID: Ald_Xan_dh_C2 Pfam Description: Aldehyde oxidase and xanthine dehydrogenase, molybdopterin binding domain
  misc_feature (241)..(424): Pfam ID: FAD_binding_5 Pfam Description: FAD binding domain in molybdopterin dehydrogenase
  misc_feature (134)..(221): Pfam ID: Fer2_2 Pfam Description: [2Fe-2S] binding domain
  misc_feature (603)..(713): Pfam ID: Ald_Xan_dh_C Pfam Description: Aldehyde oxidase and xanthine dehydrogenase, a/b hammerhead domain
  misc_feature (437)..(550): Pfam ID: CO_deh_flav_C Pfam Description: CO dehydrogenase flavoprotein C-terminal domain
MDPGEATPRPDPAGAAPPVWPAPTGEDPTAASWRPMYSSLLIAKIDSPARRAPTGQDLLAASIRLMIENDNWVLGSFLARLLNVHGKATKIQCGCGACVVLIAKYNPKTDEVTEFTASSCLTLLYTLNFCSVITTEGLGNSRDGFHAVQERMSGFHASQCGFCTPGMCMSIFTSLINADKSNSPEPPKGFSKLKVSEAEKAFSGNMCRCTGYRPIVDACKSFASDVDLEDLGLNIFWKKVSREGWYHPRSIKEYYELINSCLFSDSVKVVVGNTSSGVPGYKDQDLYSKYIDIGGIPELSNIIRRESGFEIGAATPISRTIEILEEECESTSSAKGSVVFRKLANHMSKVSTPFVRNTASIGGNIVLAQKFPFPSDIATILLGAGATVCLQVVAERRQITLEEFLEQPPIDATTLLLSIFIPQWIPDSGTKTSLLFETYRAAPRPLGNAVSYVNCAFLGHASVDEQSDTLVLSNLRLAFGAYGTEHAIRAKKVEEFLTGKALTASVVLGAIQLLRETVVPMEGTSHPEYRVSAAVGFLFSFLSPLSKCIPDPGKSLTSSSAGSADTDDVHNLPLSSRRETFSSDEYKPVGEPIKKYGVELQASGEAVYVDDIPVPKNCLYGEFIYSTQPLAYVKSIKFKSSLASEKIVSFVSAKDIPSGGQNIGSSFTFGDEPLFGYPIAEYAGQALGIVIAETQRYADMAAKQVIIEYDTEDLSPAIITVEQAVEKSSYFDVPPELYPKEVGDVSKGMAEADHKIPSTEVKLASEYYFYMETQTALAVPDEHNTLVVYSSTQYPELAQSVIARCLGIPFSNVRVITRRVGGGFGGKAFRSFQVATAAALCAYKLQRPVRMYLNRNTDMVMIGGRHPVKAHYSVGFKSDGKITALHLDLLINAGISPDASPIIPGTIISSVKKYNWGALSFDIKLCKTNNSSKSVMRAPGDTQGSLIADAVIEHVASVLSVDANSVREKNFHTYGTLQLFYPDSAGEASTYTLHSIFDRLVSTSSYLDRAESIKEFNSKNKWRKRGISCVPLIFKVEPRPAPGRVSVLNDGSIVVEVGGIEIGQGLWTKVQQMTAFALGKLWPDGGQSLLERVRVLQADTLNLIQGGLTAGSTSSESSCAATLQACNMLFDRLKPVLDRLQQQSENVSWDTLISQASKDNVNLSASAYWVPGQVSNKYLNYGAGISEVEIDLLTGAITLIRGDLVYDCGKSLNPAVDLGQIEGSFIQGIGFFVYEEYITNSDGLMISNSTWDYKIPSVDIIPKQFNAEVLNTGYHKNRVLSSKASGEPALVLASSVHCALREAIRAARVGFANSTVSGCSPLEFQMDVPAPMTVVKELCGLDIVEKYLERLSTYERVAGA

SEQ ID NO: 20484 - DNA, 4347 bp, Sorghum bicolor
  misc_feature: Ceres ANNOT ID no. 8646053
  misc_feature: Down-regulated in root tissues in response to aminocyclopropane carboxylic treatment
  misc_feature: Up-regulated in shoot tissues in response to methyl jasmonate treatment
  misc_feature: Up-regulated in root tissues in response to methyl jasmonate treatment
  misc_feature: Up-regulated in shoot tissues in response to salicylic acid treatment
  misc_feature: Encodes the peptide sequence at SEQ ID NO 20485
atggcgcacgagttggggtggccgcggaatgctgccacgggatctgctgccattgttcggacacggcagagatgccgccagcatcgagctccttcagtgccttcggtcctggtggcgcccttttcatccatcagtgacaccagggttaggttttcggtccagcagacttgggagggagttgaatctcgagagccgggctacctgcctggttgcgtgacattgcacgagttagaaagttgtttggaaaggctcttaaaagtgcatggaaaggccactaaaatagaatgtccagagtatctcttctggatgaccgtaatccttaaaatggtttggaataaaaactctttccaggacaaatcaaatcgcaacgtatttggttattttagccagttagattcagatctttcagttcagcctattcttgcacatctgtgtggcggttgtggggcttgtgttgtccttatagcaaagtataacccaaagattactgcaagttcatgcttgacactactttacactataaatttctgttcagttatcacaactgagggtctgggaaatagccaagagggctttcatgctgttcaggaaaggatgtctgggtttcatgcctctcagtgtggcttctgcactcctggaatgtgcatgtctattttcacttcccttatcaatgctgacaaatccaataggcctgaaccaccaaaggggttctcaaaactaaaagtatcagaagcagaaaaggctttctctggcaacatgtgcagatgcactggttaccgtccaattgttgatgcctgcaaaagttttgcatcagatgttgacttggaggatttgggccttaatatattctggaagaaaggtgataagaacccagatgttagtgaattgccaagttacatccttggtggcggaatctgcacctttcctgactttctaaaaactgagataaaatcttcacttgatcatctgagtagtccttgtattgcagtctccagggagggttggtatcatccgagaagtatcaaagaatattatgagttaataaattcttatttatttagtgactcagtcaaagtggttgttgggaatactagcagtggtgtaccaggatacaaggatcaagacatctatagtaagtatattgacataggaggcattccagaactttcaaatattgtaaggagggagtctggctttgaaattggagcagctacaccaatctctaggaccattgagatacttgaggaagaatgtgaatctacatcctctccaaagggaagcgtggttttcagaaaacttgcgaaccacatgagcaaagttgctacaccttttgttcgtaacacagctagtattggaggaaacatagttttggcacaaaaattcccatttccatcagatattgcaaccatactcctcggtgctggtgcaacagtttgtcttcaggtagttgcagaacgaagacaaattactttggaagagttcctagagcagcctcctatagatgctactactttactcctgagcatatttattccacattggatcccagattctgggacaaagacaagattgttatttgaaacttacagagcagctcctcgtcctcttggcaatgctgtttcatatgtaaattgtgctttcttggggcatgcttgtgtggatgaacaatcagatactcttgtattgagtaatctgcggttggcttttggtgcatatggaacagaacatgctattagagcaaagaaggtggaggaattccttactggtaaagcactcactgcttcggttgtacttggtgcaattcaattacttagagaaacggttgtaccaatggagggaacatcacatcctgaatatagagtcagtgcagctgttggatttctcttcagtttcctatctccgctttctaaaggcatcccagagcctgggaagtctctgaacagtagttctgctgattcagcagatacaaatctgccattatcaacacgtcaagaaacattttccagtgatgattataaaccagttggtgaaccggttaggaagtatggtgttgaacttcaagcttctggggaggcagtatatgtggatgatattcctgctccaaagaattgcctctatggagaatttgtttacagcacacaaccccttgcttatgttaaaagtataaaattcaagtcttctttagcatcagagaagatcatctcttttgtttctgcaaaggatattccaagtggaggacaaaatattggttcatcctttatgtttggtgacgaaccactatttggtgatccgattgctgagtatgctggtcaagctcttggcattgtgattgcagaaacacaaaggtatgctgacatggcagccaagcaggttattattgaatatgacacagaagatttgagcccaccgatcataactgtggagcaagcagtggaaaagagtagctactttgatgtccccccggaattgtatcctaaagaagttggtgatgtctccaagggcatggcagaagctgatcacaagatcccatcaacagaagtaaaacttgcctctgagtaccacttctacatggaaacacagacagcactagcagttccagatgaggataacactttggtagtctacagttcgtcacagtaccctgaacttgcacaaagtgtcatagcaaggtgcctaggtattccattcagcaatgtgcgtgtcattacaagaagggttggaggaggctttggtggaaaggcattcagatcattccaagttgcaacgggagctgcactttgtgcatacaagttacgacgtcctgtacgaatgtaccttaatcgcaacactgatatggttatgattggtggtaggcacccagttaaagctcattattctgtcggattcaagtctgatggaaaaattacggccttgcgtctagatttattaattaacgctggaatatctccagatgcaagccccgtgataccaggctatattatatctagtgtcaagaagtacaattggggtgctctgtcatttgacatcaagctctgcaaaacaaataattcatctaaatctgtaatgcgtgctcctggagatgcacaaggctccctaatggcagatgctgtaattgagcatgttgcgtctgtcctgtcagtggatgctaacagcgtgagggaaaagaattttcacacctatggtactcttcagttgttctacccagatagtgcgggcgaagcttctacgtacacattgcattctatttttgataggttgatctcaacttcaagctacctggatcgagctgagtccataaaggaatttaatagtaacaacaagtggcggaaacgtggcatctcttgtgtacccctcattttcaaagtagagccaaggccggccccaggaagggtttccgtgctcaatgatggctccatagtgttggaggttggtggaattgaaatcgggcaaggtctatggacaaaagtacagcagatgactgcctttgctctaggaaaattatggcctgatggaggtgaaagtcttcttgagagagtgcgtgttctacaggccgacaccttgaacttaatacaaggtggacttactgctggcagcacttcttctgaatctagttgtgcagccacccttcaggcatgcaatatgctgtttgatagattaaagccagtcttggataggctgcagcagcaatcagaaaatgtctcatgggatactttgatttctcaggcaacagcctctaaagataatgttaatttatctgcaagtgcgtactgggtacctggccaagtttctaataagtaccttaactatggagctggtataagtgaggtggagattgatcttcttacaggagcaattactttaataaggggcgatcttgtgtatgactgtgggaagagcttgaaccctgcagtagacttaggacagattgaaggttcctttatacagggaattggttttttcgtatatgaagagtatattacgaacagtgatggcctgatgattagcaacagcacatgggactacaagatcccaagtgtggacataatcccaaaacagtttcatgctgaggtgctgaacactggataccataagaaccgtgtgctttcttcaaaagcttctggtgaacctgccttggttcttgcctcatccgttcattgtgcactgagagaagctatccgagcagcaagagtggagtttgcaaacagcactgtatctggacgctcaccactggaatttcagatggatgtccctgcaccaatgacactggtgaaagaactatgtggtttagatattgtggagaagtatttggaatgtctatctacctatgaacgtgcggctagggcgtaa

SEQ ID NO: 20485 - protein, 1448 aa, Sorghum bicolor
  misc_feature: Ceres ANNOT ID no. 8646053
  misc_feature: Down-regulated in root tissues in response to aminocyclopropane carboxylic treatment
  misc_feature: Up-regulated in shoot tissues in response to methyl jasmonate treatment
  misc_feature: Up-regulated in root tissues in response to methyl jasmonate treatment
  misc_feature: Up-regulated in shoot tissues in response to salicylic acid treatment
  misc_feature (146)..(1437): SWISSPROT Homolog: EC 1.2.3.14 Abscisic-aldehyde oxidase
  misc_feature (810)..(1350): Pfam ID: Ald_Xan_dh_C2 Pfam Description: Aldehyde oxidase and xanthine dehydrogenase, molybdopterin binding domain
  misc_feature (331)..(514): Pfam ID: FAD_binding_5 Pfam Description: FAD binding domain in molybdopterin dehydrogenase
  misc_feature (689)..(799): Pfam ID: Ald_Xan_dh_C Pfam Description: Aldehyde oxidase and xanthine dehydrogenase, a/b hammerhead domain
  misc_feature (181)..(268): Pfam ID: Fer2_2 Pfam Description: [2Fe-2S] binding domain
  misc_feature (527)..(640): Pfam ID: CO_deh_flav_C Pfam Description: CO dehydrogenase flavoprotein C-terminal domain
MAHELGWPRNAATGSAAIVRTRQRCRQHRAPSVPSVLVAPFSSISDTRVRFSVQQTWEGVESREPGYLPGCVTLHELESCLERLLKVHGKATKIECPEYLFWMTVILKMVWNKNSFQDKSNRNVFGYFSQLDSDLSVQPILAHLCGGCGACVVLIAKYNPKITASSCLTLLYTINFCSVITTEGLGNSQEGFHAVQERMSGFHASQCGFCTPGMCMSIFTSLINADKSNRPEPPKGFSKLKVSEAEKAFSGNMCRCTGYRPIVDACKSFASDVDLEDLGLNIFWKKGDKNPDVSELPSYILGGGICTFPDFLKTEIKSSLDHLSSPCIAVSREGWYHPRSIKEYYELINSYLFSDSVKVVVGNTSSGVPGYKDQDIYSKYIDIGGIPELSNIVRRESGFEIGAATPISRTIEILEEECESTSSPKGSVVFRKLANHMSKVATPFVRNTASIGGNIVLAQKFPFPSDIATILLGAGATVCLQVVAERRQITLEEFLEQPPIDATTLLLSIFIPHWIPDSGTKTRLLFETYRAAPRPLGNAVSYVNCAFLGHACVDEQSDTLVLSNLRLAFGAYGTEHAIRAKKVEEFLTGKALTASVVLGAIQLLRETVVPMEGTSHPEYRVSAAVGFLFSFLSPLSKGIPEPGKSLNSSSADSADTNLPLSTRQETFSSDDYKPVGEPVRKYGVELQASGEAVYVDDIPAPKNCLYGEFVYSTQPLAYVKSIKFKSSLASEKIISFVSAKDIPSGGQNIGSSFMFGDEPLFGDPIAEYAGQALGIVIAETQRYADMAAKQVIIEYDTEDLSPPIITVEQAVEKSSYFDVPPELYPKEVGDVSKGMAEADHKIPSTEVKLASEYHFYMETQTALAVPDEDNTLVVYSSSQYPELAQSVIARCLGIPFSNVRVITRRVGGGFGGKAFRSFQVATGAALCAYKLRRPVRMYLNRNTDMVMIGGRHPVKAHYSVGFKSDGKITALRLDLLINAGISPDASPVIPGYIISSVKKYNWGALSFDIKLCKTNNSSKSVMRAPGDAQGSLMADAVIEHVASVLSVDANSVREKNFHTYGTLQLFYPDSAGEASTYTLHSIFDRLISTSSYLDRAESIKEFNSNNKWRKRGISCVPLIFKVEPRPAPGRVSVLNDGSIVLEVGGIEIGQGLWTKVQQMTAFALGKLWPDGGESLLERVRVLQADTLNLIQGGLTAGSTSSESSCAATLQACNMLFDRLKPVLDRLQQQSENVSWDTLISQATASKDNVNLSASAYWVPGQVSNKYLNYGAGISEVEIDLLTGAITLIRGDLVYDCGKSLNPAVDLGQIEGSFIQGIGFFVYEEYITNSDGLMISNSTWDYKIPSVDIIPKQFHAEVLNTGYHKNRVLSSKASGEPALVLASSVHCALREAIRAARVEFANSTVSGRSPLEFQMDVPAPMTLVKELCGLDIVEKYLECLSTYERAARA

SEQ ID NO: 20486 - DNA, 1011 bp, Sorghum bicolor
  misc_feature: Ceres ANNOT ID no. 8646316
  misc_feature: Down-regulated in shoot tissues in response to methyl jasmonate treatment
  misc_feature: Encodes the peptide sequence at SEQ ID NO 20487
atggtcgccgtccgtctcctcggcctgcgtccgtcgcctggccgtctggagaggtgggtggggagtctaccggccgcgggtagctggggcggtcgcctccccttgcctataggaagtgtccgctcctacttcattcggtccattcccccggccggaggagttgagagaggagcaagggcggcgaggcccccgcgcgccgcgatgggcggcgacctgtacgcccttgacttcgacggcgtcttgtgcgacagctgcggggagagctccctctcggccgtcaaggctgcgaaggtgaggtggccgtcgctgtttgagcaggttgacgccgccatggaggagtggatagtggagcagatgtacacccttcgtccagtggtggaaacaggatatgagaacctgttgcttgtaaggttgcttgttgagatccagataccctctgttcgaaaatcatcagttgcagatgggcttagcatccaagaaatattggagaactggttaaaactgaagcccactctcatggatgagtggcaagaagatagggaatctcttgtagatctctttggccgtgtaagagatgattggattgaaaatgatttttctggctggataggtgctaacaggttttatcctgggacagctgatgcattgaagctttcaagctccgaaacttacatagtcacaacaaaacagagtagatttgctgaagctctactcaaagaattggctggaatagactttccctctgaaaggatatatggccttggcactggtccaaaggttaaagttctccagcagctgcagcaaatgccgcagaaccaaggcctaaaacttcatttcgtcgaggaccgacttgcgactctgaagaatgtgatcaaagaaccagcgctggacaaatggaacctctacctggtgacatggggatacaacacacagaaagagagggaagaagcagaggctataccaagggttcaactcattgatctcccagatttcagtaggcagctcaaatag

SEQ ID NO: 20487 - protein, 336 aa, Sorghum bicolor
  misc_feature: Ceres ANNOT ID no. 8646316
  misc_feature: Down-regulated in shoot tissues in response to methyl jasmonate treatment
MVAVRLLGLRPSPGRLERWVGSLPAAGSWGGRLPLPIGSVRSYFIRSIPPAGGVERGARAARPPRAAMGGDLYALDFDGVLCDSCGESSLSAVKAAKVRWPSLFEQVDAAMEEWIVEQMYTLRPVVETGYENLLLVRLLVEIQIPSVRKSSVADGLSIQEILENWLKLKPTLMDEWQEDRESLVDLFGRVRDDWIENDFSGWIGANRFYPGTADALKLSSSETYIVTTKQSRFAEALLKELAGIDFPSERIYGLGTGPKVKVLQQLQQMPQNQGLKLHFVEDRLATLKNVIKEPALDKWNLYLVTWGYNTQKEREEAEAIPRVQLIDLPDFSRQLK

SEQ ID NO: 20488 - DNA, 6000 bp, Sorghum bicolor
  misc_feature: Ceres ANNOT ID no. 8646351
  misc_feature: Down-regulated in shoot tissues in response to salicylic acid treatment
  misc_feature: Encodes the peptide sequence at SEQ ID NO 20489
atggagcacactgctctgctgctgctgctgctgctgcttctcttctctctcagcgaattgcttgttgcaatccgtcatgctcatgcctgcctgccattcacaaactcgtgtgtttctaatgaggagcaactgaggcacaaccccaaccccaacccgtccctgttctgttcgtcgcaatatctgtttctgctcagcagtggctatctcttgcttgctcgctcgccattgggcgcgtgcatggcgcccaagagcaagcgcgggaagggcaagggagagaagaagaagaaagatgagaaagttctccctatcgccattgacatcagtgtgaacctgccggaccagtctcatgtcattctgaaggggatttcaacggacaggatcatcgatgtgaggcggctgctctgcgtcaacaccgccacgtgtgccatcacaaactactctctcacacatgagatgcgtgatggtgccttgaaggatgccgctgacattgctacactgaaaccctgcacgctgacgttggtagaagaggagtacagcgaggagagcgcggtcgagcacgtcaggcgtctgctggacatcgtcgcctgcaccacctccttcggccccgcgccgccacctccgccgccgccgtctcccaaggacgccgatgccgccaaggagtcctccagctccagcgccacctccaaggccgccgcatccgcctcctcgggcgggcgccgaacggcctcgccgccgccgtcctcgccgtcctccgctgccgcgaaggagtcgtcagccgcaaaggaggcagcagccaaggagtccgcggctgcggcagagctggaggccgagatgagcggcgcgtgcccccgcctcggcgccttctacgagttcttctcactcgccaacctcacgccgccactccaatttgtaaggcgagtgttgcagcctcgacaggaggagcagccttcggatgaccatctgttctttcttgaggcaaagctttgtagtgggaaattcattgttattgaagctcgacgaaagggattcttcagtttaggaaagcagcgagtcttgtgtcataacctggtcgatcttctgcggcatcttagtagaccatttgataatgtttatgaagatcttatgaaggcatttttggaacgaaacaagtttggaaattttccttatggatttcgtgcaaatacatggcttgttcctccaattgctgcccagtcaccatcaacatttcctcctcttcctgctgaggatgaaacatggggaggcagtggaggtggttggggaagggatggaaagagcgacatggtgccatgggcagatgaatttctctatctcacatccatgccttgcaaaactgctgaggagagggaactccgtgacaggagagcattcctacttcacagcctctttgtagatgttgccatctttcgtgctattgcagcagtaaggcatgtaatggagagcacagagttatcggcatcaaccaagatagatgaagttttgtattctgagacagtgggaaattttagcatcactgtcacaagagattcttcagatgcaagctgcaagttggacactaagatagatggaaacagagccacaggaatggactctaaaaatcttgcggaaaggaaccttttgaaaggaataactgcagatgaaaacacagctgcccacgatgttgacagtttgggcattatcaaccttagatattgtgggtatgttgcagtagcaaaggtggacaacatcgacaaaaccaaagtaaactcttctatcaagcctatgaatatcgcagatcaacctgaagggggtgcacatgcattgaacattaacagtttgaggatgctccttaatgaagccacttctactggagagaaaaagatatcaaacctttcacaaaatcataggcaggaagaactaattgcggcacaaaattttgttgagaaattattgaaggaaagtcttcagaagcttgaggaagaggaaaatgtaaaacagccatttatgagatgggaacttggtgcctgctgggttcagcatttgcaggatcagaaaaattctgataaggataaaaagcaaggtggtgagaaggataagaagaaaacagtggagaaatctaaagaaccaaagattgaagggctagggaagcctctcaaagctcttaagaatgcgaaaaatgttaattctgctgacctgggttcctcattggggcccaaaagctctgcagaaagccagaaagacaagccatcagatgttgaattgcctcaaggagagactagtgcttctgagaatgaaaaccttctgaaggatttattaccagaatctgcttttacaaggttgaaagaatctgaaactgggctccaccagaagtcaccacctgagttgattgagatggctctgaagtactacgatgaagttgcacttcctaagctggttgctgattttggttctctggaactttcacctgttgatggtaggactttgactgatttcatgcataccagaggcctacagatgcgctctctaggacgagtcgtcaagctttcagagaagctttcacatgttcagtccttatgtgtgcatgagatgatagtgcgtgctttcaagcatatcgtccgctctgtgattgctgctatttcagacatgcgacaattagcactaacaatagctgcagctttgaacttactgcttggtgttcctgaatctgatttctctggaagttctcctaatgtgcatcccctagtatggagatggctggtgaccttcttgaaaaagagatatgaatttgagcttacggagaaacattaccatgatgtgaggaaatatgctgtccttagaggactatgccataaggtgggcattgaattggcaccccgagatttcattatggattgctctttcccattccataagcaggacattattagcctggtacctgtacataagcaagttgcatgctcatctgcagatggtaggcaactgctagaatcctctaaaactgcccttgacaagggtaaacttgaagatgctgtcaattatgggaccaaggcactttccaagctcataactgtatgtggtccctaccaccgaatgacagctggagcttatagtctgctagctgttgttttgtaccatactggtgattttaatcaggctactatttatcagcaaaaggccctagacatcaacgagagggaacttggacttgaccaccctgatactatgaagagctatggagaccttgctgtgttctactaccgtctgcaacatacagaattggccctaaagtatgtcaagcgtgcgctatatcttctgcatcttacgtgcgggccatctcatccaaatacagctgctacatatatcaatgtagctatgatggaagaaggattgggcaatgtgcatgtagctctaagatatttacacaaagctttaaaatgcaaccagaaattgcttggacctgatcatatacagactgctgccagctaccatgctatagcaatagctctctcattgatggaagcatattccttgagtgttcagcatgagcaaacaaccttgcaaatccttcgtgcaaagcttggaccagatgacctacgaactcaggatgctgctgcttggcttgaatactttgagtcaaaagtaattgagcaacaagaggctgcacggaatggaactcggaaacctgacgcatcaatagctagtaaaggacacctaagtgtatctgatcttctcgattacataaatcctgaccaagagagcaagggaagagactctgaatctggaaaaaggagatactcaagcataaaggttttatcccattcaaacgaaagttcaaatggagcaagccctgagatatctccaagagattcaaatcccattatagatgaggaacagcaagttaaagagccatcaaaagatgacagtacggaaattatttctgaagctgaggttaaacagactcctgaatcatttgagcatccagcaccttctgagctacaactagagatagctgaagtgaacattaatgcacctaaggaagctattgaagttgaaaattcagaacctgaagatggttggcagcctgttcaaagacctaaatcagctgggggtccaggtaaacagatgaagcattatcgtccaaccaccagaaaggtgtatgaacctgatagtcatgatccaacatatacttcacaatacaaggcaaggaattcctattcaaataaccggtattatttcttaaggaagagaacagttgttcctacaacgtacacagatcctcaacagcatgtgaaagttcagacatctggtgccaggtttggtcgcaagatttacaaggctgtgacctatcgggttaagccagggactgcaaccacagaggtgctagatacttttaagagtaaagagcagatgagtggtaaagcagaatcgcaggtaatgtactcacaagcacaaaatcctacctcaacagatcacaaagaaagcgagtcacatggaactttagttgcaagtagtggaaatgctccatcatacaaagatgttgccttagcacgccctggaacaattgccaagacccaaatacagaaacctagagatgatgtacctcagaaccaaccatcacttggtcagattattgcacaagaaatgaaagattctttggttgattcactccaagtggaacaaggacctgtctctgcaaatatcaataattccgaagaagaaatcaatgtgctaggagaagtccagaaattagaagaaacaaaattctctgaaggagaactggagattgagaatctgggcaaagacaggttacaagatttgccaataccaaaggctgaggaatctggcattggaagtgagcctgtaaatagtaaaaaagatgccaatgtgttaagtaacacaagtcaagaactatcaagtggtagcaatgatggtgcagccattgagttttctgagtccactggatctgtaaaaactgaacagactgagaagtctgatacggaattttttgaagctctaccccacagtatagaaaatattacagtttcagcatctacgacaaacacagggagtcttggaggtgatggaagtgagaagtccaagcctaacttagtgctaagtaatattgatttgagagagatgcctaataagaagctatctgcttctgcaccacctttcaatccatctccaccatctgtacttagccccctttctggcaatgttggtctcccgccaccaggtgccattccaggagtagcgccttggcctgtgaatgtctccctgcatcctgggcattcaactatggtgccaagtggtcctcctttgtgcacttcccctcatcatttgtaccctcctgctccccgatctcctaatctcatgcatcctgtgccgtttctttatccaccatatagtcaaccacaggtggttccaagcaccacatttcccatgaacactaatatttttcggcctaaccattatggatggcaaccttatatgggcccagcgccatcagaatttgtgccaatgtcatcatggtcaagtagccatacagttgacttcattcccacgccacatgttgttgaccctatttctcaatctttagcagataaacatattcaatctgatgcagctgttgttagtataggcccttcactggacagtaatgctgtagtggccaaggaagagatggagactcctgcagtggtagcaagtggcaatttgataagcaacaaacatgatgatcaagataaacaattaaaggatgccattagaattgaactgagtcctgacatgcaagaagacaacaggcatgatgaaggtagtttcaggatatatgtgaaggggaaaagccgtcggaaacaaactctgagaatcccaataagtttgcttaacaagacatatgggtcacgctcatttaagcttgtctacaacaaagtagtcagagaaaatgacatcttcaggccttcgagtgtgtcctttgctgaagttgtttcaactggcaactag

SEQ ID NO: 20489 - protein, 1999 aa, Sorghum bicolor
  misc_feature: Ceres ANNOT ID no. 8646351
  misc_feature: Down-regulated in shoot tissues in response to salicylic acid treatment
  misc_feature (1032)..(1065): Pfam ID: TPR_2 Pfam Description: Tetratricopeptide repeat
MEHTALLLLLLLLLFSLSELLVAIRHAHACLPFTNSCVSNEEQLRHNPNPNPSLFCSSQYLFLLSSGYLLLARSPLGACMAPKSKRGKGKGEKKKKDEKVLPIAIDISVNLPDQSHVILKGISTDRIIDVRRLLCVNTATCAITNYSLTHEMRDGALKDAADIATLKPCTLTLVEEEYSEESAVEHVRRLLDIVACTTSFGPAPPPPPPPSPKDADAAKESSSSSATSKAAASASSGGRRTASPPPSSPSSAAAKESSAAKEAAAKESAAAAELEAEMSGACPRLGAFYEFFSLANLTPPLQFVRRVLQPRQEEQPSDDHLFFLEAKLCSGKFIVIEARRKGFFSLGKQRVLCHNLVDLLRHLSRPFDNVYEDLMKAFLERNKFGNFPYGFRANTWLVPPIAAQSPSTFPPLPAEDETWGGSGGGWGRDGKSDMVPWADEFLYLTSMPCKTAEERELRDRRAFLLHSLFVDVAIFRAIAAVRHVMESTELSASTKIDEVLYSETVGNFSITVTRDSSDASCKLDTKIDGNRATGMDSKNLAERNLLKGITADENTAAHDVDSLGIINLRYCGYVAVAKVDNIDKTKVNSSIKPMNIADQPEGGAHALNINSLRMLLNEATSTGEKKISNLSQNHRQEELIAAQNFVEKLLKESLQKLEEEENVKQPFMRWELGACWVQHLQDQKNSDKDKKQGGEKDKKKTVEKSKEPKIEGLGKPLKALKNAKNVNSADLGSSLGPKSSAESQKDKPSDVELPQGETSASENENLLKDLLPESAFTRLKESETGLHQKSPPELIEMALKYYDEVALPKLVADFGSLELSPVDGRTLTDFMHTRGLQMRSLGRVVKLSEKLSHVQSLCVHEMIVRAFKHIVRSVIAAISDMRQLALTIAAALNLLLGVPESDFSGSSPNVHPLVWRWLVTFLKKRYEFELTEKHYHDVRKYAVLRGLCHKVGIELAPRDFIMDCSFPFHKQDIISLVPVHKQVACSSADGRQLLESSKTALDKGKLEDAVNYGTKALSKLITVCGPYHRMTAGAYSLLAVVLYHTGDFNQATIYQQKALDINERELGLDHPDTMKSYGDLAVFYYRLQHTELALKYVKRALYLLHLTCGPSHPNTAATYINVAMMEEGLGNVHVALRYLHKALKCNQKLLGPDHIQTAASYHAIAIALSLMEAYSLSVQHEQTTLQILRAKLGPDDLRTQDAAAWLEYFESKVIEQQEAARNGTRKPDASIASKGHLSVSDLLDYINPDQESKGRDSESGKRRYSSIKVLSHSNESSNGASPEISPRDSNPIIDEEQQVKEPSKDDSTEIISEAEVKQTPESFEHPAPSELQLEIAEVNINAPKEAIEVENSEPEDGWQPVQRPKSAGGPGKQMKHYRPTTRKVYEPDSHDPTYTSQYKARNSYSNNRYYFLRKRTVVPTTYTDPQQHVKVQTSGARFGRKIYKAVTYRVKPGTATTEVLDTFKSKEQMSGKAESQVMYSQAQNPTSTDHKESESHGTLVASSGNAPSYKDVALARPGTIAKTQIQKPRDDVPQNQPSLGQIIAQEMKDSLVDSLQVEQGPVSANINNSEEEINVLGEVQKLEETKFSEGELEIENLGKDRLQDLPIPKAEESGIGSEPVNSKKDANVLSNTSQELSSGSNDGAAIEFSESTGSVKTEQTEKSDTEFFEALPHSIENITVSASTTNTGSLGGDGSEKSKPNLVLSNIDLREMPNKKLSASAPPFNPSPPSVLSPLSGNVGLPPPGAIPGVAPWPVNVSLHPGHSTMVPSGPPLCTSPHHLYPPAPRSPNLMHPVPFLYPPYSQPQVVPSTTFPMNTNIFRPNHYGWQPYMGPAPSEFVPMSSWSSSHTVDFIPTPHVVDPISQSLADKHIQSDAAVVSIGPSLDSNAVVAKEEMETPAVVASGNLISNKHDDQDKQLKDAIRIELSPDMQEDNRHDEGSFRIYVKGKSRRKQTLRIPISLLNKTYGSRSFKLVYNKVVRENDIFRPSSVSFAEVVSTGN

SEQ ID NO: 20490 - DNA, 2154 bp, Sorghum bicolor
  misc_feature: Ceres ANNOT ID no. 8646891
  misc_feature: Down-regulated in shoot tissues in response to salicylic acid treatment
  misc_feature: Encodes the peptide sequence at SEQ ID NO 20491
atgtcgggccccacctcgcggctcctcctgctcgcccgccgcgccgaccgacgcagaggcctcccctttctcgttccccgcgccttgcaggctggccccgcgacctcgtccccggcgttgccgccacctccctgcttccccgcctcaacgccggtgatgagctactcaagtgcattcacaagtgtacatggagagaggccatcgtcagaatatgcaaagatcagaaagaagtcactggaaacccagtttggaagaatcttggggtcaagttcacgcaggatttttgctgatcgtggctttggtccattccttgctctgtacagggctgctactatctcttttcatgttgtaaaactcactatttggcatttgttgctcaatgacatgcataaaagagcagaaaagtttcgagagaccttgatacgcttgggtcctttttacatcaagcttggccaggcattgagcacacgccctgatatacttcctagtgcgtattgtcaggagcttgcaaagctacaggatcaaataccaccgtttccaactcgcattgcactaaggaccatagagtctcaattgggctctcgaatttctgatttgtttgctgatatcagcccagagccaattgcagcagcatcactggggcaagtttacaaagctcatctacactctggagagcttgttgcagtcaaagttcaaaggcctggaatggcgcccttgctgactctagatgcacttttgttccacatgattggaggacaaatgaaacgatttgctaaggctcgcaaagacctattggtggcagttaatgagattgtcaggcacatgtttgatgagattgattataatttagaaggaaaaaatgctgaaaggttcgctactctttattgtcagggttcaggtggggacaattctgaaggtagtacaagtatcaaggtcccaaaagtttactggaattatacatgtgaaaccatactgacactggaatggattgatggaattaagctaactgatgctgagcgcatcagcaaagccaatttgaacaggaaaggaatgatagatgagggtctctattgctcattgcgacagctgcttgaagaaggatttttccatgcagacccccatcctggtaatctagttgcaactgaaggtggatctctagcatattttgacttcggtatgatgggagatattccgaggcactatcgtgtggggcttatacaaatgcttgtacattatgttaatcgggactccttaggcttggcgaacgatttccattcactaggatttgttcctgagggaacagatttacttgcagttgcagatgcgttgcggttttcctttggtgatgtcaggaggcaatccaatgatttccagggtgtaatgaaccatttgtatgatgtgatgtatgaatttaatttctcccttccccctgattatgcgctggtgataagagcgcttggttctctagaagggacggcaaaagcactggatcctgagtttaaagttattgagagtgcatatccttttgtgattgggaggctccttgcagaccccagccctgatatgaggaaaatattaagggagcttcttatacgtgacgatggatccatcagatggaatcgactggaaaggctgattgcagctatatctgaacagtcatcagaatcttcaagcacagtgggagctgactctagtgagaatgccaatggaagtcctgagtggagatcatttgatatgcattctgtgattgcagctacagaagacctatttgatttcattttatcgaggaaaggatggcgggttcgggttttccttgtccaggatattgttaaagcttcagatgtgtttcttcaagaagcaacattcccgtatatatttgacaatgtgggaaagataggggacataaatccagagagaagtaagatgatcaggaggctggtgaatacagtgcaatcgttccgtcaagctatcagtttggctccagatgcttggagtgccatgctaatccgtactttgttgaagcacgaggcacaaaaatttgttcttgatgtgtttttgaccctggctagccattccagttacaagattccagaaacattctggctttgtatgtcaagatttctaaattacttggacaaacaagatacgttttag

SEQ ID NO: 20491 - protein, 717 aa, Sorghum bicolor
  misc_feature: Ceres ANNOT ID no. 8646891
  misc_feature: Down-regulated in shoot tissues in response to salicylic acid treatment
  misc_feature (190)..(316): Pfam ID: ABC1 Pfam Description: ABC1 family
MSGPTSRLLLLARRADRRRGLPFLVPRALQAGPATSSPALPPPPCFPASTPVMSYSSAFTSVHGERPSSEYAKIRKKSLETQFGRILGSSSRRIFADRGFGPFLALYRAATISFHVVKLTIWHLLLNDMHKRAEKFRETLIRLGPFYIKLGQALSTRPDILPSAYCQELAKLQDQIPPFPTRIALRTIESQLGSRISDLFADISPEPIAAASLGQVYKAHLHSGELVAVKVQRPGMAPLLTLDALLFHMIGGQMKRFAKARKDLLVAVNEIVRHMFDEIDYNLEGKNAERFATLYCQGSGGDNSEGSTSIKVPKVYWNYTCETILTLEWIDGIKLTDAERISKANLNRKGMIDEGLYCSLRQLLEEGFFHADPHPGNLVATEGGSLAYFDFGMMGDIPRHYRVGLIQMLVHYVNRDSLGLANDFHSLGFVPEGTDLLAVADALRFSFGDVRRQSNDFQGVMNHLYDVMYEFNFSLPPDYALVIRALGSLEGTAKALDPEFKVIESAYPFVIGRLLADPSPDMRKILRELLIRDDGSIRWNRLERLIAAISEQSSESSSTVGADSSENANGSPEWRSFDMHSVIAATEDLFDFILSRKGWRVRVFLVQDIVKASDVFLQEATFPYIFDNVGKIGDINPERSKMIRRLVNTVQSFRQAISLAPDAWSAMLIRTLLKHEAQKFVLDVFLTLASHSSYKIPETFWLCMSRFLNYLDKQDTF

SEQ ID NO: 20492 - DNA, 3123 bp, Sorghum bicolor
  misc_feature: Ceres ANNOT ID no. 8647392
  misc_feature: Down-regulated in shoot tissues in response to salicylic acid treatment
  misc_feature: Encodes the peptide sequence at SEQ ID NO 20493
atgcacaaagaaaactccccgtcatcttcactgtcgagctttttggccaaaccgccatgggcctcgttccctctgatacatggtagcagccacaccacaaacgtagttggtgtagtctcgcaagactacaagctagtcccattgagtacaatacggtgcgcacaagcacctattggcaagaggttgtcccaaaactttacttctctaacagggaaggcaaagaacaacccccgagcacaagctgtagccccattccatgccgccagccacctcgccgaggctgatgctgcggctttcgctgcttccgcatcggcgctgtccaaggccaccgcgtgcaaggcatcttgtgtcgccacccgcccccgaaggtcaccgagcccgactctcgcccgccgccatgaggaggagtgcctccgagcggatcttgcggccacccgttgtagaacgcacatggaactcctagctgcccttgtggatgctcgatggcagtcgacagatgctcatggacccaacaacagagctcgccctcatggtggattatggaaggctacgaggaccccgcacatcaaatttttatgcgcgcaccaggagcactacaaaagggcaggacgacagttgcatgagctgcaacgtagttggtggaggcgtagaaagatccagcctcagcggcggcatgcagccggaggcataataattatgagaagagcaagtatgaggatgagcaagcaagaaaggctgaaaaggaagcaagaggaggacaagtggaggttgaagatgatgtacgacttgcgatcattcttcggtgtgttcatcaatgtcgccctgcagttaggccaggtcgcggctgtgaccacctgcatgctcttatccttgaagcggctgaagaagcaagactacgtggaaccccagcagcttcatcaagacgaccaccgaaatatcagcctatccctcaacattttctacagtttggttgttgcccagggaatcatcttcatctgcatactgctcaacgtgttggtttttggttttaagatgcaggccctacagcaatacaggctatttgggccctcgggtcacagcatactcaaccgttacgtgaaggagaactatctggagttcatcagtgggaatatccgtgccaccctcaacacggacctggtcacctttgccaacaacctgtcactttctagctctgtggatgaccagttagttggcattcgggccatggatcgcatcctcagggcagtcaagtacagaagcctcacccttttgaggcttcgtgcttcccttgatgatgacactttgaagaagttggtcaataagctaggcttcatcaggaccacagaggagcaagctatcagaggccacgctgcaagagtagtgctgaaactcaccccagaccttctggttcaaaagttccctgaaatcttctatctcatattttcttccttgctcaccacatctaataagatggatcttgacctactctggttcggccttcgaatccttgacaagctcacagacaacccagaaaattgtaggcaaccaataaaagatgatgatggtgatatattactgaagattgtagacctcatcaccaaccattgtgatcatggaagcggcacgagcaatagaatttctaactcttggattgaacaagagattattcctatacttgagaaagaagatgactttcctcctcctttcatacagaagattgaccatgagattatccttggcatgtcactcagtatcttgagcaagctgctagccgcttcacttgttgctggtgctgcggtatttatgagggaaaagtcatcacaagattttcacttcctgacaaactctaggatgatcttgaatcattttgaagcaacaagagtgatatcatgcttagcagtagatgaggcagcaaggagagaaattggcaagttgcctaacgtcattgagaatctcaaggattgtctgctttccaaggctccatacctgaatttcagtaaagtggctgcaaagttattgctcctggagtacaccgctagcgaccacctggaccaacttaagttgttcattaatgaaaataatatcttgcaagatcaaagcttttcattaccagtgtctgccttcatacaagaacttcatatgcatgaacaaacaccaatgcaaagcgtggtagaagaccttgatctggaagatgtactttcagggccacgggtgaatcactctgaagaagctgctaaagcattaattctactcactacagagtgtgagaataatgttgaagctttcctacaagaaatcaagccacaagagttggagaagatagtgaaggtgctttcttctgaagaaggagagaaagataagagaaagatgatggcccactttgaaggacgtaatctagacaaggaaacattgtgcatcatcagacaaataatctgtgtagagggtgaagaacacaaaagaagtatgcatgcgaaactcttgcagaatttgcgtgcctattcaggaacaatagattttaataagcacatgcaagtaattgaccaagctctgccaatggttttcaaagcaatctcagatggagtgttaagattggaggatcaatcatctactaataaaaatcattcccatgaaaatagcgtgtggattaaagaaggcaaagtaatagagagctttatcggactggcggtgcagatttgtaggtcccagaatgcaattgattttgccaaaacactaggctatgccaatgttgctgctgacacattggtcaagcgactgaaaaaaatattggaattgtacaactgtccaactatcgattttccatgcataaggagatccacaattgaactactgacttggatagtagaacacaacaataacaacatagaaatactcctgcagtgtggtgtgtatgagcaactgaatgaagtggctaagactgccagaaaacttgagagcttcaagctgtttcacagtggtgtcggagttcctactaagcctggtatctcatgcatctcttccctttcaactgaattacagcaacaacttcaatgcagccctaatttcaatgaaagatcctgctgctatagagaacgttcaagcaccatatctgttttaattgattaa

SEQ ID NO: 20493 - protein, 1040 aa, Sorghum bicolor
  misc_feature: Ceres ANNOT ID no. 8647392
  misc_feature: Down-regulated in shoot tissues in response to salicylic acid treatment
MHKENSPSSSLSSFLAKPPWASFPLIHGSSHTTNVVGVVSQDYKLVPLSTIRCAQAPIGKRLSQNFTSLTGKAKNNPRAQAVAPFHAASHLAEADAAAFAASASALSKATACKASCVATRPRRSPSPTLARRHEEECLRADLAATRCRTHMELLAALVDARWQSTDAHGPNNRARPHGGLWKATRTPHIKFLCAHQEHYKRAGRQLHELQRSWWRRRKIQPQRRHAAGGIIIMRRASMRMSKQERLKRKQEEDKWRLKMMYDLRSFFGVFINVALQLGQVAAVTTCMLLSLKRLKKQDYVEPQQLHQDDHRNISLSLNIFYSLVVAQGIIFICILLNVLVFGFKMQALQQYRLFGPSGHSILNRYVKENYLEFISGNIRATLNTDLVTFANNLSLSSSVDDQLVGIRAMDRILRAVKYRSLTLLRLRASLDDDTLKKLVNKLGFIRTTEEQAIRGHAARVVLKLTPDLLVQKFPEIFYLIFSSLLTTSNKMDLDLLWFGLRILDKLTDNPENCRQPIKDDDGDILLKIVDLITNHCDHGSGTSNRISNSWIEQEIIPILEKEDDFPPPFIQKIDHEIILGMSLSILSKLLAASLVAGAAVFMREKSSQDFHFLTNSRMILNHFEATRVISCLAVDEAARREIGKLPNVIENLKDCLLSKAPYLNFSKVAAKLLLLEYTASDHLDQLKLFINENNILQDQSFSLPVSAFIQELHMHEQTPMQSVVEDLDLEDVLSGPRVNHSEEAAKALILLTTECENNVEAFLQEIKPQELEKIVKVLSSEEGEKDKRKMMAHFEGRNLDKETLCIIRQIICVEGEEHKRSMHAKLLQNLRAYSGTIDFNKHMQVIDQALPMVFKAISDGVLRLEDQSSTNKNHSHENSVWIKEGKVIESFIGLAVQICRSQNAIDFAKTLGYANVAADTLVKRLKKILELYNCPTIDFPCIRRSTIELLTWIVEHNNNNIEILLQCGVYEQLNEVAKTARKLESFKLFHSGVGVPTKPGISCISSLSTELQQQLQCSPNFNERSCCYRERSSTISVLID

SEQ ID NO: 20494 - DNA, 1188 bp, Sorghum bicolor
  misc_feature: Ceres ANNOT ID no. 8647453
  misc_feature: Up-regulated in root tissues in response to methyl jasmonate treatment
  misc_feature: Up-regulated in shoot tissues in response to methyl jasmonate treatment
  misc_feature: Encodes the peptide sequence at SEQ ID NO 20495
atgcagcaggcggggccggccgacgacgacgaggacgaggagatgggggtcaaggaggaggaggaagacggcgacgaggaggaggaggacgacgacgggtactacatggacccccggagcccggccgccgccaccgtcgtgtcgacgcccggcggcggcggcggcagggccggagggaccccgaaccggcggcgcgcgcgcgaggagaaggagcggaccaagatgcgggagcggcagcggcgcgcgatcacggggcggatcctggcgggcctgcgccagcacggcaactacagcctgcgggcgcgcgccgacatcaacgaggtgatcgccgcgctcgccagggaggccggatgggtcgtcctccccgacggcaccaccttcccctcttcgtcctcctcctccgccgccgtggctgcacagccggcccgtcccgtgatggtcgccgccgcgccgccctccgccaccccgctcgcgatcccggcctccgcggcgttccccctccgcggcatcgcgcccgtcgccgcgcgccccatctcccaccgccccgcgcccgcgtccgccctcctcgtctcgcccccgcgcgccaccgcggcttcgcgacccccggctgacgacgtccccgacgggaactcctcgcacctcctcgccgtccccgtccccatggaccccgccgccgaagacggccccgtcgccaagcaggtgcccgatgtggcgccgcgcccgccggagcgggacttcgccggcacgccctacgtgccggtctacgtcatgctcccgcttggggtggtgaatggcaacggcgaggtggtggacgcggacgagttggtgggccagctgcgggtgctcaaggcagcgggagtggatggggtcatggtcgattgctggtgggggaacgtcgaggcgcacaggccgcaggagtacaattggactggctacaggcgcctctttcagatgatcagggaactcaagctcaagttgcaggtcgtcatgtcgtttcatgaatgtggtggcaatgttggagatgatatatccattcctctcccacattgggtaatagagattggaaggagcaatccggatatctactttactgacagggcaggaagacgtaatacagagtgcttatcgtggggaattgataaagaaagggttctgcaaggcagaacagcagtggaggagaaagggtaa

SEQ ID NO: 20495 - protein, 395 aa, Sorghum bicolor
  misc_feature: Ceres ANNOT ID no. 8647453
  misc_feature: Up-regulated in root tissues in response to methyl jasmonate treatment
  misc_feature: Up-regulated in shoot tissues in response to methyl jasmonate treatment
  misc_feature (251)..(392): SWISSPROT Homolog: EC 3.2.1.2 Beta-amylase
  misc_feature (255)..(395): Pfam ID: Glyco_hydro_14 Pfam Description: Glycosyl hydrolase family 14
MQQAGPADDDEDEEMGVKEEEEDGDEEEEDDDGYYMDPRSPAAATVVSTPGGGGGRAGGTPNRRRAREEKERTKMRERQRRAITGRILAGLRQHGNYSLRARADINEVIAALAREAGWVVLPDGTTFPSSSSSSAAVAAQPARPVMVAAAPPSATPLAIPASAAFPLRGIAPVAARPISHRPAPASALLVSPPRATAASRPPADDVPDGNSSHLLAVPVPMDPAAEDGPVAKQVPDVAPRPPERDFAGTPYVPVYVMLPLGVVNGNGEVVDADELVGQLRVLKAAGVDGVMVDCWWGNVEAHRPQEYNWTGYRRLFQMIRELKLKLQVVMSFHECGGNVGDDISIPLPHWVIEIGRSNPDIYFTDRAGRRNTECLSWGIDKERVLQGRTAVEEKG

SEQ ID NO: 20496 - DNA, 1149 bp, Sorghum bicolor
  misc_feature: Ceres ANNOT ID no. 8647452
  misc_feature: Down-regulated in shoot tissues in response to methyl jasmonate treatment
  misc_feature: Encodes the peptide sequence at SEQ ID NO 20497
atggttgtcgatacggtcagcgcgagcacctccataattgccccccacctgttcgaccacaggtccaggggcgccggcgcctcccaccaccaccacctccgccatgtcgtcgcctgccgccccctgcccaccgccttcgccggccgccgcctcgtgtcccgggtcaacaagcagccgtcgccgcgcctcgccgattggccggtcagggcgctggctatgggtatcacaaaggaggccagccctcgcagggagtaccgggggatccccggggacggtggcgacatgggggatgttggggtcaccagccccaagccgtcgtggcctccgcagaacagggcagatgaccccaagctgcacaatccgctgctccgcctcgagcgcatgggctgcgggtggctcggcgtcatcttcgagtgggagggggtcattgttgaggatgatgccgaattggagaggcaggcatggttgaccctggcacaggaggagggcaagtcgccgcctcccgcttttgtgttgcggagagtcgaagggatgaagaatgagcaggcgatttctgaggttctctgctggtctcgggacccctcggagcttaggagattggcctcgaggaaggaggagattcacaacagcctccgaggcggctcctaccaccagatgaggaacggttcccgggagttcatgagcacgctcgccaattacaagatccccattgctgtggccaccacacgcccacggaaggttattgaggaagccattgaagctgttggtgtgcgcagcttctttgatgcggttgtggcagcagaagacgtgtaccggggcaagcctgacccagaaatgtttctgtacgctgctcagctcctcagtttcatccccgagaggtgcatcgtgtttgggaactccaattcggcggtggaagcagcacacgatgcccgtatgaagtgtgtcgcggtcgcaagcaagcacaaaatctacgagcttagtgccgcagaccttgtggtgaaacaattagacgagctatctgtcgttgacttgaagaacctcgctgatatagagtccccggagtttggcatggaacctgaaccagagatggaggaggaggaagtgcccccaccatcgacgtctgtgggtgtagatgatttattctggtaa

SEQ ID NO: 20497 - protein, 382 aa, Sorghum bicolor
  misc_feature: Ceres ANNOT ID no. 8647452
  misc_feature: Down-regulated in shoot tissues in response to methyl jasmonate treatment
  misc_feature (135)..(310): SWISSPROT Homolog: EC 5.4.2.6 Beta-phosphoglucomutase
  misc_feature (132)..(320): Pfam ID: Hydrolase Pfam Description: haloacid dehalogenase-like hydrolase
MVVDTVSASTSIIAPHLFDHRSRGAGASHHHHLRHVVACRPLPTAFAGRRLVSRVNKQPSPRLADWPVRALAMGITKEASPRREYRGIPGDGGDMGDVGVTSPKPSWPPQNRADDPKLHNPLLRLERMGCGWLGVIFEWEGVIVEDDAELERQAWLTLAQEEGKSPPPAFVLRRVEGMKNEQAISEVLCWSRDPSELRRLASRKEEIHNSLRGGSYHQMRNGSREFMSTLANYKIPIAVATTRPRKVIEEAIEAVGVRSFFDAVVAAEDVYRGKPDPEMFLYAAQLLSFIPERCIVFGNSNSAVEAAHDARMKCVAVASKHKIYELSAADLVVKQLDELSVVDLKNLADIESPEFGMEPEPEMEEEEVPPPSTSVGVDDLFW

SEQ ID NO: 20498 - DNA, 1866 bp, Sorghum bicolor
  misc_feature: Ceres ANNOT ID no. 8647822
  misc_feature: Up-regulated in root tissues in response to salicylic acid treatment
  misc_feature: Encodes the peptide sequence at SEQ ID NO 20499
atggagggcctgatcgggttgatgaaccgcatccagcgcgcctgcaccgccctcggagaccacggaggaggaagcgacttgcccaccctctgggagtctctcccaaccatcgccgtcgttggaggccagagttcgggcaaatcctctgtacttgagagcattgttggcaccgactttcttccccgtggatcgggaatcgtcacgcgaaggcctttggtgctacagctgcaacagacagacaatggatctcaggaatacgcagagttcttacataagccaaaaacaaggttttcagactttgcccttgttcgccaagaaattgctgatgagacggatagactgactggaaaaactaagcaaatatctcctgtccctattcatctcagcatctactcgcccaaggttgtgaacttaaccttgattgatcttccagggttgacaaaagttgctgtagagggacagtctgaaaatattgtgcaagatatagagaatatggttcgctcatatgttgataagcccaactgtattattttggctatatctccagcaaatcaggatattgcaacttctgatgcaattaagctctcaaaagaagttgatccaacaggtgaaaggacgtttggcgtgttgacaaagctggacctaatggataaaggaacaaatgctctcgatgttcttgagggaagagcctatcggctgcagaatccttgggttggaatcgtcaaccgctcgcaagcagatattaataggaaggttggcatgctttcagcgagggaaaaagaaagggaatattttgaaaccagtcctgactatgctcatttagcaagtcggatgggttccgagtatcttgctaagcttctttctcagcatcttgaatctgttatcaaagcacgcattcctagtatcacagcgacaatcaacaaaactatagatgaacttgaatcagagctggacatcattgggagaggtgtggcttctgatccaggggctcaactgtacaccatattggacctctgccgtgcttttgaccgtgttttcaaggaacatcttgatggagggaggtcaggtggagatagaatatatggcgtgtttgatcataagcttcctgctgcttttaagaagcttccctttgaccgctatctgtctgtgcaaaacgtgaagaaggtggtttcagaagcagatggctatcagccccatcttatcgctcccgaacaaggataccgtcggcttattgaaaaaggcattacctatttcagaggaccagctgaagccacggttgatgcggtccacgttgttctaaaagacttggtcaggaaatccattggggagacagagcaactgagaagattcccaactcttcaagctgcgattgcgaccgccgcgaatgaagccctggaacgattccgggaggatgggcgcagcacagcacttcgtctagtggacatggaggctgcatacgtgacggtggaattcttccggaagctccctcaggatcctgctgatcctagtagtaaggtcggacctaataaacctccagtggagccgtcgccgacgccggaccgctatggtgatgggcacttcaggaatattgcctccaacgtgtcccagtacattcggatggttggagacgaactcttgcagaagatccccaaggcagctgtccactgccaagttcgcgaggcgaagaggtctctgctcaaccatttctacgtgcagatcgggaagaaagagggtggggagtttgggcatatgctggatgaggacccggcgatgatggagcgccggcagcaatgcttgaagaggctggagctgtacaaatctgcgagggatgaggtcgattctgtggcatggagcagcagcagataa

SEQ ID NO: 20499 - protein, 621 aa, Sorghum bicolor
  misc_feature: Ceres ANNOT ID no. 8647822
  misc_feature: Up-regulated in root tissues in response to salicylic acid treatment
  misc_feature (1)..(487): SWISSPROT Homolog: EC 3.6.5.5 Dynamin GTPase
  misc_feature (37)..(213): Pfam ID: Dynamin_N Pfam Description: Dynamin family
  misc_feature (222)..(508): Pfam ID: Dynamin_M Pfam Description: Dynamin central region
  misc_feature (522)..(615): Pfam ID: GED Pfam Description: Dynamin GTPase effector domain
MEGLIGLMNRIQRACTALGDHGGGSDLPTLWESLPTIAVVGGQSSGKSSVLESIVGTDFLPRGSGIVTRRPLVLQLQQTDNGSQEYAEFLHKPKTRFSDFALVRQEIADETDRLTGKTKQISPVPIHLSIYSPKVVNLTLIDLPGLTKVAVEGQSENIVQDIENMVRSYVDKPNCIILAISPANQDIATSDAIKLSKEVDPTGERTFGVLTKLDLMDKGTNALDVLEGRAYRLQNPWVGIVNRSQADINRKVGMLSAREKEREYFETSPDYAHLASRMGSEYLAKLLSQHLESVIKARIPSITATINKTIDELESELDIIGRGVASDPGAQLYTILDLCRAFDRVFKEHLDGGRSGGDRIYGVFDHKLPAAFKKLPFDRYLSVQNVKKVVSEADGYQPHLIAPEQGYRRLIEKGITYFRGPAEATVDAVHVVLKDLVRKSIGETEQLRRFPTLQAAIATAANEALERFREDGRSTALRLVDMEAAYVTVEFFRKLPQDPADPSSKVGPNKPPVEPSPTPDRYGDGHFRNIASNVSQYIRMVGDELLQKIPKAAVHCQVREAKRSLLNHFYVQIGKKEGGEFGHMLDEDPAMMERRQQCLKRLELYKSARDEVDSVAWSSSR

SEQ ID NO: 20500 - DNA, 3252 bp, Sorghum bicolor
  misc_feature: Ceres ANNOT ID no. 8647998
  misc_feature: Up-regulated in shoot tissues in response to methyl jasmonate treatment
  misc_feature: Up-regulated in root tissues in response to methyl jasmonate treatment
  misc_feature: Encodes the peptide sequence at SEQ ID NO 20501
atgccggccaagtacctgggcttgggggcgttcgcggaggacaggcgcccggacctccaccgccaggtgggctgcgtcactgggatcttgcaggccttcgaccgccgccaccctctcgcctcttcccacaagaggctccttcctcccccaacagcaacaggccatgcactatccagcagcccaagcaaagggggagagtgcacaagatattcaccccagattgttctggagaagaactcgagtaaaacatgggctgacagccaaagagcaccagcaacagaactgtctcaaacctcatattcgtcatcaccctcttcgtcattctcgtcacttgatggcaacaggtcaacacaacaagacctatcatccactgaccgaatgctatttccagagaggccgttcaagagctcgccgaagctcaaaagttcttttgacagtgacaatggactagactatcctgatgatgcgcctaccaagtccaagaacatgcccatagttcaatccagcctgccaactcttggtataagaaatcttgtgaaggattcaatctataaggatagccgtgaattgtcagtgagaatttgcactgaagaagaagtaaaagatcacccatccaactgtggagatcaacctaggcaattgaatgggcctccccatgacagtacacaaggaaaaagcaagggtctcgtggatatcaacgaatcgcttcgagtgctagctaagctcagggaagcttcatggactcctcccgaatctgcccatcatgcaagactttcatatgatgctcctcggttctcatacgatgggaaggaagcagcatcaaaactgagggaggtaccaaggttgtcactggacatcaaggaaggtcacctttggaatcgtgaaattgactctagatcaaacccacgttctgcagatagaagcagcaacactgttactgggtccaatgcagctatcgagacccaacaggaacagcctgcctgcaagcggcttcctagcgttgttgcaaagcttatgggtttggaagagttgcctgagcataatcaaagtacagcatcatcacatgcatggaaaaccgttcaagagagcaagcaagatgcaatgtttaacccctcgagcatctcatcccacgatgagcatgctcttcgacaacaaagaaatcatgattcaactgcaagaaatttacccaactcaaagtttcctgttgaaactgcaccatggaagcaacaagaaaggattgtccttcctcgaagactgccaaagggatcaaaaggagcccatgcaagagaacaacctgctgcatcagtcttcagtgacatagagaagcggctcaaggatcttgattttcaacaatcgaacaaggaccttagagcgcttaaacagattttggattccatgcaagcaaaaggactattggaaaacaagaaacgggaagaagcatctatgccaaagttatatgatggaaaccatgatggccaagaggtagccggtgtgaacatgagactgaacactaacaccaacaacatgtggatgcctgaagagaacaacgcggaaagctctttcaaatcgcctattgtgatcatgaaaccttcaaaatctgcaaaccttttcagcgaagtggattcttctgtcttcccattagggggtccatctgatcccacacagctgcaaacaagcaatagcactgatagaaggaaagcttcaatgatcaatagaacagctaaagagcaacatgcgaaatttagtcaaaaggtgcctacttctcaaccccttgtttcttatgacaggagatcatatggaaggaatgacgatagcagcaacaaccaaaaatctagttcactgctggttactgagagctcatccagaagacagcagctgccaagagacggtagcataagtatgcaaaagaataaaaattccactagcccaaggttactacagcgaaaacttgattcagagcggagggctagaccacctattccttccgctgagtataacaaaatccaaaggcaatctggagataggaataattcagaaacagtgtcaccccgaagcaaattcagaaggaaacttgtgcgtccacaagaaggtgatgatggcatgcccaatggattgaacaacaggacaaggagcctgaatcagcatggcaatgatatgtccacaaagtcaaatggcaatataagtgttgcttcagagctggatattataagcaatgacagatctgcagaagttaatgtttctaactttgagcaaggcattggaactccatctggaaggaacccacaaaaagtgaaaatctcatatgatgcaagcaaggacgtgccatctgtagaccctttggctgctatttcggaacgacccagtccagtttctgtgttggactcttcatttgatcaggaggatttattccctaccagcaggactccaaattcacttgctgttgatgatgagcgccaaacattagaggcaccctggaaaccttctgatagaaagccaacagaggtcgctatgcagtccaagaacaataaacttgctaatgttgcgagcttgcttgagaagctccagcagcttagcgtgaacaaggatgaggatgcacctccggttgaccatattgctttcttgtgtgagacagaaagcccagaccaccgctatgtgtctgagatactgctggcctcgggtcttctgatgaaagacctaggttcaggacaggcaggtctccagctccactcttctggttacccaatcaacccggacttgttccacgtgttggagcaaagaaaggcaggatgggccagtatacctgatagcatccatcagagcagaagcggcgcaaaatctgatcccaagagagcgcaccggaagctgttgtttgacactgtgaatgagcttctgcttcagaagtttgagaaggaaactgcagtttattcggtcagttcctacaccagagcgaaggatccaccgtctaagactcctagcgggcagcaactgctgaagctcatatcttcaggaatcgaagacctggacatggagcgatcatctatctggcagaaggaaggcagcgtgatacctgatgcagagatcctgcagaggctgcagggatggtcgagcttcagcaaggagttcccagggatggtgctggagatcgaaaggtcgatattcaaggagctggtggacgaggtggtgcatggggagtctgctgacggcccggagatgaaggtggcaggcaggcggagaaggcggctctttgcttga

SEQ ID NO: 20501 - protein, 1083 aa, Sorghum bicolor
  misc_feature: Ceres ANNOT ID no. 8647998
  misc_feature: Up-regulated in shoot tissues in response to methyl jasmonate treatment
  misc_feature: Up-regulated in root tissues in response to methyl jasmonate treatment
MPAKYLGLGAFAEDRRPDLHRQVGCVTGILQAFDRRHPLASSHKRLLPPPTATGHALSSSPSKGGECTRYSPQIVLEKNSSKTWADSQRAPATELSQTSYSSSPSSSFSSLDGNRSTQQDLSSTDRMLFPERPFKSSPKLKSSFDSDNGLDYPDDAPTKSKNMPIVQSSLPTLGIRNLVKDSIYKDSRELSVRICTEEEVKDHPSNCGDQPRQLNGPPHDSTQGKSKGLVDINESLRVLAKLREASWTPPESAHHARLSYDAPRFSYDGKEAASKLREVPRLSLDIKEGHLWNREIDSRSNPRSADRSSNTVTGSNAAIETQQEQPACKRLPSVVAKLMGLEELPEHNQSTASSHAWKTVQESKQDAMFNPSSISSHDEHALRQQRNHDSTARNLPNSKFPVETAPWKQQERIVLPRRLPKGSKGAHAREQPAASVFSDIEKRLKDLDFQQSNKDLRALKQILDSMQAKGLLENKKREEASMPKLYDGNHDGQEVAGVNMRLNTNTNNMWMPEENNAESSFKSPIVIMKPSKSANLFSEVDSSVFPLGGPSDPTQLQTSNSTDRRKASMINRTAKEQHAKFSQKVPTSQPLVSYDRRSYGRNDDSSNNQKSSSLLVTESSSRRQQLPRDGSISMQKNKNSTSPRLLQRKLDSERRARPPIPSAEYNKIQRQSGDRNNSETVSPRSKFRRKLVRPQEGDDGMPNGLNNRTRSLNQHGNDMSTKSNGNISVASELDIISNDRSAEVNVSNFEQGIGTPSGRNPQKVKISYDASKDVPSVDPLAAISERPSPVSVLDSSFDQEDLFPTSRTPNSLAVDDERQTLEAPWKPSDRKPTEVAMQSKNNKLANVASLLEKLQQLSVNKDEDAPPVDHIAFLCETESPDHRYVSEILLASGLLMKDLGSGQAGLQLHSSGYPINPDLFHVLEQRKAGWASIPDSIHQSRSGAKSDPKRAHRKLLFDTVNELLLQKFEKETAVYSVSSYTRAKDPPSKTPSGQQLLKLISSGIEDLDMERSSIWQKEGSVIPDAEILQRLQGWSSFSKEFPGMVLEIERSIFKELVDEVVHGESADGPEMKVAGRRRRRLFA

SEQ ID NO: 20502 - DNA, 2928 bp, Sorghum bicolor
  misc_feature: Ceres ANNOT ID no. 8649174
  misc_feature: Up-regulated in shoot tissues in response to salicylic acid treatment
  misc_feature: Encodes the peptide sequence at SEQ ID NO 20503
atggatagtgctagcgtagccccatcctcggtacgggaccttgccgagcgtctccttattaggaataatgaactcgaagatcagctccgcaagtccgcacaatccaaagtcccatcagatcccaacatatggcttcagatgcgtgacaactttgagaagataattctcttagatcatgacctctctgaacagaaagaggtagaatatctcctgtggcagttgcactacaaaagaattgaagacttcaggaggaacattagtgctgcaagctcagttgcatctagtgggaagagcaatgctaacccagatcgagtcaagagaatcaaatcagccttcaaaagcttcctttcagaagcaactggcttctatcatgacttgatgttaaagatcaaatcaaattggggccttccactcagttactttccagagggccttgacaatgcgaacaactctgtgcgagatgacaagaaaacagttcagttgaagaaaggtttgatttcatgccatcggtgtctgatatatttgggagatcttgctcgttacaagagcttgcatggtgatggtgattcggctagtcgtgaatatgcagctgcttctagttactacaaagaggcagcttctatctatccttccagtggcaaccctcatcatcagcttgctatactagcttcttactcaggcaacgaggtggtagctgtttataggtacttccgaagcttagctgcagatactccttttaccactgcacgggacaacttgattattctttttgagaagaatcgccaaatatatggacagctcccagacagcaacaaagttcccagtgctaagacattactcccacgtccatctgggaggggccgaggacggggagaagtaaggtttcagccaaaagatgttaatgctgaaacagctgaaagggaacgggagtgcaatattcgtgatacattgaaggccttctatatacgatttgtcaggctcaatggaattcttttcacgaggaccagtttggaaacatttggggagctgttttcttcagttagcaatgatttgcagattctcctttcttctggtcttgaggacgagcttaattttggttgtgatgctgcagaaaatgcattagctgctgttaggcttactgtcatccttatattcacagtacacaatgtaaagaaggaacctgatagccagtcgtatgctgaaattgtgcaacacagagtactgctccaaagtgcgtttacggctgcttttgattttgttggacgaattctcagaaggtgttcagagctccgtgatatcacatcaagcttctatctgccagccattctggtgtacattgaatggctggcatcccatccggagttggctgttgattcagagatggaggaaaagcatgcaaatgccagatctttcttctggaaccaatgtatctcatttatgaataagctgatccttaccaaccttgcatctatggacgatgatgatgatgaggcttgcttttctaatatgagcatttatgaggaaggtgaaactggtaacaggcttgccctttgggaagatctcgaattgagaggttttttgcccttagttcctgcacataccattttggatttctcaagcaaacacacttttgaaaatgttggaagcaccaaggagaagaaagcacgggttcaacgaatttttgctgcagggaagtcactgctgaactttgttcagatcgatcagttgaggatatattttgatccatcttccaagaaatttgtcatggccaagaaccctcctgtgtctaaggctaacaaccctcttaatgagtctcctgatgcacttaaaacaaatggcgctgacatggatcatgaggctgctagaacatttgactcagtttcctctaatatgggcacactgcagtctaatgtgcagtttggtcctgatagtgacgatgatgaagaaattgttttcaagcctatagcttctgaaaagtttctgaaagctccttcagacctgttggttaatggatatacctatcctctaccaatgtctgctgctggctggccaaccaatgctagtttagtgtctgttcagagcactgcatcaatgtctctgactggttggccacccaatggtgggtcacattcttttctaagtactgcatctctgtcagctgctggtaattacaacattaaccagtcgcttcccagctcttctgttggttgggctgtcaatggtgagcaaaatgttattcctagcattgctccaagatttgaactcatgcagcctgttgaggagcctgcttccagctggacaagcagtggtgctggattgagtggtgtacagtctattgggtattcgtctactgagcctgctggtaccactaaaaactcgatgcataatcatgtgaacattactggagagactgtcccctctacacttgattcagttgtaccttcaatagcaccatcaggtggcatgccaatgaaattcacagaagcaccactaactgcttcaaagaagaaccctgttagtcgtccatcaaagcctgttgggccgcctccaggatttaatcatgtaaccccgaagcgtcaagatgattctattctggttgaaaaactacagagcccacaggtcgatgattacagctggctagatggctatcagccatcgattgatgatgttaacaatttaagagctgtttatcctggtgtcagtgatactatcacttcatttgccactccattccccttccctgggaaacaacagatctctgagatacatgcacaaggggccaatgagaagacatggcaagatttccacctttttgagccttcaaagcagaatatgttccaaaattaccaccaaagaaatcagcaaagtggtcaaatagctgaacaagagccagcaaattctatctggtctagcagttaccatgtgtga

SEQ ID NO: 20503 - protein, 975 aa, Sorghum bicolor
  misc_feature: Ceres ANNOT ID no. 8649174
  misc_feature: Up-regulated in shoot tissues in response to salicylic acid treatment
MDSASVAPSSVRDLAERLLIRNNELEDQLRKSAQSKVPSDPNIWLQMRDNFEKIILLDHDLSEQKEVEYLLWQLHYKRIEDFRRNISAASSVASSGKSNANPDRVKRIKSAFKSFLSEATGFYHDLMLKIKSNWGLPLSYFPEGLDNANNSVRDDKKTVQLKKGLISCHRCLIYLGDLARYKSLHGDGDSASREYAAASSYYKEAASIYPSSGNPHHQLAILASYSGNEVVAVYRYFRSLAADTPFTTARDNLIILFEKNRQIYGQLPDSNKVPSAKTLLPRPSGRGRGRGEVRFQPKDVNAETAERERECNIRDTLKAFYIRFVRLNGILFTRTSLETFGELFSSVSNDLQILLSSGLEDELNFGCDAAENALAAVRLTVILIFTVHNVKKEPDSQSYAEIVQHRVLLQSAFTAAFDFVGRILRRCSELRDITSSFYLPAILVYIEWLASHPELAVDSEMEEKHANARSFFWNQCISFMNKLILTNLASMDDDDDEACFSNMSIYEEGETGNRLALWEDLELRGFLPLVPAHTILDFSSKHTFENVGSTKEKKARVQRIFAAGKSLLNFVQIDQLRIYFDPSSKKFVMAKNPPVSKANNPLNESPDALKTNGADMDHEAARTFDSVSSNMGTLQSNVQFGPDSDDDEEIVFKPIASEKFLKAPSDLLVNGYTYPLPMSAAGWPTNASLVSVQSTASMSLTGWPPNGGSHSFLSTASLSAAGNYNINQSLPSSSVGWAVNGEQNVIPSIAPRFELMQPVEEPASSWTSSGAGLSGVQSIGYSSTEPAGTTKNSMHNHVNITGETVPSTLDSVVPSIAPSGGMPMKFTEAPLTASKKNPVSRPSKPVGPPPGFNHVTPKRQDDSILVEKLQSPQVDDYSWLDGYQPSIDDVNNLRAVYPGVSDTITSFATPFPFPGKQQISEIHAQGANEKTWQDFHLFEPSKQNMFQNYHQRNQQSGQIAEQEPANSIWSSSYHV

SEQ ID NO: 20504 - DNA, 1971 bp, Sorghum bicolor
  misc_feature: Ceres ANNOT ID no. 8651126
  misc_feature: Down-regulated in shoot tissues in response to salicylic acid treatment
  misc_feature: Encodes the peptide sequence at SEQ ID NO 20505
atggcggcgcaagggcaggcggcggctggatccgcgtccgagtccggcggctcaccggctgcctcagctgcggcggcggccgcgttcccggcgacttcgctctacgtgggtgacctgcacgagagcgtgcaggacgcgcagctcttcgacgtcttcagccaggtcggcggcgttgtctccgtgcgcgtctgcagggacatcaactcccgcaagtcgctagggtacgcctacgtcaactacaacaatcccggcgacgctgcacgggcacttgaactgcttaacttcactcctatcaatggaaagcctatcaggatcatgtattctaaccgtgaccccagttcgcgtaaaagtggtgcaggaaatatatttattaagaatcttgataagtcaatagacaacaaagctttatatgacacgttctgtgcatttgggaatatcctttcatgtaaaattgcaacagacccctcaggagaatcaaggggctatggtttcgttcagtttgagagggatgaatctgctcagtctgctattgataaactcaatgggatgcttatcaatgacaagaaagtgtatgttggaccttttgttcgcaagcaggacagggagaatgtttcgagcaatttcaaattcagtaatgtatatgtgaagaatctgttagatactgttactgatgatgagttgaaggagatgtttggaaaatatgggtccatcactagtgctgttgttatgcgggatagtgatgggaaatccaggtgttttggatttgtcaattttgaaaatgctgatgatgctgctcaggctgttcaagagttgaatggcaagatattcaatgataaggaactgtatgttggaagagcacagaagaagtctgaaagagagatggagttgaaggagaaattcgaaaagaatattcaagaggtagctgagaagttccagaacactaacttgtatctgaagaacttagaagataacattgatgatgagaagttgcgtgaactctttgctgagtatggcaatattacttcttgcaaggttatgcgggattcgaatggtgtcagcagaggatctggatttgttgctttcaaatctgctgaagatgctaaccgagctcttacagagatgaatggcaaaatggttgggagcaagcccctttatgtagctcttgcgcagcgtaaagaagacagaaaggcaaagctacaggcacagttttcacaaatgcgtccagttgcgatggcgccttcagttggtcctcgcttgcccatgtttccacctggtgtccctggagttggtcaacagctgttttatggtcagccacctccagccttcataaaccctcaggctggatttgccttccagcaacctctgatgcctggtatgaggccgggtggtccaatgccgaactttatgatgcctatggttcagcagggacagcaaccacagcgtcctgctggtaggcgcgctggtgctagtggaatgcagcagcccatgccaatggctggtcagcaacagatgttccctagaggtggacgtgggtaccgctatcctactggccgtggaatgcctgatcctggcatgcatagtgttggtgctgtgatgccatctccatatgagatgggaggggtgccaatgagagatgctggtctctcgcagccgcagcctgttccaatcggggcactagccactgcgcttgctaatgccccaccagatcagcaaagactgatgcttggtgagaacctgtatcctcttgtagaacagctagagcgtgagcaggctgctaaggtcaccggcatgcttttggagatggaccaaacggaggttcttcacctgctggagtcaccagatgctctcaaggccaaggttgctgaagctatggaggtcctccgctctgcccagcatctccagcagagcaatgcctcccccgagcagcagctggctaatctatcactgaatgatggtgttgtttccagctga

SEQ ID NO: 20505 - protein, 656 aa, Sorghum bicolor
  misc_feature: Ceres ANNOT ID no. 8651126
  misc_feature: Down-regulated in shoot tissues in response to salicylic acid treatment
  misc_feature (213)..(338): SWISSPROT Homolog: EC 5.2.1.8 Peptidylprolyl isomerase
  misc_feature (213)..(283): Pfam ID: RRM_1 Pfam Description: RNA recognition motif. (a.k.a. RRM, RBD, or RNP domain)
  misc_feature (316)..(386): Pfam ID: RRM_1 Pfam Description: RNA recognition motif. (a.k.a. RRM, RBD, or RNP domain)
  misc_feature (122)..(192): Pfam ID: RRM_1 Pfam Description: RNA recognition motif. (a.k.a. RRM, RBD, or RNP domain)
  misc_feature (34)..(105): Pfam ID: RRM_1 Pfam Description: RNA recognition motif. (a.k.a. RRM, RBD, or RNP domain)
  misc_feature (556)..(627): Pfam ID: PABP Pfam Description: Poly-adenylate binding protein, unique domain
MAAQGQAAAGSASESGGSPAASAAAAAAFPATSLYVGDLHESVQDAQLFDVFSQVGGVVSVRVCRDINSRKSLGYAYVNYNNPGDAARALELLNFTPINGKPIRIMYSNRDPSSRKSGAGNIFIKNLDKSIDNKALYDTFCAFGNILSCKIATDPSGESRGYGFVQFERDESAQSAIDKLNGMLINDKKVYVGPFVRKQDRENVSSNFKFSNVYVKNLLDTVTDDELKEMFGKYGSITSAVVMRDSDGKSRCFGFVNFENADDAAQAVQELNGKIFNDKELYVGRAQKKSEREMELKEKFEKNIQEVAEKFQNTNLYLKNLEDNIDDEKLRELFAEYGNITSCKVMRDSNGVSRGSGFVAFKSAEDANRALTEMNGKMVGSKPLYVALAQRKEDRKAKLQAQFSQMRPVAMAPSVGPRLPMFPPGVPGVGQQLFYGQPPPAFINPQAGFAFQQPLMPGMRPGGPMPNFMMPMVQQGQQPQRPAGRRAGASGMQQPMPMAGQQQMFPRGGRGYRYPTGRGMPDPGMHSVGAVMPSPYEMGGVPMRDAGLSQPQPVPIGALATALANAPPDQQRLMLGENLYPLVEQLEREQAAKVTGMLLEMDQTEVLHLLESPDALKAKVAEAMEVLRSAQHLQQSNASPEQQLANLSLNDGVVSS

SEQ ID NO: 20506 - DNA, 2097 bp, Sorghum bicolor
  misc_feature: Ceres ANNOT ID no. 8651602
  misc_feature: Up-regulated in root tissues in response to aminocyclopropane carboxylic treatment
  misc_feature: Up-regulated in shoot tissues in response to methyl jasmonate treatment
  misc_feature: Up-regulated in root tissues in response to methyl jasmonate treatment
  misc_feature: Encodes the peptide sequence at SEQ ID NO 20507
atgtggaggctcaagcagttcatccccaaggagcagcccagtggcctggagggtcggaccgtcgatgttggcaatgtcaaggtgcacgtccgggaggccattgcggagggtgggttctcatccgtctatgctgccagagacctggtaaacccggcgaagcagtacgccctcaagcacgtgatcgtccaggacgaggagtcgctgggcctggtccggaaggagatcacggtgatgcggtcgctcaagggacaccctaatgtggtcacgctggttgcacacgccgtactggacatgggacggacgagggaggcactgctgctcatggagttctgcgagaagtcgctggtttctgtgttggagggcagaggagcaggctactttgatgaagagaaggtggctctcatcttccgggatgtttgcaatgctgtctttgcgatgcattgccagacgccgcctcttgctcacagggacctaaaggctgaaaatgttcttcttgctgctgatggggcttggaaactatgcgattttggtagtgtgtcgacaaatcataagtgctttgataaacctgaggagatgggcattgaagaagataacatcaggaagcacaccactcctgcatatagagctcctgagatgtgggacttgtacaggagggagattatcagtgagaaagtagatatctgggctcttggatgtctcttgtatagaatctgctacttcaaatcagcatttgatggagaatcaaagcttcaaatacttaacgggaactatcgtatcccagaattgccgaagtacagttcttctattacaacacttatcaaagacatgcttaattcttctccagatgccagaccagacatcacacaggtgtggttccgcattaatgagttacttccattggagctgcaaaaggatttacctgatggatctccatctggatcagcatttgaatctcatactgccattgatgaagcatcaacaagaccacagcaaatgagtgcctcttcatcatcaagagacaatatgaggagtacctctcttagtgattcttccaacgtgatggcacaaggtcctgtgaaagctgtggacaacaggggttctatgggtgcattttggtcaactcaacatgctcaggagctatcttttgcttatgacaaggggccagcttttgatgaagagcccattaatcaagtcacatcaaagcaatcacaggctaagaaccagaacacaccagctcccaattcatctcggaagtctctgtctgcatcggttgatagttcccctggggattttgaaattaggttttctgcaaatggctcggagtctgggctggagaaaaccaaaacggcaataacagagaataaaacaaagatacaaactactgccttcaactccttcgtggcagactttgataatatcaaaatgaactcacaaaacagtactgacaatgtaaacatgactagcaaattgaaagaacatcaattggaagcagaagtaactttgctgaaggaacaattaaagatagcaaacctggagaaggaagaaatttcattgaagtttgataagttgtctgccatttgctcctctcagaggcgagagatacaagagcttaagcaagccttagctgcagcttctgctacaccaccagctaaacagttcagagaaaattcaaaagttgaactcaccccacccagcaaaagcctcgatactccgccgagggagaagattgaaggaacccctccagagctccggcatggcctatttacttcaagcccgggaacaccaagccctgatccgaaaacatggtcagctttccctgaagagccaaaagctcaagcagctgtgaagagtgtccaccccaggtcagtccgaactctgcgcgcatcaaacagcaacaaagccagctcgcttggacagtcaaatataagttctagcaccgatccatttgcctttggtcaagatagctttaaggctgctccttctggaactgtacttccccagctatcaagcatggggaatacttctcaggtaaataatctgaatgtagaagaaaagaaagatggatcctaccaaccagctggatggactgggttttga

SEQ ID NO: 20507 - protein, 698 aa, Sorghum bicolor
  misc_feature: Ceres ANNOT ID no. 8651602
  misc_feature: Up-regulated in root tissues in response to aminocyclopropane carboxylic treatment
  misc_feature: Up-regulated in shoot tissues in response to methyl jasmonate treatment
  misc_feature: Up-regulated in root tissues in response to methyl jasmonate treatment
  misc_feature (14)..(301): SWISSPROT Homolog: EC 2.7.11.1 Non-specific serine/threonine protein kinase
  misc_feature (28)..(292): Pfam ID: Pkinase Pfam Description: Protein kinase domain
MWRLKQFIPKEQPSGLEGRTVDVGNVKVHVREAIAEGGFSSVYAARDLVNPAKQYALKHVIVQDEESLGLVRKEITVMRSLKGHPNVVTLVAHAVLDMGRTREALLLMEFCEKSLVSVLEGRGAGYFDEEKVALIFRDVCNAVFAMHCQTPPLAHRDLKAENVLLAADGAWKLCDFGSVSTNHKCFDKPEEMGIEEDNIRKHTTPAYRAPEMWDLYRREIISEKVDIWALGCLLYRICYFKSAFDGESKLQILNGNYRIPELPKYSSSITTLIKDMLNSSPDARPDITQVWFRINELLPLELQKDLPDGSPSGSAFESHTAIDEASTRPQQMSASSSSRDNMRSTSLSDSSNVMAQGPVKAVDNRGSMGAFWSTQHAQELSFAYDKGPAFDEEPINQVTSKQSQAKNQNTPAPNSSRKSLSASVDSSPGDFEIRFSANGSESGLEKTKTAITENKTKIQTTAFNSFVADFDNIKMNSQNSTDNVNMTSKLKEHQLEAEVTLLKEQLKIANLEKEEISLKFDKLSAICSSQRREIQELKQALAAASATPPAKQFRENSKVELTPPSKSLDTPPREKIEGTPPELRHGLFTSSPGTPSPDPKTWSAFPEEPKAQAAVKSVHPRSVRTLRASNSNKASSLGQSNISSSTDPFAFGQDSFKAAPSGTVLPQLSSMGNTSQVNNLNVEEKKDGSYQPAGWTGF

SEQ ID NO: 20508 - DNA, 3690 bp, Sorghum bicolor
  misc_feature: Ceres ANNOT ID no. 8653520
  misc_feature: Up-regulated in shoot tissues in response to salicylic acid treatment
  misc_feature: Encodes the peptide sequence at SEQ ID NO 20509
atggaagttgatgacgacgtggaggaggatgacatagattttaaccctttccttagggaaggatctccgtctgagacctcatcaaaccttacctcagaagcagaatgtgaggagcatagttctgaaaatcaaccaagtagtcagacatatctgcagaatactgtagttaatgaaattacaagtgacagtgcacttcctcaaaatagattgtcgtctcaagatgttgtcaacaaaatatgtccagaagaaacatctacccaggttaatcttgagaatgatgaaggtcacttgaatggattggaaaaagatgttttagcaagcgaagctgcttgctctcaaacagtgcaaaaccctcatcaccaatctctcgaaattagtgaggaagatgcaatttgcagaaggacgagggcaagatactcactagaaaactattcacttgaggaattggagacctttctccaggaatcagatgacgatagtcgtctgcaaaatgttgatgaagaagaggaataccgcaagtttcttgctgctgtcctgtctggtgtaggcaatgacacactggcattccagggggaggataaccaagatgaagatgataatgatgcagactttgagctcgagattgaggaggccctagaaagtgatggtgatgaaaatgttgagaactatgatgacacaaatcatagaaaagagagagatggctgtaggcctcagactaggcagaggcggccattaaccgagttgtctggggccggtagctatcgtcaggaatccaataaaactcatttaagaccaattgtgccatatattccatctgcattggtgactcctgcacatgcttttggatggcaatatcctacccagaacgcccttttcccttcatccttgatttcactaacgcgtgcacctttagcatgtggatttactgaacagcaactcgggcaactacatgtgttgatatatgagcatgttcagctccttatccaaacattttccctatgtgttcttgattcatctagacaagatgtggctaataatgtcaaaaagatgatagttgagttggttggcgctcgtgatcaagcactggctaggagtgctcctcaacggcatatcttctttgaatcccagcatctcttatctagttttgtttcttctgaaaattcaaaatgcgaatggattcccttaatcaagagtccgattgtatccatccttgatgtcgcaccgcttgagttggccctcgactatttaagtgatgtcgcaactgctgtcgtgaagtatagaaaaagtcatgtggatggcactgctgacaaaacccgcaggaaagagtccctgtttccttcaccagtgattatcagttgcaaagaagtgaataatgtttctcaagatagatcaaatagtatgcctacagcatcatctccttcatctgggcagttgaagcagaagaaatcattggctgctaccctgcttgagaatattaaaaaggatacagttgctcttgttcctgctggcattgcaagattagcacagagattcttttcacttttcaattttgcactctttcctcataagccacccccttcagctatggccagtagagtgcttttcactgatgcagaggacagattattagctctaggaattctggaatataacaatgactgggcagcaatacaaaagcgctttcttccttgtaaatcaaagcatcagatatttgtgagacaaaagaatcgtagctcctccaaagctcctgataatccagttaaggatgtgcgtcatatgaagacatctccattgacagtcgaggagaaagaacgtatccaggaggggctgaggatattcaaaaacgactggacatcagtttggaggtttgtagtgccacatagagatccttcactgctccaacgtcaatggagagttgcaagtggagtccagaaatcttacactaaaagtgatgctgaaaaagaaagaaggcgaacatatgaagcaaagaggagaaagcttagagcatccatacccgactcacactatggacaagaggctgataacaatgcttctgaagatgttgaaaatgatgatgattcatatgtcaatgaagcatttttggaagacacagatagtaggagcatgaacatgatgccttgtcagctgtccttgtcaaaacatgctggaaaaagcatgatgatgcagtcaggcacaggcgtcgatgaagaatgtggtgctgcatgtggttacattgaaccacagaaaggaagtggtgcggaacctgatgtaaccacctcatatataccttttatgtactgcccctctgatggcccatcatatgtgagaacaccttccgttgcagctccagtggtaccatgtggatctctggaccaactgccagcttccaaattgcgtaaagagaaaggtggttgtgtggtcaagttggctccagaattgcctccagtgaaccttccaccttctgtccgtgtcctatctcaggtggcatttcatccgaacgcaacacattttcatggcacctcgaatcatgcagcaaagaatatgtaccctgtgccacctctggcctttacagaaagtgcttatagacagctaaatctgttccctgatcacagagctaattctagattgcagcagaatgagatctctagtgataatgctatggaggatggtgctgagcaagatttgcagatgcatcctttactgtttcagtattctcgagatgtggtttcgtcatatagtcacccggttcaaaatcttattaatcagtcaagaaaatatgatcttttcccctttgagaaagttcgagttgagagaagtaacaaccagactacaagttccaccgaaaatggtactgtaaatgctaacactatcgacttccatcctctcttgcaaagaacagaagttgatgtgcataatgaaatagcagaacatgataataaccttgattaccatcagtctgataataacatgagcgaagtccctgtagatgaccagtcaacagctgggcaagcatccacaagcccttctgagagggagacaagtattgacttgaacattcatttgtgttctccaatggccataaaagatacaaatgacttcagaagtagttttagcagaccaaatgttcaagttgatgtttttaggaaggacaaatcaagtattccagagctcgaggttgtaaattcctattttcatcattgcattcaagaacctaatgaagaatcaatgcaaggaattgtaatggagcaagaagaattaagtgattccgaggaagatagccagcatgttgagtttgaatgtgaggaaatggatgattctgaagaggagcaagttcagggtccagaaacgtctccaattcaaaataagggtatctcagcatcagctgtttttggggaatttcatgttagtactgaccagagtcaaatccagcaaggatctgttcaaaaggataaacagggtgcaagttcgattcagaaaatgcaagttccttctcgttcagtgagggctaagctgaagccggaaactgcaaagcacacaggatctaggacaagccaacgttcgtccacttctcgcacagctgaaactaaccggagcaaaaccagaagttctaaagtgccacagggacagtcaagtgctgaacgcaagcccaatgattcaagaagacctcgaaaaactccagccccaagatga

SEQ ID NO: 20509 - protein, 1229 aa, Sorghum bicolor
  misc_feature: Ceres ANNOT ID no. 8653520
  misc_feature: Up-regulated in shoot tissues in response to salicylic acid treatment
MEVDDDVEEDDIDFNPFLREGSPSETSSNLTSEAECEEHSSENQPSSQTYLQNTVVNEITSDSALPQNRLSSQDVVNKICPEETSTQVNLENDEGHLNGLEKDVLASEAACSQTVQNPHHQSLEISEEDAICRRTRARYSLENYSLEELETFLQESDDDSRLQNVDEEEEYRKFLAAVLSGVGNDTLAFQGEDNQDEDDNDADFELEIEEALESDGDENVENYDDTNHRKERDGCRPQTRQRRPLTELSGAGSYRQESNKTHLRPIVPYIPSALVTPAHAFGWQYPTQNALFPSSLISLTRAPLACGFTEQQLGQLHVLIYEHVQLLIQTFSLCVLDSSRQDVANNVKKMIVELVGARDQALARSAPQRHIFFESQHLLSSFVSSENSKCEWIPLIKSPIVSILDVAPLELALDYLSDVATAVVKYRKSHVDGTADKTRRKESLFPSPVIISCKEVNNVSQDRSNSMPTASSPSSGQLKQKKSLAATLLENIKKDTVALVPAGIARLAQRFFSLFNFALFPHKPPPSAMASRVLFTDAEDRLLALGILEYNNDWAAIQKRFLPCKSKHQIFVRQKNRSSSKAPDNPVKDVRHMKTSPLTVEEKERIQEGLRIFKNDWTSVWRFVVPHRDPSLLQRQWRVASGVQKSYTKSDAEKERRRTYEAKRRKLRASIPDSHYGQEADNNASEDVENDDDSYVNEAFLEDTDSRSMNMMPCQLSLSKHAGKSMMMQSGTGVDEECGAACGYIEPQKGSGAEPDVTTSYIPFMYCPSDGPSYVRTPSVAAPVVPCGSLDQLPASKLRKEKGGCVVKLAPELPPVNLPPSVRVLSQVAFHPNATHFHGTSNHAAKNMYPVPPLAFTESAYRQLNLFPDHRANSRLQQNEISSDNAMEDGAEQDLQMHPLLFQYSRDVVSSYSHPVQNLINQSRKYDLFPFEKVRVERSNNQTTSSTENGTVNANTIDFHPLLQRTEVDVHNEIAEHDNNLDYHQSDNNMSEVPVDDQSTAGQASTSPSERETSIDLNIHLCSPMAIKDTNDFRSSFSRPNVQVDVFRKDKSSIPELEVVNSYFHHCIQEPNEESMQGIVMEQEELSDSEEDSQHVEFECEEMDDSEEEQVQGPETSPIQNKGISASAVFGEFHVSTDQSQIQQGSVQKDKQGASSIQKMQVPSRSVRAKLKPETAKHTGSRTSQRSSTSRTAETNRSKTRSSKVPQGQSSAERKPNDSRRPRKTPAPR

SEQ ID NO: 20510 - DNA, 1155 bp, Sorghum bicolor
  misc_feature: Ceres ANNOT ID no. 8653866
  misc_feature: Up-regulated in root tissues in response to salicylic acid treatment
  misc_feature: Up-regulated in shoot tissues in response to salicylic acid treatment
  misc_feature: Encodes the peptide sequence at SEQ ID NO 20511
atggcggcgtacctgagcatgggtgaggcgcaccgccgcatcggcgactacctctctcgcgtgaccaacgccatctcctactccgacggcgccgcgctcgcctccctcctctccgtctcctccgcgccggcctccaccccgctctccgacgcgctcgccgccttcccggacttcccgcgcctcgccggagaccgcttcccccaccttgccgacttcctcgttccgttgctccgcgccatccactcccactccgtccagcgcttcgccgacgcctactcctcgttcgagaaggcctccagcgcgttcctgcaggagtttaggaactgggagacgccgtgggcgatggaggcgatgcacactgtggcgctcgagatcaggctaatcgctgagaaggcagatagggagcttgctacgaatggaaagaaccccgacaagcttcaggcagccgggtcctttctgatgaaggtttttggcacactagcggtgaaaggacctaagcgtattggagcactctatgttacctgccagctattcaaaatttacttcaggcttggaacagtaaacctttgccgtagtgtcataaggagtatcgaaactgcaaggaattttgattttgaagattttccagtgaaagacaaggtcacttatatgtactacactgggcggttggaggtgtttaatgagaactttcttgttgcagatcagaagctaacttatgctttgatgcattgcaattctcaaagcgagtcaaatttgaggagaattttgaagtttcttatccctgtaaagctttcaataggtgtactgccaaaaaggactctcctggagcggtacaatttgcttgagtatgcagatgttgtaactgcacttaagagaggagatctcaggcttctcaggcaagctctagacaggcatgaagaccaccataacattcagaggcagaaggaaccagccaaggcacatcaaattaagctagatgttgtcgtaagagctctgaaatggcttgaaattgacatggatgtggatgaggtggagtgcatcatggcatgcctcatatacaagaaccttataaagggttactttgctcacaagagcaaggtccttgtcctcagcaaacaagaccccttccccaagttgaacgggaagcctgtttaa

SEQ ID NO: 20511 - protein, 384 aa, Sorghum bicolor
  misc_feature: Ceres ANNOT ID no. 8653866
  misc_feature: Up-regulated in root tissues in response to salicylic acid treatment
  misc_feature: Up-regulated in shoot tissues in response to salicylic acid treatment
MAAYLSMGEAHRRIGDYLSRVTNAISYSDGAALASLLSVSSAPASTPLSDALAAFPDFPRLAGDRFPHLADFLVPLLRAIHSHSVQRFADAYSSFEKASSAFLQEFRNWETPWAMEAMHTVALEIRLIAEKADRELATNGKNPDKLQAAGSFLMKVFGTLAVKGPKRIGALYVTCQLFKIYFRLGTVNLCRSVIRSIETARNFDFEDFPVKDKVTYMYYTGRLEVFNENFLVADQKLTYALMHCNSQSESNLRRILKFLIPVKLSIGVLPKRTLLERYNLLEYADVVTALKRGDLRLLRQALDRHEDHHNIQRQKEPAKAHQIKLDVVVRALKWLEIDMDVDEVECIMACLIYKNLIKGYFAHKSKVLVLSKQDPFPKLNGKPV

SEQ ID NO: 20512 - DNA, 1614 bp, Sorghum bicolor
  misc_feature: Ceres ANNOT ID no. 8653883
  misc_feature: Up-regulated in shoot tissues in response to salicylic acid treatment
  misc_feature: Encodes the peptide sequence at SEQ ID NO 20513
atggcggcgtccccgccgcggaggcgcctccctgctgcgcgcctcctcttggcgctccttctcgcgacgtccgccgtgctgccgcggggcgccggggcggtggaactggggctgaagctgcccttcagcccgggggacgtgctccccgtcctgccgcgccaggtggcgtggcccgtcatgaacacgctccacagcgccgtcgacctgctgccgtccttcgtcgccgccgtggcgcccggggcgccggcgcccgcggcctggagcggcgcgtgcttcgcggagaacgaggccgctatcgagctcacgcccggggaccgcaacgggaccgacgtcggcggcgccgtcctgcgcctcaagactgcttcagctcatagttggacatgcatggatctctatgtttttgcaacaccatataggataacatgggactattattttgctgctcaggagcacactttggagattaaatcatgggaggaacaagcggaattggaatatgtgaaggagcatggcatttctgtttttctcatgccatctggaatgcttggaactttgctatctttgattgatgtcctgcctttgttttcaaacactgcctggggccaacattccaacttagcctttttaaagaagcatatgggagcctcatttgagaaacgttcccaaccttgggttgctaatattagaaaggaggatatacaatctggtgactttttggctctatcaaagattcgaggacgatggggcgggttcgagacattagagaaatgggtgactggtgcatttgctgggcatacctcggtttgcttaaaagacgagaagggtgatctttgggttgcagagtcaggctatgaaaacgagaagggagaagaaatcattgcaatagttccttgggatgaatggtgggccatggccctaaaggatgaatcaaatcctcagatagccctgcttcctttgcaccctgatgtacgtgccagattcaacgaaagtgctgcatgggaatatgcccagagcatggttggacaaccttatggctatcataacatgatatttagctggatcgatacaataggagataattatccacctcctcttgatgctaacctggtaatggcagttatgtcaatgtggactaggttgcagccagtttatgctgcaaacatgtggaatgaagccctaaacaaacgacttggcactgagggtttggaccttcaggggatcattattgagactgaaagacgtggaatgtcttttgatcagttgctcaccatacccgagcaagacgaatgggtatacagtgatggtaaatcaactacttgtgttgccttcattcttgcaatgtataaggaggctggaatattcgcccctttctcggagtcgatccaggtcaccgagttcactattcgtgatgcatacatgctcaagatttttgaagacaacccggcaaggcttccaagctggtgcaacacagacacggacaagcttcccttttgccagattctcggagagtacagaatggagcttccagagtacaacacgattgaaccttatgcgaaaatgaacgagaactgtccgtccttacctccaacatacaaacgacccgcacgctgctga

SEQ ID NO: 20513 - protein, 537 aa, Sorghum bicolor
  misc_feature: Ceres ANNOT ID no. 8653883
  misc_feature: Up-regulated in shoot tissues in response to salicylic acid treatment
MAASPPRRRLPAARLLLALLLATSAVLPRGAGAVELGLKLPFSPGDVLPVLPRQVAWPVMNTLHSAVDLLPSFVAAVAPGAPAPAAWSGACFAENEAAIELTPGDRNGTDVGGAVLRLKTASAHSWTCMDLYVFATPYRITWDYYFAAQEHTLEIKSWEEQAELEYVKEHGISVFLMPSGMLGTLLSLIDVLPLFSNTAWGQHSNLAFLKKHMGASFEKRSQPWVANIRKEDIQSGDFLALSKIRGRWGGFETLEKWVTGAFAGHTSVCLKDEKGDLWVAESGYENEKGEEIIAIVPWDEWWAMALKDESNPQIALLPLHPDVRARFNESAAWEYAQSMVGQPYGYHNMIFSWIDTIGDNYPPPLDANLVMAVMSMWTRLQPVYAANMWNEALNKRLGTEGLDLQGIIIETERRGMSFDQLLTIPEQDEWVYSDGKSTTCVAFILAMYKEAGIFAPFSESIQVTEFTIRDAYMLKIFEDNPARLPSWCNTDTDKLPFCQILGEYRMELPEYNTIEPYAKMNENCPSLPPTYKRPARC

SEQ ID NO: 20514 - DNA, 3645 bp, Sorghum bicolor
  misc_feature: Ceres ANNOT ID no. 8653889
  misc_feature: Down-regulated in shoot tissues in response to aminocyclopropane carboxylic treatment
  misc_feature: Down-regulated in shoot tissues in response to methyl jasmonate treatment
  misc_feature: Down-regulated in shoot tissues in response to salicylic acid treatment
  misc_feature: Encodes the peptide sequence at SEQ ID NO 20515
atgacaagacagaacatatcgaagtcgctcgccgtcctcctccgcgcccgcatgcagcccaaccccatcccctccccgccgccgccgccgcccacggaccccgaccccgccgccccgcccgtggctctcgtccgccactggctccacgcgtctgcctccgccgcctccccggcccccgcggcgctcgacagcttctccgatgggtaccgctccctcgacctcgtcgggcgccgcgaggtcctccgttccctcgccatcgactacgatgtgccccgcgcgcgtgtccgggacctcttgagacagtacatgagcgtcgcctccgccgagccgtcaggcggggatgacgtggaggcggaggggaaggagggcgccgcgtcggcgctgtaccggatggagcgggggctccgggacgcactccggccccggtacgccgggttcctcgaggccatgaacgcgcagccaggcgggctcaagctcctcgccgtgctccgcgccgatctcctcgccttgctgggggaggagaacgctccagcgctgcgggctctggacttgtacttgaaggagaagctggtgacttggcttagtcctgcggcactgacgctccaccagattacctgggatgatcctgcctccttgctagagaagattgtggcatatgaagtttgtggccggctccctgttaatttggctgtgcatccaatcaggaatctgatagacttgaagagaagattgggcattggccgccgatgctttgggtacttccatccagcaataccaggggagcccctgattttcattgaagttgctttacttaaagatatggccgcatctatacaggaggtcttgtgggatgaccccccgactcctgaatctgaagccagctgtgcactattttactcaatatcgtcaacccagcctggtttatcaggtattaatctagggaagtttcttctcaagcgtgtgattgacatgttgagaagagatatgccatcagtacagatttttgcaacacttagtccaatccctggtttcatgcaatggcttcttgctaagctggcctcccaaataaagttatcagaggcagaatcacaggaggggaattcactaggagcttgttctactttcaaagaatccatccttcttcctgacgaagagagaatgattcatgatgccaccgaacaagctgatggaaagcaagggattgaactattgcaagatatactgaaatcaagacagtgggtaaagtctgacaaattatctgctgcattaaaacggcctcttatgcgtttatgtgcaaggtatcttgccagagagaagaagcgaggaaaagctctagatgctgttgcaaattttcacttgcaaaatggagcaatgattgaaagaataaattggatggccgaccaatcagagaagggcattcatcaaagtggaggtatcatggtcaattatctttacaggttagagaacatagaagagtatgcactatcatattcgagtacagggttcatccattcttcacctagcctgtctgagtatctcgaggatatggcagctcttccccctgttcgttgtgaacatgagggaaaaaaggagcgtcctgctattggcggtaggccccgtggctattgtcgtacgatcagccacaggcgaaagcctcggaagcactcgttgactcctcggcgcggctacaagtcaacccagcgaccgcagcccagcctcctccagacggattcctcccatttccaagcgctccagacctccagtcctgggctcctcccggtccggcttaacccctcccgaatcccgatgccggcggactccgcgccgtcgagcgcagcgtcgctgtccgaagacgaccgcctgctcgtcgcacactgcgccgcgctctgcttcccctgcagctcccccaccgccgccgcctccttccaggtgcatcatgcgtcccacccctacccctgcgccgccttcgccttcccgccctcctggtccgccgccgactggatgggaggcgacggcggccgcgcgccgttcggggacgccgaggtggacccggccctgttcccgtcactccgcgctgtcgggagcggcatccccgcgcgaaccaacgccgccttcctcggggccttccgccggctgctcgacggatcgacgctccagtccgaggtaacaagagctgtggcagaggagaaacgtgtagtattcacaggccattcatcaggaggctcaatagccacccttgctgctatatggtttcttgagaagtgcaccagacgaggaagtgttaatcaagcacacccattttgtgtgacctttggggctcctcttgttggagacaatatcttcaaccatgctgttaaaagagagggctggtcacagtgtattttgcatttccttcttccactagacattgtcccacgcataccactgactccacttgcgtccttcagagaagaaattcaagctgttctggattggttatctcctcagacgccaaacaactcccctgctgggaggtcccttgtcatacctgaatattatgaaactttattgagaagcacactatctattgccagctatgaagcctgttctttcatgggatgtaccagctccatcctggggacattgacttccttcattgacctctccccttacagaccctgtgggacttatcatttcttgacaagcagtgagcaattgattgttctcacaaattcagatgctgtcctgcagttgttattttactgccttcagttggatccccaacaacaactgcttgatgctgctgctagaagcttaagtgctcactggcagtatgaaccaattaaagagtgcatgcaggatataatctgtgtggattacctgggaacaatctcatcaactcttcctggtaggcagacagacagagcgaccattggaagcactgaattgagcagggaagctgtactgcacctttctgcagctgcgcaatgggagaagcaaagacagagaaaccaaacaaaaatagatgaaagctgccaaaagattcaggaagccctcgggtccctaaacgagtacaagagatcaagggaactctgcggcgtaagctactacgattccttcaaactccaacgtgaggtgcatgacttcaatgcaaacgtgcggaggctggagctagctggcctctgggacgagatagtggagatgttgcggaggcgtgaactgccggacggcttcgaggctcgtgaggagtgggtgagcctggggaccttgttccgtcgcctggtcgagccgctggacatcgccaactactaccggcactccaagaatgaggacaccggctcctacctctccaaggggcggccgaggcggtacaagtacacgcagaagtggcacgagcagctgcagcgcgctcccgttgggtccagcctcgagtcctgcttctgggcggtggtcgaggagctccaggccgagatggccgacggcagggcgttcgaggacctgagagaccgggtggttaaacttgagaacgatgcacatggctggtataactctggaagtttgggcaaggacgtgtttctggggagctcgtctttcgtggcgtggtggaggaggctcccggagcagcataggtcggcgtcgagcattgcgaaacttgtatctctgtaa

SEQ ID NO: 20515 - protein, 1214 aa, Sorghum bicolor
  misc_feature: Ceres ANNOT ID no. 8653889
  misc_feature: Down-regulated in shoot tissues in response to aminocyclopropane carboxylic treatment
  misc_feature: Down-regulated in shoot tissues in response to methyl jasmonate treatment
  misc_feature: Down-regulated in shoot tissues in response to salicylic acid treatment
  misc_feature (108)..(413): SWISSPROT Homolog: EC 4.1.1.9 Malonyl-CoA decarboxylase
  misc_feature (700)..(808): SWISSPROT Homolog: EC 3.1.1.3 Triacylglycerol lipase
  misc_feature (114)..(486): Pfam ID: MCD Pfam Description: Malonyl-CoA decarboxylase (MCD)
  misc_feature (655)..(812): Pfam ID: Lipase_3 Pfam Description: Lipase (class 3)
MTRQNISKSLAVLLRARMQPNPIPSPPPPPPTDPDPAAPPVALVRHWLHASASAASPAPAALDSFSDGYRSLDLVGRREVLRSLAIDYDVPRARVRDLLRQYMSVASAEPSGGDDVEAEGKEGAASALYRMERGLRDALRPRYAGFLEAMNAQPGGLKLLAVLRADLLALLGEENAPALRALDLYLKEKLVTWLSPAALTLHQITWDDPASLLEKIVAYEVCGRLPVNLAVHPIRNLIDLKRRLGIGRRCFGYFHPAIPGEPLIFIEVALLKDMAASIQEVLWDDPPTPESEASCALFYSISSTQPGLSGINLGKFLLKRVIDMLRRDMPSVQIFATLSPIPGFMQWLLAKLASQIKLSEAESQEGNSLGACSTFKESILLPDEERMIHDATEQADGKQGIELLQDILKSRQWVKSDKLSAALKRPLMRLCARYLAREKKRGKALDAVANFHLQNGAMIERINWMADQSEKGIHQSGGIMVNYLYRLENIEEYALSYSSTGFIHSSPSLSEYLEDMAALPPVRCEHEGKKERPAIGGRPRGYCRTISHRRKPRKHSLTPRRGYKSTQRPQPSLLQTDSSHFQALQTSSPGLLPVRLNPSRIPMPADSAPSSAASLSEDDRLLVAHCAALCFPCSSPTAAASFQVHHASHPYPCAAFAFPPSWSAADWMGGDGGRAPFGDAEVDPALFPSLRAVGSGIPARTNAAFLGAFRRLLDGSTLQSEVTRAVAEEKRVVFTGHSSGGSIATLAAIWFLEKCTRRGSVNQAHPFCVTFGAPLVGDNIFNHAVKREGWSQCILHFLLPLDIVPRIPLTPLASFREEIQAVLDWLSPQTPNNSPAGRSLVIPEYYETLLRSTLSIASYEACSFMGCTSSILGTLTSFIDLSPYRPCGTYHFLTSSEQLIVLTNSDAVLQLLFYCLQLDPQQQLLDAAARSLSAHWQYEPIKECMQDIICVDYLGTISSTLPGRQTDRATIGSTELSREAVLHLSAAAQWEKQRQRNQTKIDESCQKIQEALGSLNEYKRSRELCGVSYYDSFKLQREVHDFNANVRRLELAGLWDEIVEMLRRRELPDGFEAREEWVSLGTLFRRLVEPLDIANYYRHSKNEDTGSYLSKGRPRRYKYTQKWHEQLQRAPVGSSLESCFWAVVEELQAEMADGRAFEDLRDRVVKLENDAHGWYNSGSLGKDVFLGSSSFVAWWRRLPEQHRSASSIAKLVSL

SEQ ID NO: 20516 - DNA, 816 bp, Sorghum bicolor
  misc_feature: Ceres ANNOT ID no. 8654198
  misc_feature: Up-regulated in shoot tissues in response to methyl jasmonate treatment
  misc_feature: Up-regulated in root tissues in response to methyl jasmonate treatment
  misc_feature: Up-regulated in shoot tissues in response to salicylic acid treatment
  misc_feature: Up-regulated in root tissues in response to salicylic acid treatment
  misc_feature: Encodes the peptide sequence at SEQ ID NO 20517
atggcgttccggctgagcaacaacctgatcgggatcctaaacttcatcaccttcctgctctcgatcccgatcctgggcgcggggatctggctgggccagcgcgcggacggcaccgagtgcgagcggtacctctccgctccggtcatcgcggtcggggtgttcctcctcgtggtctcgctcgcggggctcgtcggcgcctgctgccgcgtcacctggctgctctgggtctacctcctcgccatgttcgtcctcatcctcgtcctcttctgcttcaccgtcttcgccttcgtcgtcaccaataagggcgccggggaggccgtctccgggagagggtacaaggagtacaggcttggggattactccaactggctgcagaaaagggtcgagaacaccaagaactgggacaagatcaggagctgccttgaggattctaaggtctgcaagaaactgcaggacaagaacgagaccttcacgcagttcatatcttccgacctctcccccatcgagtctggctgctgcaagccccccaccatctgcggctacacctacgtcagcggcaccaactggacgacgcccgccaacgcgacggcggacccggactgccagacctggagcaactcggcgctctgctacaactgccagtcgtgcaaggccggcgtggtggccacggtgaagcgggactggaagcgcgtcgccatcgtctgcatcgtcttcctcgtcttcatcatcatcgtctactccgtcggctgctgcgccttcaggaacaaccgcagggacaacgcctaccgcggcggctggaagggcggatacgcctga

SEQ ID NO: 20517 - protein, 271 aa, Sorghum bicolor
  misc_feature: Ceres ANNOT ID no. 8654198
  misc_feature: Up-regulated in shoot tissues in response to methyl jasmonate treatment
  misc_feature: Up-regulated in root tissues in response to methyl jasmonate treatment
  misc_feature: Up-regulated in shoot tissues in response to salicylic acid treatment
  misc_feature: Up-regulated in root tissues in response to salicylic acid treatment
  misc_feature (5)..(242): Pfam ID: Tetraspannin Pfam Description: Tetraspanin family
MAFRLSNNLIGILNFITFLLSIPILGAGIWLGQRADGTECERYLSAPVIAVGVFLLVVSLAGLVGACCRVTWLLWVYLLAMFVLILVLFCFTVFAFVVTNKGAGEAVSGRGYKEYRLGDYSNWLQKRVENTKNWDKIRSCLEDSKVCKKLQDKNETFTQFISSDLSPIESGCCKPPTICGYTYVSGTNWTTPANATADPDCQTWSNSALCYNCQSCKAGVVATVKRDWKRVAIVCIVFLVFIIIVYSVGCCAFRNNRRDNAYRGGWKGGYA

SEQ ID NO: 20518 - DNA, 1173 bp, Sorghum bicolor
  misc_feature: Ceres ANNOT ID no. 8654292
  misc_feature: Up-regulated in root tissues in response to aminocyclopropane carboxylic treatment
  misc_feature: Up-regulated in shoot tissues in response to aminocyclopropane carboxylic treatment
  misc_feature: Up-regulated in shoot tissues in response to salicylic acid treatment
  misc_feature: Down-regulated in shoot tissues in response to salicylic acid treatment
  misc_feature: Encodes the peptide sequence at SEQ ID NO 20519
atgtgcggcggcgccatcctctcggggttcatcccgccgtccggtgtggcggctgcggcggcggccgccaagaagaaacagcagcaggggcggcgcgtgacggccgacctgctgtggccggggcccggcaagaagggagcgctgccccaggaggaggaggacgacttcgaggccgacttccgcgagttcgagcgcggcctcagcgaggatgacgacgtggacggcgccggcgaaggcggcgacgacgaggtccaggagcttgctccgccggagccggtgaggtttgccttcgccgccgcggctaaggcgccgcgccctgcagttgatggtgtgatgactccaaaggatgttcaaggagatagacctactgctaactcagtaaagcgcaaccggaagaatcagtacaggggaatccgccagcgcccttggggcaaatgggcagctgaaatcagagaccctagcaagggcgtccgtgtttggcttggaacttacaacactgctgaggaggcagctagggcatacgatgctgaagctcgcaagatccgtggaaagaaagcgaaggtcaattttcctgatgaagtaccaggtgctcagaagtcaactgcaaagccaactgattcaaatgcaacaaagctagctccacccccaaaggcctgtgctgatgaggttttcagtaacctgaacaatgacaacaatgatttgttcgcaatgtttgcgttcaatgacaataaggttcctgtgaagccagctgaggttgccagtttcctccctgcagtgaaacctctggtgcccagtaagagatctgcgactaacatgctttctgaccagaacagcaactcctatggctcttctgactttgggtgggacgatgacaccatgacctcaggctacacctttgctcccaataatgctataccagcatcttacatgcaaggtggagagtcaaagagaatgaggaacaactatggtgtagccatgtttcagggaaatggcgcccccagtctcgcacaagtcatgcctggttttgatcctgagatgaactatcagccattgccttatgttgagagcagctcatcagatgcatcaatggacagccttctaccacaggatggggcaagcaatggggatatctggagccttgatgagctgctcatggcagctggtgcttattga

SEQ ID NO: 20519 - protein, 390 aa, Sorghum bicolor
  misc_feature: Ceres ANNOT ID no. 8654292
  misc_feature: Up-regulated in root tissues in response to aminocyclopropane carboxylic treatment
  misc_feature: Up-regulated in shoot tissues in response to aminocyclopropane carboxylic treatment
  misc_feature: Up-regulated in shoot tissues in response to salicylic acid treatment
  misc_feature: Down-regulated in shoot tissues in response to salicylic acid treatment
  misc_feature (133)..(184): Pfam ID: AP2 Pfam Description: AP2 domain
MCGGAILSGFIPPSGVAAAAAAAKKKQQQGRRVTADLLWPGPGKKGALPQEEEDDFEADFREFERGLSEDDDVDGAGEGGDDEVQELAPPEPVRFAFAAAAKAPRPAVDGVMTPKDVQGDRPTANSVKRNRKNQYRGIRQRPWGKWAAEIRDPSKGVRVWLGTYNTAEEAARAYDAEARKIRGKKAKVNFPDEVPGAQKSTAKPTDSNATKLAPPPKACADEVFSNLNNDNNDLFAMFAFNDNKVPVKPAEVASFLPAVKPLVPSKRSATNMLSDQNSNSYGSSDFGWDDDTMTSGYTFAPNNAIPASYMQGGESKRMRNNYGVAMFQGNGAPSLAQVMPGFDPEMNYQPLPYVESSSSDASMDSLLPQDGASNGDIWSLDELLMAAGAY

SEQ ID NO: 20520 - DNA, 1536 bp, Sorghum bicolor
  misc_feature: Ceres ANNOT ID no. 8654354
  misc_feature: Up-regulated in shoot tissues in response to methyl jasmonate treatment
  misc_feature: Up-regulated in shoot tissues in response to salicylic acid treatment
  misc_feature: Encodes the peptide sequence at SEQ ID NO 20521
atgggggccttcgcgaaggaggagcaccagttcctcgccgagctcggcctcgcgcagcgcaacccgggcgcgttcgtatgcggcgcgtggggcggctcgggccccgccgtcacctccaccagcccgaccaacaaccaggtcatcgcggaggtcgtggaggcgtccgtgcaggactatgaggagggcatgcgcgcctgcttcgatgccgccaagacatggatggcgtttcctgctccgaagcgaggagagattgttaggcaaatcggtgacgcactgagagcaaagctccatcaccttggcaggcttgtgtcacttgagatggggaaaattcttcctgaagggatcggtgaggttcaggaaatcatcgacatgtgtgattatgctgtggggctaagtcgccaactaaatggatccattataccatctgaacgaccaaaccatatgatgatggaggtgtggaatccccttggagttgtgggtgttataacggcatttaattttccttgcgctgtgcttggttggaatgcttgcattgctttggtctgtggaaactgtgttgtctggaaaggtgccccaacgactccactgatcactattgcaatgactaaaatagtggctagcgtattggagaagaacaatttgccaggcgcaattttcacatccttttgtggtggcactgaaattggtcaagcaattgccgttgacactaggatacctttggtttcattcactggaagtacaagggctggtctgatggttcaacaacaagttaatgcaagatttggtaaatgccttcttgaacttagcggaaacaatgccatcattgttatggatgacgcagatatccagctagctgtgcgttctgtcttgtttgctgctgtcggtacagcaggacaacgctgcactacatgccgtaggctgattcttcatgaaagcatatatcaaactttccttgatcaacttgttgaggtatacaaacaagtccgaattggggatccgttggagaagggcaccttactgggaccactgcacactcctgcttcaaaagagaactttttgaaaggcgttcaaaccattaaatctcaggtgaagggagggaaaatcctttttggaggatctgccattgaatcagaaggaaacttcgtgcaaccaacaattgtggaaattacaccttctgcagcagttgtgaaagaagaactctttggtcctgtcctttatgttatgaaatttcagagcttgaaggaagcaattgaaatcaataactctgttcctcaaggattgagcagttctatatttacaaagaggccagaaattatttttaagtggctcgggccccatggtagtgattgtggtatagtgaatgtgaacatacctactaacggtgctgaaatcggtggagcatttggtggagaaaaggcaactggtggtggacgagaagcagggagtgattcctggaagcagtacatgaggagggcgacttgtacaatcaactatggaagcgagctacctctagcccagggaatcaattttggttaa

SEQ ID NO: 20521 - protein, 511 aa, Sorghum bicolor
  misc_feature: Ceres ANNOT ID no. 8654354
  misc_feature: Up-regulated in shoot tissues in response to methyl jasmonate treatment
  misc_feature: Up-regulated in shoot tissues in response to salicylic acid treatment
  misc_feature (1)..(511): SWISSPROT Homolog: EC 1.2.1.3 Aldehyde dehydrogenase (NAD(+))
  misc_feature (30)..(493): Pfam ID: Aldedh Pfam Description: Aldehyde dehydrogenase family
MGAFAKEEHQFLAELGLAQRNPGAFVCGAWGGSGPAVTSTSPTNNQVIAEVVEASVQDYEEGMRACFDAAKTWMAFPAPKRGEIVRQIGDALRAKLHHLGRLVSLEMGKILPEGIGEVQEIIDMCDYAVGLSRQLNGSIIPSERPNHMMMEVWNPLGVVGVITAFNFPCAVLGWNACIALVCGNCVVWKGAPTTPLITIAMTKIVASVLEKNNLPGAIFTSFCGGTEIGQAIAVDTRIPLVSFTGSTRAGLMVQQQVNARFGKCLLELSGNNAIIVMDDADIQLAVRSVLFAAVGTAGQRCTTCRRLILHESIYQTFLDQLVEVYKQVRIGDPLEKGTLLGPLHTPASKENFLKGVQTIKSQVKGGKILFGGSAIESEGNFVQPTIVEITPSAAVVKEELFGPVLYVMKFQSLKEAIEINNSVPQGLSSSIFTKRPEIIFKWLGPHGSDCGIVNVNIPTNGAEIGGAFGGEKATGGGREAGSDSWKQYMRRATCTINYGSELPLAQGINFG

SEQ ID NO: 20522 - DNA, 1908 bp, Sorghum bicolor
  misc_feature: Ceres ANNOT ID no. 8654429
  misc_feature: Down-regulated in shoot tissues in response to aminocyclopropane carboxylic treatment
  misc_feature: Down-regulated in root tissues in response to salicylic acid treatment
  misc_feature: Encodes the peptide sequence at SEQ ID NO 20523
atgccgagcccgacgatccggaggctggacgtggcctcgccggtgccggcggacatcgacatcgccaacgccgtcgagccgctcccgatcgccgacatcgcggcggagctcggcctccggcccgaccactacgacctctacggcaagtacaaggccaaggtcttgctgtcggttcttgatgacctcaaggcgcagcaggatggatactacgtcgtggtcggcggcatcacgccgacgcccctcggggagggcaagtccaccaccaccgtcggtctgtgtcaggctcttggcgctttccttgataaaaaggttgtcacatgccttcgtcaaccatcacaagggcctacctttggaatcaagggaggtgcagctggaggtggctacagccaagttatacccatggatgagttcaatcttcatctgacaggcgatatccatgcaattacggctgcaaacaatctacttgctgctgctattgatacaaggatcttccatgaaaattctcagtcagacaaaggactgttcaacagattgtgtccggcaaacaaggaaggcaagaggcactttgctgacgtaatgttcagacgtctgacaaagttgggcatttcaaagacagaccccaatgagcttacaccagatgaaatcaggcgttttgcaaggcttgatatcgaccctgagtccattacatggagacgggtgatggatgtcaatgaccgtttcctgagaaaaatcactattggacagggccctgaagaaaaaggtatggtgagagaaacaggctttgatatatctgtagctagtgaaataatggctgtattagctcttacaacttccctcgctgacatgagagaaaggcttggaagaatggtgatagggaacagcaagtcaggtgagccgataactgctgatgatcttggggttggaggtgcgttgactgtcctaatgaaagatgctattcatcccaccctcatgcaaactcttgaaggcacaccagttttagtacatgctggaccgtttgctaacattgctcatggaaattcttcaattgttgctgataagattgctttgaagttggttgggaagggtggctttgttgttactgaggcaggttttggtgctgatattggaactgagaagttcatggacatcaaatgtaggtatagtggattggtgccacagtgtgctattattgtggccacaattagagctctcaaaatgcatggaggggggcctgaggtggtggctggaaagcctctggatcatgcatatgtgagcgaaaatgtggcccttgttgaagctggatgtgtaaatctggctaaacatatatcaaacacgaggagttatggagttaatgttgtagttgcaatcaacaaatttgcatcagatactgaagcagaaatgaatgtggtgcgtagtgcatcaatggctgctggtgcttttgacgctgtcgtctgcacgcaccatgcccatggtggtaaaggagcggtcgagcttggacttgctgtccaacgagcatgtgaaagccagacagaacctctgaagtttttgtatcctttggaatctagcataaaggagaagattgagtcaattgctaagttttatggtgccagtggtgttgaatactccgagcaggctgagaagcagattgagatgtacaccaagcaagggttctccaacctccccatctgcatggcgaagacccaatactcattctcacacgtcccatccatgaagggcgcgccgacgggctttgttctaccaataagagatgtgagggccagtatcggagctgggttcatctacccgctcgtgggcaccatgagcacgatgcctgggcttcccacaaggccctgcttctacgagatcgatgtagacactgccaccgggaaggtcatgggcctgtcatga

SEQ ID NO: 20523 - protein, 635 aa, Sorghum bicolor
  misc_feature: Ceres ANNOT ID no. 8654429
  misc_feature: Down-regulated in shoot tissues in response to aminocyclopropane carboxylic treatment
  misc_feature: Down-regulated in root tissues in response to salicylic acid treatment
  misc_feature (3)..(635): SWISSPROT Homolog: EC 6.3.4.3 Formate--tetrahydrofolate ligase
  misc_feature (15)..(635): Pfam ID: FTHFS Pfam Description: Formate--tetrahydrofolate ligase
MPSPTIRRLDVASPVPADIDIANAVEPLPIADIAAELGLRPDHYDLYGKYKAKVLLSVLDDLKAQQDGYYVVVGGITPTPLGEGKSTTTVGLCQALGAFLDKKVVTCLRQPSQGPTFGIKGGAAGGGYSQVIPMDEFNLHLTGDIHAITAANNLLAAAIDTRIFHENSQSDKGLFNRLCPANKEGKRHFADVMFRRLTKLGISKTDPNELTPDEIRRFARLDIDPESITWRRVMDVNDRFLRKITIGQGPEEKGMVRETGFDISVASEIMAVLALTTSLADMRERLGRMVIGNSKSGEPITADDLGVGGALTVLMKDAIHPTLMQTLEGTPVLVHAGPFANIAHGNSSIVADKIALKLVGKGGFVVTEAGFGADIGTEKFMDIKCRYSGLVPQCAIIVATIRALKMHGGGPEVVAGKPLDHAYVSENVALVEAGCVNLAKHISNTRSYGVNVVVAINKFASDTEAEMNVVRSASMAAGAFDAVVCTHHAHGGKGAVELGLAVQRACESQTEPLKFLYPLESSIKEKIESIAKFYGASGVEYSEQAEKQIEMYTKQGFSNLPICMAKTQYSFSHVPSMKGAPTGFVLPIRDVRASIGAGFIYPLVGTMSTMPGLPTRPCFYEIDVDTATGKVMGLS

SEQ ID NO: 20524 - DNA, 2127 bp, Sorghum bicolor
  misc_feature: Ceres ANNOT ID no. 8654449
  misc_feature: Down-regulated in shoot tissues in response to methyl jasmonate treatment
  misc_feature: Down-regulated in shoot tissues in response to aminocyclopropane carboxylic treatment
  misc_feature: Down-regulated in shoot tissues in response to salicylic acid treatment
  misc_feature: Encodes the peptide sequence at SEQ ID NO 20525
atgacgacggtgagccacctggatctcgaggccggctggcccggccccggccccggccgcggcggcggcggcggtccgcccgaatatgagcaggcggaggtcggcaattttcgcaaagatctagcccttgcttacaagactctcggcgttgtgtttggtggcctcgtcacgtcccccctctacgtttacccctcaatgaacttgtcatctcctacaaaagatgactacatggggttatacagcataatgttttggactcttactttgattggtgtggtcaagtatgtaggcatagcacttaatgccgacgatcatggtgaaggaggtacatttgccatgtactctctgttgtgtaggcatgctgatataggcatacttccttccaaaaaagtttattcggaagaagagcctctacttcagaatcagtctgcaagagctggaaggcctagctggctggggaagttctttgagcgaagcataacagccagaagagcactgctgttcatggcaatactgggaatgtgcatgctcattggggatggcatactcactcctgctatttcagtattatcagcaattcaagggctaagagggccatttccttctgtcagcaacgctgtagtcgaagttctgtctgctgtgatccttatcggcttattcttactgcaaaagtatggaacctcaaaagtgagctttctgttttcaccgatcatggcagcatggactttcaccactccaattatcggcttgtatagcattgttcattactatcccggcatcttcaaagccatctcacctcattatattgttcgcttcttcctgagaaataaaaaggaagggtggcgcatgctcggtggaactgttctatgcatcaccggtgctgaagctatgtttgcagatcttggccacttcagtaagaagagtattcagatagcatttctgtctagcatatatccttctctgatcctcacatatgctgggcaaacagcgtacctcatcaacaatgttaacgacttcagtgacggattctacaaatttgtccctcgccctgtttactggcccatgttcatcatcgcaacgctggcagcaatcgtcgcaagccaatccttaatatctgcaacattttcagtcatcaagcaatccgttgtcctggactacttcccacgcgtcaaggtggtgcacacgtctcagcataaagaaggggaggtttactccccagaaaccaattacatcctcatggtactatgcgtcagtgtcatactaggctttggtgctggaaatgcgatcgggaacgcattcggtgttgtggtcatcatggtcatgctcataaccacaatcatgctcaccctggtgatgatcattatatggagaacaccacctgttcttgtggcgctttacttcgtgcctttcttcatcatggaaggatcttatgtcagtgcagtcttcaccaagatccctgaaggcgggtggctcccctttgcagtgtccatcatcctggcactggtcatgttcggctggtattacggcaggcaacggaagatggagtacgagatggcgaacaaggtgaccgtggagcgcctcaccgagctccttgcgaggccggaggtgcagagggtccccgggctttgcttcttctacagcaacattcaggacgggctcactccaatcctcggccactacatcaagaacatgagctcgctgcacgcggtcacggtcttcgtcaccctgcgatacctgttggtggccaaggtggacgagcgggagaggatcctcgtcaggaggctggggccgaacggggtgtacggctgcactgtccagtacgggtacgccgacagcctcggcaacggcgacctcgccgcgcaggtcacgagctccctgcggcggcactttgagacgacgacggaggcgggggaggaggaggccgcgagtctggaggcggcgaggatgaccggcgtggtgcacgttcggggtaagatgaggttctacgtgggcgacgacgccgggtggttcgacaaggtcatgctcgggttctacgagttcctgcacggcatctgtcgctccgcgctgccggcgctggggacgccgctgcaacagcgagtcgagatcggcatgctgtacaaggtttga

SEQ ID NO: 20525 - protein, 708 aa, Sorghum bicolor
  misc_feature: Ceres ANNOT ID no. 8654449
  misc_feature: Down-regulated in shoot tissues in response to methyl jasmonate treatment
  misc_feature: Down-regulated in shoot tissues in response to aminocyclopropane carboxylic treatment
  misc_feature: Down-regulated in shoot tissues in response to salicylic acid treatment
  misc_feature (42)..(708): Pfam ID: K_trans Pfam Description: K+ potassium transporter
MTTVSHLDLEAGWPGPGPGRGGGGGPPEYEQAEVGNFRKDLALAYKTLGVVFGGLVTSPLYVYPSMNLSSPTKDDYMGLYSIMFWTLTLIGVVKYVGIALNADDHGEGGTFAMYSLLCRHADIGILPSKKVYSEEEPLLQNQSARAGRPSWLGKFFERSITARRALLFMAILGMCMLIGDGILTPAISVLSAIQGLRGPFPSVSNAVVEVLSAVILIGLFLLQKYGTSKVSFLFSPIMAAWTFTTPIIGLYSIVHYYPGIFKAISPHYIVRFFLRNKKEGWRMLGGTVLCITGAEAMFADLGHFSKKSIQIAFLSSIYPSLILTYAGQTAYLINNVNDFSDGFYKFVPRPVYWPMFIIATLAAIVASQSLISATFSVIKQSVVLDYFPRVKVVHTSQHKEGEVYSPETNYILMVLCVSVILGFGAGNAIGNAFGVVVIMVMLITTIMLTLVMIIIWRTPPVLVALYFVPFFIMEGSYVSAVFTKIPEGGWLPFAVSIILALVMFGWYYGRQRKMEYEMANKVTVERLTELLARPEVQRVPGLCFFYSNIQDGLTPILGHYIKNMSSLHAVTVFVTLRYLLVAKVDERERILVRRLGPNGVYGCTVQYGYADSLGNGDLAAQVTSSLRRHFETTTEAGEEEAASLEAARMTGVVHVRGKMRFYVGDDAGWFDKVMLGFYEFLHGICRSALPALGTPLQQRVEIGMLYKV

SEQ ID NO: 20526 - DNA, 2031 bp, Sorghum bicolor
  misc_feature: Ceres ANNOT ID no. 8654742
  misc_feature: Down-regulated in shoot tissues in response to salicylic acid treatment
  misc_feature: Encodes the peptide sequence at SEQ ID NO 20527
atggcgttgcaacctctatgccgcacaggatgtcaggatgtagatcatgggtgcgatatgcgcggcgacacaatagatgatgaggttgaggccaaggacggaaggagccccaacatggtcatcctaacggggcggacccataggatccgccacgtcaaaagtctgaagacttctttgttgcagaaatggttgaacgagttgctcacctcaattgttacaaaagaatacaggagatcaatcaacaaaagatcgaggagcgatcgaggagcgggtcatcatacatctttgagctcgaggcagcagacggcgctgccaccgtgggcgtggaaggagagggccaaaccgcgccaacgccccaaatcccagcatatggagggggttgcgcccgccgtctcgctgttccgcccacgcgcttccgcacgccccaccattgtcctcgccgagaattccggcagcgcccggaggagccctggtgcagggaggagcaggggggtttcaaggcttagtccggagatgtctcccggcggggccagtcggagtaattgcttagatgttctgtgcttttgtttgatatttgttccgcaatatgggattcttttttttgatagttatggatatgcttatagcttgctaccgttgttgttgattgttgagtatgactgcctttggacttctcttgtggtaacatgtggttctagctaccaatcaatatctctgatttttttaggaatcactagagttccaaaccttggtactgcagtttctactaaaagagcagggatgagtaaggatacggttattaatttggacgtatctcatcacagagcggttgcagtggtgaggttgctaagaatcgagaagggaaaagcatttgtagaccttttgaatgagaaagcaaatgattctggagagaaagagataggatatgtggagaggacgctaggtttcagcacacgctatttggatgacagggacataagactggttactgtcatagttgctggaactgtgcgttggaaacgctacctggattatctaatcatgtcgctatgcagtgaggagaaggttttcagggagatggagccactgctccttcagatattgagaattggcttttttgaaattctcaagcttgatgtacctgcttatgctgctgttgacgagaatgtaaagcttgctaaagtagctttaaggcctggtgctgggaatatggtgaatgcaattctgcgtaaacttgtattgctaaaggagacagactctcttcctcttccaaagatagaaggcgatgatcgtgcccaagctcgtgctctttctataatttattctcatcctgtttggatggtgagaagatggatacgatttcatggaaaagatgaagctctaagattgatgaattggaataacagtgatcctcatttcagtctaagggtgaacacatcaaaaggctatactagggctgaccttgtaaaacgattggaaagtttacaggttcattatgaagaatcggttatggatggatttgtccgcattcaggaagggatgcaggcagtcctacaagctggattactgaaagatggcatttgtgctgtgcaagatgagagtgcaggccttgtagtgtctgtggtcgatccacaacctggggaaacaattgttgattgctgtgctgcacctggtggaaagactctttttatggcatcacggttgtcaggagaagggaagatacaggctctggacataaacaaaggtcgcttgagaatactcatggatgcagcaaagttacacggtctagatgatataatcaccgacatccatgctgatcttcgactatatgctaaggaaaccactgctaaatatgacaaagtattgttggatgctccatgctctgggctgggagtcctttccaagagggcggacttacgttggaatagacagtttgaagatttggaagagttgatatgtttacaagacgagcttcttgattcggttggtaaggcctggtggtatactaatctacagtacgtgttcaattga

SEQ ID NO: 20527 - protein, 676 aa, Sorghum bicolor
  misc_feature: Ceres ANNOT ID no. 8654742
  misc_feature: Down-regulated in shoot tissues in response to salicylic acid treatment
  misc_feature (541)..(642): SWISSPROT Homolog: EC 2.1.1.29 tRNA (cytosine-5-)-methyltransferase
  misc_feature (272)..(416): Pfam ID: NusB Pfam Description: NusB family
  misc_feature (463)..(672): Pfam ID: Nol1_Nop2_Fmu Pfam Description: NOL1/NOP2/sun family
MALQPLCRTGCQDVDHGCDMRGDTIDDEVEAKDGRSPNMVILTGRTHRIRHVKSLKTSLLQKWLNELLTSIVTKEYRRSINKRSRSDRGAGHHTSLSSRQQTALPPWAWKERAKPRQRPKSQHMEGVAPAVSLFRPRASARPTIVLAENSGSARRSPGAGRSRGVSRLSPEMSPGGASRSNCLDVLCFCLIFVPQYGILFFDSYGYAYSLLPLLLIVEYDCLWTSLVVTCGSSYQSISLIFLGITRVPNLGTAVSTKRAGMSKDTVINLDVSHHRAVAVVRLLRIEKGKAFVDLLNEKANDSGEKEIGYVERTLGFSTRYLDDRDIRLVTVIVAGTVRWKRYLDYLIMSLCSEEKVFREMEPLLLQILRIGFFEILKLDVPAYAAVDENVKLAKVALRPGAGNMVNAILRKLVLLKETDSLPLPKIEGDDRAQARALSIIYSHPVWMVRRWIRFHGKDEALRLMNWNNSDPHFSLRVNTSKGYTRADLVKRLESLQVHYEESVMDGFVRIQEGMQAVLQAGLLKDGICAVQDESAGLVVSVVDPQPGETIVDCCAAPGGKTLFMASRLSGEGKIQALDINKGRLRILMDAAKLHGLDDIITDIHADLRLYAKETTAKYDKVLLDAPCSGLGVLSKRADLRWNRQFEDLEELICLQDELLDSVGKAWWYTNLQYVFN

SEQ ID NO: 20528 - DNA, 2100 bp, Sorghum bicolor
  misc_feature: Ceres ANNOT ID no. 8654838
  misc_feature: Down-regulated in shoot tissues in response to methyl jasmonate treatment
  misc_feature: Down-regulated in root tissues in response to methyl jasmonate treatment
  misc_feature: Up-regulated in root tissues in response to salicylic acid treatment
  misc_feature: Encodes the peptide sequence at SEQ ID NO 20529
atggcgacggacacggagaccttcgcttttcaggctgagatcaaccagctgctctccctcatcatcaacaccttctactccaacaaggagatcttcctccgcgagctcatctccaactcatccgatgcgttggacaagatcaggttcgagagcctcactgacaagagcaagctcgatgcgcagccggagctgttcatccacattgtcccagacaaggcctcgaacacgctctccatcatcgacagtggcatcggcatgaccaagtccgacctcgtcaacaacctcggtaccatcgccaggtccgggaccaaggagttcatggaagcccttgctgccggcgctgatgtgtccatgattggccagttcggtgtcggtttctactctgcctacctcgtcgccgagagagtcgtcgtgaccaccaagcataacgatgacgagcagtacgtctgggaatcccaggccggtgggtcgttcactgttacgcgtgacacatccggggagcagcttggcaggggtactaagatcacactgttcctcaaggacgatcagctggaataccttgaggagcgtcgcctcaaggatctggtcaagaagcactctgagttcatcagttaccccatctccctgtggactgagaaaacaactgagaaggaaatttctgatgatgaagatgaggaagagaagaaagatgctgaggagggcaaggttgaggatgttgacgaggagaaggaagagaaggaaaaaaagaaaaagaagatcaaggaggtttctcatgagtggtcgttgatcaacaagcagaagcccatttggatgaggaagccagaagagatcacgaaggaagaatatgctgccttctacaagagcttgacaaatgactgggaggagcatctggctgtgaagcacttctctgtggagggtcagctggagttcaaggctgttctctttgttcctaagagggccccctttgatctctttgacaccaagaagaagcaaaacaacatcaagctctatgtgcgcagggtgttcatcatggacaactgcgaggagctgatccctgagtggctgagcttcgttaagggtattgttgactctgaggacctccccctgaatatctctcgtgagactcttcagcagaacaagatcctgaaggtgatccggaagaaccttgtgaagaagtgtgttgagctcttctttgagattgctgagaacaaggaggactacaacaagttttatgaggctttctccaagaacctcaagcttggcatccatgaggactcacagaacaggaccaagatcgccgagcttctgagataccactccaccaagagtggtgatgagctgaccagcctcaaggactacgtgaccaggatgaaggagggacagaacgacatctattatatcactggtgagagcaagaaggcagtggagaactcccccttcctggagaagctgaagaagaggggctatgaggtcttgtacatggttgatgccattgatgagtatgctgttggtcagctcaaggagtttgagggcaagaagcttgtctctgccaccaaggagggtctgaagcttgacgagaccgaggacgagaagaagaggaaggaggagctgaaggaaaagtttgaggggttgtgcaaagtcatcaaggaggttctgggtgacaaggttgagaaggtggtggtgtctgaccgtgttgtggactcaccgtgctgtcttgtcactggtgagtatggctggactgccaacatggagaggatcatgaaggcgcaggctctgagggactcgagcatggcgggctacatgtcgagcaaaaagactatggagatcaacccagagaaccctatcatggatgagctccgcaagcgcgctgaggccgacaagaatgacaagtcggtcaaggatctcgtgatgctgctgttcgagacttctctcctgacctctggcttcagcctggatgaccccaacaccttcgggacccggatccaccgcatgctcaagctcggtctaagcatcgatgaggacgagtctgctgaggctgaagctgagatgcctccactggaggacgacgccggtgaaagcaagatggaggaggtcgactaa

SEQ ID NO: 20529 - protein, 699 aa, Sorghum bicolor
  misc_feature: Ceres ANNOT ID no. 8654838
  misc_feature: Down-regulated in shoot tissues in response to methyl jasmonate treatment
  misc_feature: Down-regulated in root tissues in response to methyl jasmonate treatment
  misc_feature: Up-regulated in root tissues in response to salicylic acid treatment
  misc_feature (185)..(699): Pfam ID: HSP90 Pfam Description: Hsp90 protein
  misc_feature (28)..(182): Pfam ID: HATPase_c Pfam Description: Histidine kinase-, DNA gyrase B-, and HSP90-like ATPase
MATDTETFAFQAEINQLLSLIINTFYSNKEIFLRELISNSSDALDKIRFESLTDKSKLDAQPELFIHIVPDKASNTLSIIDSGIGMTKSDLVNNLGTIARSGTKEFMEALAAGADVSMIGQFGVGFYSAYLVAERVVVTTKHNDDEQYVWESQAGGSFTVTRDTSGEQLGRGTKITLFLKDDQLEYLEERRLKDLVKKHSEFISYPISLWTEKTTEKEISDDEDEEEKKDAEEGKVEDVDEEKEEKEKKKKKIKEVSHEWSLINKQKPIWMRKPEEITKEEYAAFYKSLTNDWEEHLAVKHFSVEGQLEFKAVLFVPKRAPFDLFDTKKKQNNIKLYVRRVFIMDNCEELIPEWLSFVKGIVDSEDLPLNISRETLQQNKILKVIRKNLVKKCVELFFEIAENKEDYNKFYEAFSKNLKLGIHEDSQNRTKIAELLRYHSTKSGDELTSLKDYVTRMKEGQNDIYYITGESKKAVENSPFLEKLKKRGYEVLYMVDAIDEYAVGQLKEFEGKKLVSATKEGLKLDETEDEKKRKEELKEKFEGLCKVIKEVLGDKVEKVVVSDRVVDSPCCLVTGEYGWTANMERIMKAQALRDSSMAGYMSSKKTMEINPENPIMDELRKRAEADKNDKSVKDLVMLLFETSLLTSGFSLDDPNTFGTRIHRMLKLGLSIDEDESAEAEAEMPPLEDDAGESKMEEVD

SEQ ID NO: 20530 - DNA, 3141 bp, Sorghum bicolor
  misc_feature: Ceres ANNOT ID no. 8654888
  misc_feature: Down-regulated in shoot tissues in response to salicylic acid treatment
  misc_feature: Encodes the peptide sequence at SEQ ID NO 20531
atggaagtgggtaaacacacagtcattgctgggccaaccccagacgtacttagcccacgaaacggccaaagccggcccagcccacggtgtaaccctagatatatatatgcagcagcagtgttgccgcatccacatccccgtcccagtcggttgtccctcctgcaggtcgccgccgctcgctctctctcttccctgaccaccgcgccaccgctccccgagtctcgacaaaccgtctacgcgaccggcgcccctccctccccttcggtgtcgccgtctgcatcctcctccggtcttcccaagagcttgattctcgtagaagctaaagcagcagccggaaccatggcatcccgtttctggggacagggggatagtgagtctgaggaggaggaggaagaagtcgagtcagaacagggcagtgatagtgatgatgatggaggccgtggtggtgcaggacgcagtcttggaaaccgctatttgaagaaccaagaagacgacagcgatgagtctgatacagggcaccgtgtgatccgctctctgagggacaagcgcaatgaggagatgagatctattgttgatcagatgcgtaatgcaatgaagatcaatgactgggttagcttgcaggagagttttgagaagcttaacaaacatcttgaaaaggttgttcgtgtcaatgaatctactgaggttccaaagatgtatatcaaggctcttgtgttgctggaggacttccttgctgaagcccttgcaaacaaggaggccaagaagaagatgagcagcagcaatgcgaaggcactgaatgcgatgaagcaaaagctcaagaagaacaacaagcagtacgaagaacagatccagaagtgcagggagcatccagagagttttgatgatgaacctgcggatgataaagatatggatgacgatgatgacgatgatgctgatgagagtgatgcagagattgaagatcctgataaaatagctatgtcagagtcagaagaggaacctgacgaagatgatgatgacaaggatggttgggaaaagaagaggagtaagaaagataagctaatggataagcagttcttgaaagatccaagtgaaatcacatgggatattgtcgataataaactcaaggagattgtagcatcaaggggaaagaaaggtactggaaggatagagcgtgttgagcagttaacatttttgacccgtgtggccaaaacaccagctcagaagcttgaaatccttttccatgtgatttctgcgcagtttgatgtcaaccctagtctacttgggcatatgccagtcaatgtgtggaagaagtgtgtcaataatatgctgcttgtgcttgatatactccagcagtatcctaacattgtagtagacacctcatttgagcctgatgagaaggaaactcaaaagggtgcagactataatggaactatacatgttgttggtgacctggttgcattcctcgagagactggactctgaatttttgaagaccttgcagtgcacagatccgtacacaaaagattatgttcagaggcttagagaggaacccctgtttttggttgttgctcagaatgtccaagattaccttgagagggttgggaacctcaaagctgctgccaaggttgcactgcgccgtgttgaactggtttactacaaaccccaagaagtgtatgatgcaatgagaaaacttgcagagcagcctgaggacagtttggatgatgatgatgcagaggctggtgatgaacatcaggcaatagatgacaacagaggaccatcaccatttgttgtgattccagaggttgtgccgaggaagcctacttttccagagagtggtagaactttgatggatggattgatgtccttaatttacaagtatggagatgaaaggaccaaagcccgtgcaatgctgtgtgacatatatcaccatgcgatctctgatgagttttcagtggctcgtgacttgcttttaatgagtcatttgcaagatggtgttcagctcatggacatatcatcacagattttgttcaatagggtcatggcccagttggggctgtgtgctttcagggctggtttgataaatgaagcccatggatgcttgaccgagctctactctactgggagggtgaaagaattgcttgcacaaggtgtgcaacaaagccgataccatgaaaaaactcctgaacaggaaagacttgagaggagaaggcaaatgccttaccatatgcatataaacctggaacttttggaagccacacacttgatttgtgcgatgctgattgaagtccccaatatggctgccagcacttatgacaagcggaggcctatgagcaaaacattccgacggcttcttgaagtgagtgaaaggcagacgtttgttgggccaccagagaacgtgagggaccatgtaatggctgccacaagagccctcaacaagggtgatcaccaaaaggctttcagtgtcattaattcactggagatctggaagcttttgaggaacagagatcatgttcttgagatgctgaagcttaagatcaaggaggaagctcttagaacctatctcttctcatattcgtcttgctacgagtccttgagccttaaccagctcaccaccatgtttgatctcagcgagcagcatgctcacagcattgttagcaagatgatgatgcatgaagagcttcatgctagttgggaccagccaacaaaatgcattgtattccacagtgtggatcaaactaggcttcaggggctactattccagatggcagataagctctcggtccttgtggagagcaatgagagggcatacgaggcaagaactggtggtactcttgagggagtgccgcccaggcgcagaggtgatggtcaggactcatccaatatggggaagtggcaggagaactttgtctcatcacaggggcggcagggtggtggcaatcggtttggatactctggtagaggtggaggatctggtcaaagtggtggccaccagagggacaggggcaaccagggttcccgtgggggttacggtggcggttcacggtttcaggatggaaggggtcgcaaccagtctggttcatcagccagaggtggtgatggtggtgctcgcatggtgaacctaaacagggttggtagagtttag

SEQ ID NO: 20531 - protein, 1046 aa, Sorghum bicolor
  misc_feature: Ceres ANNOT ID no. 8654888
  misc_feature: Down-regulated in shoot tissues in response to salicylic acid treatment
  misc_feature (157)..(772): Pfam ID: eIF-3c_N Pfam Description: Eukaryotic translation initiation factor 3 subunit 8 N-terminus (eIF3c_N)
  misc_feature (778)..(908): Pfam ID: PCI Pfam Description: PCI domain
  misc_feature (909)..(1046): Pfam ID: eIF-3c_C Pfam Description: Eukaryotic translation initiation factor 3 subunit 8 C-terminus (eIF3c_C)
MEVGKHTVIAGPTPDVLSPRNGQSRPSPRCNPRYIYAAAVLPHPHPRPSRLSLLQVAAARSLSSLTTAPPLPESRQTVYATGAPPSPSVSPSASSSGLPKSLILVEAKAAAGTMASRFWGQGDSESEEEEEEVESEQGSDSDDDGGRGGAGRSLGNRYLKNQEDDSDESDTGHRVIRSLRDKRNEEMRSIVDQMRNAMKINDWVSLQESFEKLNKHLEKVVRVNESTEVPKMYIKALVLLEDFLAEALANKEAKKKMSSSNAKALNAMKQKLKKNNKQYEEQIQKCREHPESFDDEPADDKDMDDDDDDDADESDAEIEDPDKIAMSESEEEPDEDDDDKDGWEKKRSKKDKLMDKQFLKDPSEITWDIVDNKLKEIVASRGKKGTGRIERVEQLTFLTRVAKTPAQKLEILFHVISAQFDVNPSLLGHMPVNVWKKCVNNMLLVLDILQQYPNIVVDTSFEPDEKETQKGADYNGTIHVVGDLVAFLERLDSEFLKTLQCTDPYTKDYVQRLREEPLFLVVAQNVQDYLERVGNLKAAAKVALRRVELVYYKPQEVYDAMRKLAEQPEDSLDDDDAEAGDEHQAIDDNRGPSPFVVIPEVVPRKPTFPESGRTLMDGLMSLIYKYGDERTKARAMLCDIYHHAISDEFSVARDLLLMSHLQDGVQLMDISSQILFNRVMAQLGLCAFRAGLINEAHGCLTELYSTGRVKELLAQGVQQSRYHEKTPEQERLERRRQMPYHMHINLELLEATHLICAMLIEVPNMAASTYDKRRPMSKTFRRLLEVSERQTFVGPPENVRDHVMAATRALNKGDHQKAFSVINSLEIWKLLRNRDHVLEMLKLKIKEEALRTYLFSYSSCYESLSLNQLTTMFDLSEQHAHSIVSKMMMHEELHASWDQPTKCIVFHSVDQTRLQGLLFQMADKLSVLVESNERAYEARTGGTLEGVPPRRRGDGQDSSNMGKWQENFVSSQGRQGGGNRFGYSGRGGGSGQSGGHQRDRGNQGSRGGYGGGSRFQDGRGRNQSGSSARGGDGGARMVNLNRVGRV

SEQ ID NO: 20532 - DNA, 2223 bp, Sorghum bicolor
  misc_feature: Ceres ANNOT ID no. 8655009
  misc_feature: Up-regulated in shoot tissues in response to salicylic acid treatment
  misc_feature: Encodes the peptide sequence at SEQ ID NO 20533
atggataatcttgttctgccaaacaaagatgaagcgctatcagtggatgctcgccaagaaattgacttgaaggttggagtagcatttactcgatttcagactcgatatttccaaggaaaatatggaaaccttgattcaagagtgatttcgtatggtccatgccaaacacctacacttggattctgtgtacaacgctatcagcaaatcaccacattcaaaccagagaaattctggtccttgaaaacgtatattatcaaagatagtgatgaaatacagctagaatgggaccggaagaaactttttgattttgatgtcactgtaatgttccagaagatggtcatcagtgatggctctctaaaagtagcagatgtgtcagtgaaggaggagtgcaaaacccgtccatctggccttaatacagttaatatgcttaaggttgcatcaagtgcgcttggtattggacctcagacagccatgcacttggcggagcggctgtacactcaaggattcatcagttatcctcgtacagagagcacggcatatccatcatcatttgattttcgaggtgcacttgctgcactattaaataatcctctatggtccaatgatgtccggacattactggatgctggttttgttaagcctcgtcaaggtcatgatgctggggaccatcctccaatcactccaatgaggtcagcaacagaagcagctctgggaactgatgcttggaggctgtaccaatacatatgccagcacttcattggaactgttagtcctgattgtagatatacaaggactgccattgagttcacttcaggtggagaaactttccactgtgttgggtatcgagtcacttctaaaggatttacttctatcatgccatggctggctatcagtgagaatagtcttcctgcatttaaaaagggagactctgttagtattcataaggttgacatatatgagggaagcactacaccacctgattacctcactgaaagtgaattgatctctctcatggagaagaatggcataggtacagatgcatcaattcctgtacatataaacaacatttgtgaacgtaattatgttcaggtgaattctggaagaaggttagtaccgacacccctgggaactacattgataagagggtatcagtgtattgatgctgatctctgcttgccagatatcagaagctttattgagcaacagattactctaattgcaaaaggcaaagctgatcatcttcgagttattcaacatgttattcagcaatttatgaaaaagtattcttactttgtgaaaaagattgaaaacatggatgcgctgtttgaggcacagttttcacctttggcagactctggccgcttactaagcaagtgtggaaaatgtggtcggtatatgaagtacatttccactcagccaatgaggttgtattgtataacttgtgaggatgtctattatcttcctcagaatggttcaattaagctttacaaagaaatcatatgccctcttgatggttttgagttgcttctgttctcgatggtgggacctgatgcaaaatctttcccattgtgccctttttgctataattgtcctccatttgaaggcatcgacaaactctttggtgctctcaagcttgatgacactggcaaggttgggaaaggggctggcatgccatgcttcctttgccctcacccaacatgcaagcaatctatgatcactcagggagtttgtgcttgtcctgagtgtagtggtaccctgattcttgatccagttagtgcacccaaatggcggctttactgcaacatgtgtaattgcattgtattactcccacatgctgctcacaggatcaccactacagataaaaaatgcctaacatgtgaatctactatcattgaagttgatttcaacaagaaaaccacccctcttcaagatggagctacattgcatgagggctgtatcttgtgtgatgatctgttgcattcactgattgaaatgaagcatggtaaatcattctttatgcggagaggtagaggcagaggcagagggagaggccggggcagagggagcagtcgtggcagaggaagactagggaactcaaggtctgctttcttcttcttctttaactgccagcaggactctgcccagcttttttatccttacattctaagtcatgcttacgcaggaaagcaaccatcatctgcagctttgtcttgtgttcagtaa

SEQ ID NO: 20533 - protein, 740 aa, Sorghum bicolor
  misc_feature: Ceres ANNOT ID no. 8655009
  misc_feature: Up-regulated in shoot tissues in response to salicylic acid treatment
  misc_feature (1)..(541): SWISSPROT Homolog: EC 5.99.1.2 DNA topoisomerase
  misc_feature (4)..(406): Pfam ID: Topoisom_bac Pfam Description: DNA topoisomerase
MDNLVLPNKDEALSVDARQEIDLKVGVAFTRFQTRYFQGKYGNLDSRVISYGPCQTPTLGFCVQRYQQITTFKPEKFWSLKTYIIKDSDEIQLEWDRKKLFDFDVTVMFQKMVISDGSLKVADVSVKEECKTRPSGLNTVNMLKVASSALGIGPQTAMHLAERLYTQGFISYPRTESTAYPSSFDFRGALAALLNNPLWSNDVRTLLDAGFVKPRQGHDAGDHPPITPMRSATEAALGTDAWRLYQYICQHFIGTVSPDCRYTRTAIEFTSGGETFHCVGYRVTSKGFTSIMPWLAISENSLPAFKKGDSVSIHKVDIYEGSTTPPDYLTESELISLMEKNGIGTDASIPVHINNICERNYVQVNSGRRLVPTPLGTTLIRGYQCIDADLCLPDIRSFIEQQITLIAKGKADHLRVIQHVIQQFMKKYSYFVKKIENMDALFEAQFSPLADSGRLLSKCGKCGRYMKYISTQPMRLYCITCEDVYYLPQNGSIKLYKEIICPLDGFELLLFSMVGPDAKSFPLCPFCYNCPPFEGIDKLFGALKLDDTGKVGKGAGMPCFLCPHPTCKQSMITQGVCACPECSGTLILDPVSAPKWRLYCNMCNCIVLLPHAAHRITTTDKKCLTCESTIIEVDFNKKTTPLQDGATLHEGCILCDDLLHSLIEMKHGKSFFMRRGRGRGRGRGRGRGSSRGRGRLGNSRSAFFFFFNCQQDSAQLFYPYILSHAYAGKQPSSAALSCVQ

SEQ ID NO: 20534 - DNA, 1005 bp, Sorghum bicolor
  misc_feature: Ceres ANNOT ID no. 8655062
  misc_feature: Up-regulated in shoot tissues in response to methyl jasmonate treatment
  misc_feature: Encodes the peptide sequence at SEQ ID NO 20535
atggtgcgtgcggtctcgccgcctatcttctgcttgtgctttcggatttccattgatccaatctcttccatgtggaaaaaacctgggatgtttcggatattctttggttatatttcaatcttgtttcgtggatcttgggggcacatgcttatgatgcttatgatgttaacttgctgcatatctttgtatgattcatgtaatgtgctaagagttcgacttacaaatctgcaggccccgaagcgaggtggcagggcgcctgtgccggccaagaagaagacggataaagtggtgaaccctctgttcgagaagaggccgaagcagttcggcatcggcggcgcgttgccgcccaagaaggacctgcaccggttcgtcaagtggcccaaggtcgtccgcatccagcgccagcgccgcatcctcaagcagcgcctcaaggtgccaccggcgctcaaccagttcacccgcaccctcgacaagaacctcgctaccaacctgttcaagatgcttctcaaataccggcctgaagacaaggctgccaagaaggagaggcttctgaagagggctcaggctgagactgaaggaaaaactgttgaagccaagaaaccaattgttgttaagtatggccttaaccatgtgacttacctcattgagcagaacaaggctcagcttgttgtcatcgctcatgatgtggatccgattgaactggttgtgtggcttccagccctgtgcaggaagatggaggtcccttactgcattgttaaaggaaaggctcgccttggatcgattgttcacaagaagactgcatcagtcttgtgtctgaccactgtcaagaacgaggacaagcttgagttcagcaagatcttggaggctattaaggcaaacttcaacgacaagttcgatgaggtgaggaagaagtggggaggtggtatcatgggctccaagtcgcaggccaagaccaaggctagggaaaagctgatcgccaaggaggctgctcagcggatgacctag

SEQ ID NO: 20535 - protein, 334 aa, Sorghum bicolor
  misc_feature: Ceres ANNOT ID no. 8655062
  misc_feature: Up-regulated in shoot tissues in response to methyl jasmonate treatment
  misc_feature (189)..(284): Pfam ID: Ribosomal_L7Ae Pfam Description: Ribosomal protein L7Ae/L30e/S12e/Gadd45 family
MVRAVSPPIFCLCFRISIDPISSMWKKPGMFRIFFGYISILFRGSWGHMLMMLMMLTCCISLYDSCNVLRVRLTNLQAPKRGGRAPVPAKKKTDKVVNPLFEKRPKQFGIGGALPPKKDLHRFVKWPKVVRIQRQRRILKQRLKVPPALNQFTRTLDKNLATNLFKMLLKYRPEDKAAKKERLLKRAQAETEGKTVEAKKPIVVKYGLNHVTYLIEQNKAQLVVIAHDVDPIELVVWLPALCRKMEVPYCIVKGKARLGSIVHKKTASVLCLTTVKNEDKLEFSKILEAIKANFNDKFDEVRKKWGGGIMGSKSQAKTKAREKLIAKEAAQRMT

SEQ ID NO: 20536 - DNA, 1677 bp, Sorghum bicolor
  misc_feature: Ceres ANNOT ID no. 8655078
  misc_feature: Down-regulated in root tissues in response to methyl jasmonate treatment
  misc_feature: Down-regulated in shoot tissues in response to salicylic acid treatment
  misc_feature: Encodes the peptide sequence at SEQ ID NO 20537
atggcgcggcggaaggacggcggcccgccgcggtggttcgcgccgctcgagtgcgggggcggccgcgtccccggcgcacccacgctgctctacctgcccggaattgatggaattggtttaggacttgtacggcaccatgagagattggcagagatgtttgaggtgtggtgcttgcacataccagttgaagatcgaacgtcctttgaaggattggttgagtatgtggagaggacagtaaaatcagagagctcaagagcaccagatagaccagtctatcttgttggagaatcagtaggatcgtgcatcgctctagctgtggctgcgcgaaacccagacatagacctggtattgatcctagtaaacccagggaacttcatgaagatgccatcaacttttgttggacctggcttctctctacaagaagctggtcagacattatcagagatcacatccaatttgttggattcccttatgattttggttgatattctgacaaaggaatctattgtttgtaagttgaaaatgttgaagacagcatcatcatttgtcaattcccgtttacatgcagtcaaggcccagactttggtgctagccagtggaaatgatgaactgttaccaagcagccaagaggctgagaggctccgtggtgctctagagaaatgcagaacacgtcttttcagagataatggccacaaaatcttactggaagccgattttgatctcgcaacaaccattaagggagctgggtactaccgccgcaccaggaagacagacttcgtttcagactacctacctcctactccagatgagttccaacaagctatcaatcacgacaggatcctaaagcttgtcactgacccagtgatgctatcaacactgcctgacgggaagatagtgaggggcctggcagggcttccaagggagggccctgccgtgctggttgggtaccacatgctcatggggtttgagcttggacctatggtcacagggatcctgagcagcaccggaatccacatccggggcttggctcaccccttcatgttcgacaagagcacggagctgctgatgcccgattcggcgcacttcgacctgcaccggatcatgggggcggtgccggtcacaggtgccaatttctacaagctgcttgcagataaggagtttgtgctgctgtatccaggaggtgcgcgggaagcgcttcacagaaagggagaggagtacaagttgttttggccggagcagcctgagttcgtgagaatggcatccaggtttggagcaacgatcataccatttggagtagtgggagaagatgatatatgtcatgttcccttctatgatatgctcgacaacgccttaaaccgcgatggactgaagctaaggactgattccatgggagacgtaaaagatcaaagaatgcaccccctagtgcttgcgcctaagttaccagggcggttttacttcgcctttggaaagcctattgaaacaagagggagagagaaaggactacgagacaaagaggaggcgcagcgcctctatttgcaagtcaaatctgaggtggagagctgtatcaactatctgaaggagaaaagggagctggacccctacaggagtatactgcccaggcttctgtaccaagcagttcatggtctcgatgcagaaatacccacatttgaaccgtga

SEQ ID NO: 20537 - protein, 558 aa, Sorghum bicolor
  misc_feature: Ceres ANNOT ID no. 8655078
  misc_feature: Down-regulated in root tissues in response to methyl jasmonate treatment
  misc_feature: Down-regulated in shoot tissues in response to salicylic acid treatment
MARRKDGGPPRWFAPLECGGGRVPGAPTLLYLPGIDGIGLGLVRHHERLAEMFEVWCLHIPVEDRTSFEGLVEYVERTVKSESSRAPDRPVYLVGESVGSCIALAVAARNPDIDLVLILVNPGNFMKMPSTFVGPGFSLQEAGQTLSEITSNLLDSLMILVDILTKESIVCKLKMLKTASSFVNSRLHAVKAQTLVLASGNDELLPSSQEAERLRGALEKCRTRLFRDNGHKILLEADFDLATTIKGAGYYRRTRKTDFVSDYLPPTPDEFQQAINHDRILKLVTDPVMLSTLPDGKIVRGLAGLPREGPAVLVGYHMLMGFELGPMVTGILSSTGIHIRGLAHPFMFDKSTELLMPDSAHFDLHRIMGAVPVTGANFYKLLADKEFVLLYPGGAREALHRKGEEYKLFWPEQPEFVRMASRFGATIIPFGVVGEDDICHVPFYDMLDNALNRDGLKLRTDSMGDVKDQRMHPLVLAPKLPGRFYFAFGKPIETRGREKGLRDKEEAQRLYLQVKSEVESCINYLKEKRELDPYRSILPRLLYQAVHGLDAEIPTFEP

SEQ ID NO: 20538 - DNA, 777 bp, Sorghum bicolor
  misc_feature: Ceres ANNOT ID no. 8655065
  misc_feature: Up-regulated in shoot tissues in response to methyl jasmonate treatment
  misc_feature: Encodes the peptide sequence at SEQ ID NO 20539
atggccccgaagcgaggtggcagggcgcctgtgccggccaagaagaagacggataaagtggtgaaccctctgttcgagaagaggccgaagcagttcggcatcggcggcgcgttgccgcccaagaaggacctgcaccggttcgtcaagtggcccaaggtcgtgcgcatccagcgccagcgccgcatcctcaagcagcgcctcaaggtgccaccggcgctcaaccagttcacccgcaccctcgacaagaacctcgctaccaaccttttcaagatgcttctcaaataccggcctgaagacaaggctgccaagaaggagaggcttctgaagagggctcaggctgagactgaaggaaaaactgttgaagccaagaaaccaattgttgttaagtatggccttaaccatgtgacttacctcattgagcagaacaaggctcagcttgttgtcatcgctcatgatgtggatccgattgaactggttgtgtggcttccagccctgtgcaggaagatggaggtcccttactgcattgttaaaggaaaggctcgccttggatcgattgttcacaagaagactgcatcagtcttgtgtctgaccactgtcaagaacgaggacaagcttgagttcagcaagatcttggaggctattaaggcaaacttcaacgacaagttcgatgaggtgaggaagaagtggggaggtggtatcatgggctccaagtcgcaggccaagaccaaggctagggaaaagctgatcgccaaggaggctgctcagcggatgacctag

SEQ ID NO: 20539 - protein, 258 aa, Sorghum bicolor
  misc_feature: Ceres ANNOT ID no. 8655065
  misc_feature: Up-regulated in shoot tissues in response to methyl jasmonate treatment
  misc_feature (113)..(208): Pfam ID: Ribosomal_L7Ae Pfam Description: Ribosomal protein L7Ae/L30e/S12e/Gadd45 family
MAPKRGGRAPVPAKKKTDKVVNPLFEKRPKQFGIGGALPPKKDLHRFVKWPKVVRIQRQRRILKQRLKVPPALNQFTRTLDKNLATNLFKMLLKYRPEDKAAKKERLLKRAQAETEGKTVEAKKPIVVKYGLNHVTYLIEQNKAQLVVIAHDVDPIELVVWLPALCRKMEVPYCIVKGKARLGSIVHKKTASVLCLTTVKNEDKLEFSKILEAIKANFNDKFDEVRKKWGGGIMGSKSQAKTKAREKLIAKEAAQRMT

SEQ ID NO: 20540 - DNA, 1878 bp, Sorghum bicolor
  misc_feature: Ceres ANNOT ID no. 8655140
  misc_feature: Down-regulated in shoot tissues in response to aminocyclopropane carboxylic treatment
  misc_feature: Down-regulated in shoot tissues in response to salicylic acid treatment
  misc_feature: Encodes the peptide sequence at SEQ ID NO 20541
atgtccgccaggttgctccggcgagttctccaggagcgtgaggccgccccgctggacactgacgtcgccgacgacgaccagccggcggaggacgaggcctctcctccacgctcctccgcgcggaacctcttcgatctcctcgacgacggcaacggcgacggcgacgaagaagataaagaggaagatgaaacagaaataattcaagctttgagctatacagaacagaaacattctgtgcaaaagaaggcaaatgttgttcctgaaacaaacaaaaaatcaaagaaaaagaaaaaaaagagcaaggcagagccatcatcaacaaagtcaaaggatgcacagtcgttggattcaattctggaagctattgaaaacaatccaatacaacaaagatcttatcagagtgacagggcagctggaaaggaaattgagacaaatgaagctactcatggggcatcctgtgttcttgcaatagaccccagacatctaaagggtgaaaatgagatgagacgcatttttggatcaaaggtagtggattcatttgaaaatcaacggaatatgccaagcagttcaaggcaagtacgtggtgctaggcgtgttgtccataatccaagaaaaactcttcttgtgtctccacctagctactggccaccatgggataagtcgatatcaatggatcttcttgagatgaagaatggtttgaattacttcaggtacacatatgatccttcagtcagccatgtgcaagaattatttgaagctgccaaagcagcaaatgatctcaatgctattgcagctatattagggaaatatccatatcatccagaatcactgttgacatttgctgaacttttcaaatattctggagagcatcaatcatcagcagatgcagtggagaaatgtctatttgcattggagtgtgcttggcatcctttatttagcccacttcagggcaactaccagttgaaattcagccatgacacaaataagccactgtttacagcactctttagtcacatgaaaaatctggataggcgtggctgccaccggtctgctttagaggtctgcaagtttctgttgtcactggactctgatgatccaaagggtgctctattttgcattgattacttcgctctaagatcacaacagtacaaatggctggagcaatttgcagaagagtaccagtgtgataactccttgtggttatttccaaatttttcattttctcttgctattgcacggttttaccttgagcgcgatgcagcatcagagtgttctgatgatgctgacaagtcaacatctcttgatctcatgaagcaagctcttatgcttcatcctatggtgcttcgcaagatagttgacaaggctcctctgaaagactcatcatggacccaaatactcagaaatgtgttctttggatcagcaaaaccgggaagcccttcacttgagcatatgatcaatatatatgtggaacgtcattatatcatgtggagattcccagaactgcagaacttgctgaaagaggctgctcttttggtgattgaatcactaaagcaagataacagggaagcccaggactgggcatgtcttagaaaggaggcattctcatcagagaagaatgagtactctcatctgcttgtttcagacttctctgacacaacgccgtccctcccaccagaggaactacgaccattcatggtcggtccaggaatggtgcatgagatgccacctgttgaacaagaagctggacctgagaggctccgtgctccccgtgaagtcgctgggcgtaatcctgcggtagtcttccttgaatcactgctcccatgggttgactatggtgacaatcatcacgatgcgaacaacgacaacgacgacgattga

SEQ ID NO: 20541 - protein, 625 aa, Sorghum bicolor
  misc_feature: Ceres ANNOT ID no. 8655140
  misc_feature: Down-regulated in shoot tissues in response to aminocyclopropane carboxylic treatment
  misc_feature: Down-regulated in shoot tissues in response to salicylic acid treatment
MSARLLRRVLQEREAAPLDTDVADDDQPAEDEASPPRSSARNLFDLLDDGNGDGDEEDKEEDETEIIQALSYTEQKHSVQKKANVVPETNKKSKKKKKKSKAEPSSTKSKDAQSLDSILEAIENNPIQQRSYQSDRAAGKEIETNEATHGASCVLAIDPRHLKGENEMRRIFGSKVVDSFENQRNMPSSSRQVRGARRVVHNPRKTLLVSPPSYWPPWDKSISMDLLEMKNGLNYFRYTYDPSVSHVQELFEAAKAANDLNAIAAILGKYPYHPESLLTFAELFKYSGEHQSSADAVEKCLFALECAWHPLFSPLQGNYQLKFSHDTNKPLFTALFSHMKNLDRRGCHRSALEVCKFLLSLDSDDPKGALFCIDYFALRSQQYKWLEQFAEEYQCDNSLWLFPNFSFSLAIARFYLERDAASECSDDADKSTSLDLMKQALMLHPMVLRKIVDKAPLKDSSWTQILRNVFFGSAKPGSPSLEHMINIYVERHYIMWRFPELQNLLKEAALLVIESLKQDNREAQDWACLRKEAFSSEKNEYSHLLVSDFSDTTPSLPPEELRPFMVGPGMVHEMPPVEQEAGPERLRAPREVAGRNPAVVFLESLLPWVDYGDNHHDANNDNDDD

SEQ ID NO: 20542 - DNA, 2244 bp, Sorghum bicolor
  misc_feature: Ceres ANNOT ID no. 8655310
  misc_feature: Up-regulated in shoot tissues in response to methyl jasmonate treatment
  misc_feature: Up-regulated in shoot tissues in response to salicylic acid treatment
  misc_feature: Encodes the peptide sequence at SEQ ID NO 20543
atggctgccctgctcggcttcttcttgctgctggtgcttcagctcggcccctcttcttgcagcaatgtgtacattgtgtacatgggggaggggaatcccgagctgcacccggagctggtccgggactcgcaccacggcatgctcgccgcccttctcggcagcgagcaggcggccaaggacgccatcctttacagctacaggcacggcttctccgggttcgccgccgtgctcacggacagccaggcggcgcggctcgccgattcacctggggttgtgcgagtggtgcggaatcgtgttcttgacctgcacaccaccaggagctgggacttcatgcgagtgaacccgtcgcactcggttggaatcctctcagagagtagattcggtgaggattccattattggtgtgctagacactggaatatggccagagtcggccagttttagagacgacggcatcggcgaggttccacggcggtggaaagggcaatgcgtcgccggagacaggttcaatgcttccaactgcaacaggaaaataataggcgcgaaatggtacatcaaaggatacgaagccgagtacgggaagatgaacaccaccgatatctatgagttcatgtctgcgagagacgctgttgggcatggcacgcacacagcctccacagctgctggtgctctggtagccgatgcaaacttcaggggccttgccagcggtgttgcaaggggaggagcacccagggcaaggatcgcggtttacaaagtgtgctgggccaccggagattgcacttctgcagatatccttgcagcttttgacgatgccatacatgacggcgtcgatgtgctttcggtgtccctaggccaagcaccgccactccctgcgtatgttgatgatgtactgtccattggatccttccatgctgttgcgagagggattgttgtggtctgctctgcaggaaattctgggccttattcagagacggtcatcaactcggcgccatggattgtgaccgttgctgctggcaccattgataggactttcctcgcaaagatcacccttggcaacaatagcacctatgtgggtcaaacactgtacactggaaagcatcctggaaaaagcatacgcatagtctatgctgaagacattgcatctaataatgcagacgatacagatgcaagaagctgcactgcaggatctctgaattctactctagtgaaaggaaatgtggtgctttgcttccagacaagggcacagagatcagcttcagtggcagtggagactgtcaagaaagctcgaggcgttggagttatcttcgcccagttcttaactaaggacattgcatcttctttcgacattcccagtgttcaagtagactatcaagttggaacagctatacttgcatacactactagcatgagaaacccaacagttcagtctggctcagcaaaaacaattcttggagaactgataggcccagaagttgcgtatttctcatctcggggtccaagttctctgtccccctctgtcctgaagccagacatcgctgctccaggtgtcaacattttggccgcatggactcctgctgctgccatatcatcagccattggatctgtgaacttcaagattgattcaggaacctcgatgtcctgcccacacatttcaggagttgttgctctcctcaaatcaatgcatcctaattggagtcctgctgcagtaaaatcactaatgtccaagacacatatgggtttgagattgtatccgaggcggcaccctacaatcaggcaaacccattcgattacggaggtggtcatgtggatccaaacagggctgcacaccccggtcttgtgtatgagatggggacatctgactatgtgcgcttcctttgctccatggcatgagacctgtcagcacacaccaaagacgcagctgaacctgaacctgccatccatcacaattcccgaactgaggggcaggcttaccgtgtcaagaacagtcaccaacgtcggctcagcctcgtcaaagtacagagctcgtgtggaagctcctccaggggtggacgtcaccgtgagcccttctctcctgaccttcaactcgaccatgagaagtttgacgttcaaggtgacgttccaggccaaactgaaggtgcaagggagatacaacttcggcagcctgacatgggaggatggcgtgcacacggtgaggatccctctggtggttcggacgatggtcagtaagttctatgtcaattcatga

SEQ ID NO: 20543 - protein, 747 aa, Sorghum bicolor
  misc_feature: Ceres ANNOT ID no. 8655310
  misc_feature: Up-regulated in shoot tissues in response to methyl jasmonate treatment
  misc_feature: Up-regulated in shoot tissues in response to salicylic acid treatment
  misc_feature (207)..(740): SWISSPROT Homolog: EC 3.4.21.25 Cucumisin
  misc_feature (22)..(103): Pfam ID: Subtilisin_N Pfam Description: Subtilisin N-terminal Region
  misc_feature (364)..(466): Pfam ID: PA Pfam Description: PA domain
MAALLGFFLLLVLQLGPSSCSNVYIVYMGEGNPELHPELVRDSHHGMLAALLGSEQAAKDAILYSYRHGFSGFAAVLTDSQAARLADSPGVVRVVRNRVLDLHTTRSWDFMRVNPSHSVGILSESRFGEDSIIGVLDTGIWPESASFRDDGIGEVPRRWKGQCVAGDRFNASNCNRKIIGAKWYIKGYEAEYGKMNTTDIYEFMSARDAVGHGTHTASTAAGALVADANFRGLASGVARGGAPRARIAVYKVCWATGDCTSADILAAFDDAIHDGVDVLSVSLGQAPPLPAYVDDVLSIGSFHAVARGIVVVCSAGNSGPYSETVINSAPWIVTVAAGTIDRTFLAKITLGNNSTYVGQTLYTGKHPGKSIRIVYAEDIASNNADDTDARSCTAGSLNSTLVKGNVVLCFQTRAQRSASVAVETVKKARGVGVIFAQFLTKDIASSFDIPSVQVDYQVGTAILAYTTSMRNPTVQSGSAKTILGELIGPEVAYFSSRGPSSLSPSVLKPDIAAPGVNILAAWTPAAAISSAIGSVNFKIDSGTSMSCPHISGVVALLKSMHPNWSPAAVKSLMSKTHMGLRLYPRRHPTIRQTHSITEVVMWIQTGLHTPVLCMRWGHLTMCASFAPWHETCQHTPKTQLNLNLPSITIPELRGRLTVSRTVTNVGSASSKYRARVEAPPGVDVTVSPSLLTFNSTMRSLTFKVTFQAKLKVQGRYNFGSLTWEDGVHTVRIPLVVRTMVSKFYVNS

SEQ ID NO: 20544 - DNA, 1020 bp, Sorghum bicolor
  misc_feature: Ceres ANNOT ID no. 8655363
  misc_feature: Up-regulated in root tissues in response to methyl jasmonate treatment
  misc_feature: Up-regulated in shoot tissues in response to methyl jasmonate treatment
  misc_feature: Down-regulated in shoot tissues in response to salicylic acid treatment
  misc_feature: Encodes the peptide sequence at SEQ ID NO 20545
atggctgcctccaatagcagcagcgctggcaagaacaacggcaccaacaacccgctggacgccatgggcgccttcttctcgaagcaggtggaccggcggaagctggtgaccaccgagaagcgtgcgctggcgacgcgtctgtcctcctccggcgagacgttcccggggtcggagcaccgccccgcggaccggaagcggtggatggcggagctgggcgccgacaagctgcgcgtgcaccaggtggtgtggcccggcacgcacgactcggccaccaacaagatcggcgtgccgttcgtgacccgccccttcgcgcagtgccagtccatgtccgtgtacgagcagctggccacgggcacgcgcgtcgtcgacgtgcgcgtccaggaggagcgccgcgtgtgccacggcatcctggcgacgtaccccgtggacgtggtgctggacgacgtgaaccggttcctgggcgagaccgagtccgaggtgatcatcctggagatccgcaccgagttcgggcacgaggacccgccggagttcggcaagttcctggtggagaagctcggcgagcacctgatcccgcaggacgaggcggtgttccacaagacggtggcggagctgctcccgcggcgggtgatctgcgtgtggaagccgcgcaagtcgccggcgcccaaggcgggggacccgctgtggagcgccgggtacctcagggacaactggatcgacacggacctgccggagaccaagttcgagagcaacctcaagttcctggcgcagcagccggccgtggcggaccggaggttcttctaccgggtggagaacacggtgacgcccaaggccgacaacccggtgctgtgcgtctggccggtcacgaagcggatccacggatacgcgaggctcttcatcgccgaggtcttcgccaagggcctcggcgacaagctgcaggtcttctccaccgacttcatcgacggcgacttcgtcgacgcctgcgccggcgtcaccaaggcgcgcgtcgagggcaccgcgtga

SEQ ID NO: 20545 - protein, 339 aa, Sorghum bicolor
  misc_feature: Ceres ANNOT ID no. 8655363
  misc_feature: Up-regulated in root tissues in response to methyl jasmonate treatment
  misc_feature: Up-regulated in shoot tissues in response to methyl jasmonate treatment
  misc_feature: Down-regulated in shoot tissues in response to salicylic acid treatment
  misc_feature (65)..(173): SWISSPROT Homolog: EC 4.6.1.13 Phosphatidylinositol diacylglycerol-lyase
MAASNSSSAGKNNGTNNPLDAMGAFFSKQVDRRKLVTTEKRALATRLSSSGETFPGSEHRPADRKRWMAELGADKLRVHQVVWPGTHDSATNKIGVPFVTRPFAQCQSMSVYEQLATGTRVVDVRVQEERRVCHGILATYPVDVVLDDVNRFLGETESEVIILEIRTEFGHEDPPEFGKFLVEKLGEHLIPQDEAVFHKTVAELLPRRVICVWKPRKSPAPKAGDPLWSAGYLRDNWIDTDLPETKFESNLKFLAQQPAVADRRFFYRVENTVTPKADNPVLCVWPVTKRIHGYARLFIAEVFAKGLGDKLQVFSTDFIDGDFVDACAGVTKARVEGTA

SEQ ID NO: 20546 - DNA, 759 bp, Sorghum bicolor
  misc_feature: Ceres ANNOT ID no. 8655417
  misc_feature: Up-regulated in shoot tissues in response to methyl jasmonate treatment
  misc_feature: Encodes the peptide sequence at SEQ ID NO 20547
atgtctgtccttcagacgttcgattatgcacgcgtgaagtcttttttcgacctaggtatgaatcaagattcgtgcgctgagaaagggttctccgcttctcctgaccgtccgatcgctccgttggcatatggtgcctgttgccgtaatgccgtcatcgcccattcgcccacacgagcgggccggccgggagcccagccagagcccagagttacttcgcgggctgagtcctcgggaccggaggtctcgctaccggcaaccggcgagactggcggccgcgtcctccgttcctctccggcgactggctcgagtcctcttcccggcggaatcatgatcgtctgcgtcgccgtcgtcggccaccagaacaatccgctgtacctgcagagcttcacggaggcggacgacgccctcaagctccaccacatcgtccactgctccctcgacgtcatcgacgagcgagtgaacaatcctaaaaggagtgcgcctacgttgaatgagacatttttgggtcttctgtacccaactgagaactacaaagtgtacggctatttgacaaacacaaaggtcaaatttatcatggtcacgactgatcttgatgtcaaagatgcagatgcccgaaattttttcaggaagttccatgctgcatatgtagatgccgtctcaaacccgttccatgtcccagggaaaaagattgcttcaagaagctttggtgcaagagtaagcaccatcgtgaaatccttcggttcagggataaccagttga

SEQ ID NO: 20547 - protein, 252 aa, Sorghum bicolor
  misc_feature: Ceres ANNOT ID no. 8655417
  misc_feature: Up-regulated in shoot tissues in response to methyl jasmonate treatment
  misc_feature (116)..(245): Pfam ID: Sedlin_N Pfam Description: Sedlin, N-terminal conserved region
MSVLQTFDYARVKSFFDLGMNQDSCAEKGFSASPDRPIAPLAYGACCRNAVIAHSPTRAGRPGAQPEPRVTSRAESSGPEVSLPATGETGGRVLRSSPATGSSPLPGGIMIVCVAVVGHQNNPLYLQSFTEADDALKLHHIVHCSLDVIDERVNNPKRSAPTLNETFLGLLYPTENYKVYGYLTNTKVKFIMVTTDLDVKDADARNFFRKFHAAYVDAVSNPFHVPGKKIASRSFGARVSTIVKSFGSGITS

SEQ ID NO: 20548 - DNA, 1680 bp, Sorghum bicolor
  misc_feature: Ceres ANNOT ID no. 8655452
  misc_feature: Up-regulated in shoot tissues in response to methyl jasmonate treatment
  misc_feature: Up-regulated in root tissues in response to methyl jasmonate treatment
  misc_feature: Down-regulated in shoot tissues in response to salicylic acid treatment
  misc_feature: Encodes the peptide sequence at SEQ ID NO 20549
atggcgagcgcgtcggaggacgaggccgcctcggaccgctgcagcgggagctacagcccaagcgccgacgtcagcgagtccgagacctccagcgactgctccgcgcccaccacccgccgcttcgcctcttcctcctcggcctccgccaccgtctcccgcctcgcgtcctcctcctcgtcgctccccaccccggcgtcggccaccgccttctacctctcctccaagccggtctccgacctctccgagatcgacatgatgaaggagcgcttcgccaagctcctgctcggcgaggacatgtccggcagcggcaagggcgtctgcaccgcgctcgccatctccaacgccatcaccaacctctccgccaccgtgttcggcgagctgtggaggctggagccgctcgcgacggcgaggaaggcgatgtggacgcgggagatggagtggctgctctccgtcgccgactccatcgtcgagctcaccccctccatccaggagctccccgaaggcggcggccagttcgaggtcatggtcccgcgcccgcgcagcgacctctacatgaatctccccgcgctcaagaagctcgatgccatgctcctcgccatgattgacgggttcaaggggacggagttctggtacgtggacaggggggtgatggtcgaggacagtggggggccgttcccgtcgtcgtcctcctcctcgtcttgtggcaggccgtcggtgcggcaggaggagaagtggtggttgccctgcccacgagtgccgcccaaggggctgtccgaggatgcgaggaggaagctgcagcagagcagggattgtgcaaaccagatactgaaggcggccatggcgattaacagcgacgtgctcgcggagatggaaatccccgatgtgtacctggagacactgcccaagagtggtaaatcttgcttgggtgagataatttaccgatacataacagctgagcagttctcaccagaatgtctcctagattgcttggatctgtcatcggagcaccacacacttgaagtggcaaacagaatagaagctgccatccatgtttggaaactgaaaggccaaaaaaaatcaacacctcaaaccaaatcaaagaaatcttggggtggaaaagtgaagggtcttgttggggataaggaaaagagtcacactttgtctgaaagagctgatggtctattgcagagcttaagattgagatatcctggtctgccacaaacttcccttgacatgaacaagatccagtataacaaggatgttgggcagtcaatacttgaaagttactcaagggttctggagagcttggcatttaacataattgcaagaattgatgatgtgatttatgttgatgatgctacaaagaaatcagctgctgctgagtctgtgtcgatcttcaatcggggcacaggtgtgccagttcagaagaggatctctccaagcccattctctattcagaatacgccatatgcctctccatttgcaacacccactttctgctcctccaccccagttacaggcagccctggaagaggacaacccccactacacaaaaacaatctagggacacaagaaatcaaggtcgaaaagctttttgctggtgatctggagaaggtgtggacatatgctggaaacctaagcgcgaggaaagatgcaggagatgcacctgagagggactga

SEQ ID NO: 20549 - protein, 559 aa, Sorghum bicolor
  misc_feature: Ceres ANNOT ID no. 8655452
  misc_feature: Up-regulated in shoot tissues in response to methyl jasmonate treatment
  misc_feature: Up-regulated in root tissues in response to methyl jasmonate treatment
  misc_feature: Down-regulated in shoot tissues in response to salicylic acid treatment
MASASEDEAASDRCSGSYSPSADVSESETSSDCSAPTTRRFASSSSASATVSRLASSSSSLPTPASATAFYLSSKPVSDLSEIDMMKERFAKLLLGEDMSGSGKGVCTALAISNAITNLSATVFGELWRLEPLATARKAMWTREMEWLLSVADSIVELTPSIQELPEGGGQFEVMVPRPRSDLYMNLPALKKLDAMLLAMIDGFKGTEFWYVDRGVMVEDSGGPFPSSSSSSSCGRPSVRQEEKWWLPCPRVPPKGLSEDARRKLQQSRDCANQILKAAMAINSDVLAEMEIPDVYLETLPKSGKSCLGEIIYRYITAEQFSPECLLDCLDLSSEHHTLEVANRIEAAIHVWKLKGQKKSTPQTKSKKSWGGKVKGLVGDKEKSHTLSERADGLLQSLRLRYPGLPQTSLDMNKIQYNKDVGQSILESYSRVLESLAFNIIARIDDVIYVDDATKKSAAAESVSIFNRGTGVPVQKRISPSPFSIQNTPYASPFATPTFCSSTPVTGSPGRGQPPLHKNNLGTQEIKVEKLFAGDLEKVWTYAGNLSARKDAGDAPERD

SEQ ID NO: 20550 - DNA, 1425 bp, Sorghum bicolor
  misc_feature: Ceres ANNOT ID no. 8655553
  misc_feature: Up-regulated in root tissues in response to methyl jasmonate treatment
  misc_feature: Up-regulated in root tissues in response to salicylic acid treatment
  misc_feature: Encodes the peptide sequence at SEQ ID NO 20551
atggccgctgccgccgctgccgcggtgtcggtcgacgagaagctcgacaagcttcgcgccgaggtcgccaagctcgaccagatcagcgagaacgagaagtccgggttcctcagcctcgtgtcacgctacctcagtggggaggcggagcagatcgagtggagcaagatccagaccccgactgatgaggtggtggtgccgtacgataccctcgcgtcgcctcccgaagatctcgaggagacgaagaagctgctggacaagctcgttgtgctcaagcttaacggagggctcgggacgaccatgggctgcactgggcccaagtctgtcattgaagtccgcaatgggttcacattccttgatcttattgtgatccaaattgagtccctgaacaagaagtatggatgcagtgtccctttacttctgatgaactctttcaacacccatgatgacacacagaagattgttgaaaagtattccaactccaacattgaaattcatactttcaatcagagccagtatcctcgcattgttaccgaggacttcttgccacttccaagcaaagggaactctgggaaggatggctggtatcctccaggccatggtgatgtgttcccctctctgaataacagcggaaaacttgacatcttattggctcagggcaaggagtatgtcttcgttgcaaactcagacaacttgggtgctatagtcgacatcaagatcctaaaccatctgatcaataaccagaacgagtattgcggaggtatggaagacagccttgttactccaaagacgctggctgatgttaagggcggtacactcatctcttacgaaggaagagttcagcttttggagattgcccaagtacctgatgagcatgtcaatgaatttaaatcaatcgagaagtttaagatattcaacactaacaacttgtgggtgaaccttaaagctatcaagagactcgtagaggctgaggctcttaagatggaaattattccaaaccccaaggaagttgatggtgtaaaggtccttcaactcgaaactgcagctggtgcagctattcggttcttcgacaaagcgattggaattaatgttccccgctcaaggtttctcccagtgaaggctacatctgatttgttgcttgtgcagtctgatctttacaccttggttgatggctttgtcatccgcaacccagccagagcgaatccagctaacccttcgattgagcttggacctgagttcaagaaggttgccaatttccttgctcggttcaagtccatccccagcatcgtcgagcttgacaacttgaaggtttctggtgatgtctggtttggctctggaattacactcaagggcaaggtgacaatcactgccaagtctggagtgaagttggagattccagatggagctgtacttgagaacaaggtataa

SEQ ID NO: 20551 - protein, 474 aa, Sorghum bicolor
  misc_feature: Ceres ANNOT ID no. 8655553
  misc_feature: Up-regulated in root tissues in response to methyl jasmonate treatment
  misc_feature: Up-regulated in root tissues in response to salicylic acid treatment
  misc_feature (9)..(473): SWISSPROT Homolog: EC 2.7.7.9 UTP--glucose-1-phosphate uridylyltransferase
  misc_feature (32)..(449): Pfam ID: UDPGP Pfam Description: UTP--glucose-1-phosphate uridylyltransferase
MAAAAAAAVSVDEKLDKLRAEVAKLDQISENEKSGFLSLVSRYLSGEAEQIEWSKIQTPTDEVVVPYDTLASPPEDLEETKKLLDKLVVLKLNGGLGTTMGCTGPKSVIEVRNGFTFLDLIVIQIESLNKKYGCSVPLLLMNSFNTHDDTQKIVEKYSNSNIEIHTFNQSQYPRIVTEDFLPLPSKGNSGKDGWYPPGHGDVFPSLNNSGKLDILLAQGKEYVFVANSDNLGAIVDIKILNHLINNQNEYCGGMEDSLVTPKTLADVKGGTLISYEGRVQLLEIAQVPDEHVNEFKSIEKFKIFNTNNLWVNLKAIKRLVEAEALKMEIIPNPKEVDGVKVLQLETAAGAAIRFFDKAIGINVPRSRFLPVKATSDLLLVQSDLYTLVDGFVIRNPARANPANPSIELGPEFKKVANFLARFKSIPSIVELDNLKVSGDVWFGSGITLKGKVTITAKSGVKLEIPDGAVLENKV

SEQ ID NO: 20552 - DNA, 1920 bp, Sorghum bicolor
  misc_feature: Ceres ANNOT ID no. 8655595
  misc_feature: Up-regulated in shoot tissues in response to methyl jasmonate treatment
  misc_feature: Encodes the peptide sequence at SEQ ID NO 20553
atgcggacgccggcgatgctccggtgggccgcggcgctcgcggtcctgctcgccgtcgccgcgccggccgccgggttctacctccctggcgtcgccccgagcgatttcgccaagggtgatctgcttccagtgaaggtgaataagttgacatctatcaagactcaactcccgtacacatattactcccttccattctgcaagccagataccataatcgacagtgccgaaaatcttggtgaggttcttcgtggtgatcgcattgagaactctccttatgtgttcaaaatgggagagcccaagatgtgtcagattgtctgcaaagcgaagatcggtgagaaagaagccaaagagctcaaggaaaagatagaggatgaatatcgagtgaacatgattctagacaacctcccgcttgttgttcctgttaaaaggcaagataagaacagtattgcttatcaaggtggatatcatgttggtcttaaaggcctgtattctggaactaaggatgagaaatacttcatccacaaccatttgtcatttgcggtgaagtatcacagggatgaaaattcaggactttctagaatagtgggatttgaggtcaacccacacagtgtcaagcatcaggttgatgataaatggaatggtgtagacactcgcttgagcacttgtgatcctcatgcgagcaaatttgtaacaaactctgataatcctcaggaagttgaaactgacaaggaaatcatattcacatatgatgttcattttgaggagagtgagatcaagtgggcatctcgatgggacacctacctgttgatgactgatgatcagattcactggttttctatcgtgaactctctcatgatcgtgcttttcctatctggcatggttgccatgataatgcttcgcaccctctacagagatatctctagatacaatcagcttgaaactcaagaagaagcacaagaggaaacaggctggaagcttgttcatggggatgtgttccgtcctccaacctactctgacttactctgtgtttatgttggcactggcgtccaattctttggcatgctcctagttacaatgatcttcgctgtgttgggtttcctttctccatcaaaccggggaggactgatgactgcaatgcttcttgtctgggttttgatggggctgcttgctggctattcttcttcacgcctctacaagatgttcaaaggttcagagtggaagaagattacactgcaaacggctttcctgtttcctggggttgcatttgttattttcttcatcttgaatgctcttatatggggggagaagtcatctggtgctgttcctttcaccacaatgtttgccttggtcctcctctggtttggcatctcagtaccccttgtctttgttgggagctatcttgggttcaagaaacctgccatggaagctccagtcaagacaaacaagattccacggcagatccctgagcaggcttggtacatgaatccgcttttcactattctgatcggtggggtccttccatttggagcagttttcattgaactcttcttcatcctcacctccatctggctgcaccagttctattacatctttggcttcctcttccttgtgtttgtgatccttatcatcacctgtgccgagatcacaattgtgctctgctatttccagctctgcagtgaggactacatgtggtggtggaggtcttaccttacctcaggatcctctgccctgtatctcttcctgtatgctgctttctacttcttcacgaaactgcagattactaagctggtgtctggcatcttgtacttcggctacatgcttctcgcctcctatgccttctttgtgctcactggcacaattggtttctgtgcctgcttctggttcactaggttgatttactcgtcagtgaagatcgattag

SEQ ID NO: 20553 - protein, 639 aa, Sorghum bicolor
  misc_feature: Ceres ANNOT ID no. 8655595
  misc_feature: Up-regulated in shoot tissues in response to methyl jasmonate treatment
  misc_feature (56)..(597): Pfam ID: EMP70 Pfam Description: Endomembrane protein 70
MRTPAMLRWAAALAVLLAVAAPAAGFYLPGVAPSDFAKGDLLPVKVNKLTSIKTQLPYTYYSLPFCKPDTIIDSAENLGEVLRGDRIENSPYVFKMGEPKMCQIVCKAKIGEKEAKELKEKIEDEYRVNMILDNLPLVVPVKRQDKNSIAYQGGYHVGLKGLYSGTKDEKYFIHNHLSFAVKYHRDENSGLSRIVGFEVNPHSVKHQVDDKWNGVDTRLSTCDPHASKFVTNSDNPQEVETDKEIIFTYDVHFEESEIKWASRWDTYLLMTDDQIHWFSIVNSLMIVLFLSGMVAMIMLRTLYRDISRYNQLETQEEAQEETGWKLVHGDVFRPPTYSDLLCVYVGTGVQFFGMLLVTMIFAVLGFLSPSNRGGLMTAMLLVWVLMGLLAGYSSSRLYKMFKGSEWKKITLQTAFLFPGVAFVIFFILNALIWGEKSSGAVPFTTMFALVLLWFGISVPLVFVGSYLGFKKPAMEAPVKTNKIPRQIPEQAWYMNPLFTILIGGVLPFGAVFIELFFILTSIWLHQFYYIFGFLFLVFVILIITCAEITIVLCYFQLCSEDYMWWWRSYLTSGSSALYLFLYAAFYFFTKLQITKLVSGILYFGYMLLASYAFFVLTGTIGFCACFWFTRLIYSSVKID

SEQ ID NO: 20554 - DNA, 1635 bp, Sorghum bicolor
  misc_feature: Ceres ANNOT ID no. 8655611
  misc_feature: Down-regulated in shoot tissues in response to aminocyclopropane carboxylic treatment
  misc_feature: Encodes the peptide sequence at SEQ ID NO 20555
atggaccccgcggcggccgcgctaggtgcagcacccgccgctggcgcgccacccccgggcgcagccgcaggggagcagcaggcagctccccgggttgagcggctcagcgcgggggtgcagcagcagctgaacctggaggggatgcgcgcgcgcgcggtggggctgtacaaggccatctcccgcatcctcgaggacttcgacgtcatcgcccgcaccaatcccagtgcctcccccaagtggcaggacgtgctcgggcagttctcgatggtgagcatggagctcttcaacattgtggaggacattaagaatgtgtccaaggtgtttgttgtgtaccccaggaatgtcaatgccgagaatgctacagtactacctgtaatgctgtcgtcaaaactgctgcctgagatggaagttgacgaaactacaaagagagagcaactattgtctggaataactaatctaccggtgcctacacagattgaaaaattaaaggctagaatagaaatgattgcgagtgcatgcgaaactgctgagaaagtaattgctgaatgccgtaagagctatgggctgggaacccgtcaggggacaaatcttggtcctacattggacaaagcacaagctgcaaagatacaggagcaggaaggcctacttagagcagcagtaaactatggtgaaggattacgggtacctggagatcagaggcagccacaatctcttcctagccatctgatagaagtgcttcctttaggagacggtgcacaaaattttggtgatagttctggtagttatcccaaaaatacgtcaacatttgcacctaataatgtcaacaaccagggaaatcaggcatccggaggacagttacttggaagacctgcgccatcacctggaaccacaggaacccctaatttcgagaatgtgtccactcctccgatgccatatgctaactctcctaggtcaggcaccaatatgatgaataccccgtccccccagcagcatctaacaccacaacagcagaggcaaaagctgatgcaagcatctcaacagcagcaactgcatgctcagcagctgaggccatcagctgctgggatgctagcgcagagcgcacttcctcagctacaagatttacaggggcaggctcaacaaaaactacaggtccctggtcaacagcaaatgcagtacaaccaagccttgtcacaacagtttcataacagacagatgcaacctggacgtatgcaaccaggcatggctcagagtcaattgaatcaaggaactcagctacggagtcatttgggccagtttactggagctgcgaatagtgcaatgttcaatgctgcacaggcatcatcaaactcacaaatgatggcaaatatgcctggatcacagtcgcttatgccacaaatgcagtatggtatggctggtgggcatccacagaggagtcatccccaaatgctgactgaccaaatgtttggtatgggagccacaaatagcagcatgatgggaatgcagcagcagcagcagcaaggggtatatgggaacatgcaggctggtgcacagaacatgcaacagggtatggtgggccttcagaatcagacccagaatcccaacttcactcagcagaggcaacaaaatcagcaatga

SEQ ID NO: 20555 - protein, 544 aa, Sorghum bicolor
  misc_feature: Ceres ANNOT ID no. 8655611
  misc_feature: Down-regulated in shoot tissues in response to aminocyclopropane carboxylic treatment
MDPAAAALGAAPAAGAPPPGAAAGEQQAAPRVERLSAGVQQQLNLEGMRARAVGLYKAISRILEDFDVIARTNPSASPKWQDVLGQFSMVSMELFNIVEDIKNVSKVFVVYPRNVNAENATVLPVMLSSKLLPEMEVDETTKREQLLSGITNLPVPTQIEKLKARIEMIASACETAEKVIAECRKSYGLGTRQGTNLGPTLDKAQAAKIQEQEGLLRAAVNYGEGLRVPGDQRQPQSLPSHLIEVLPLGDGAQNFGDSSGSYPKNTSTFAPNNVNNQGNQASGGQLLGRPAPSPGTTGTPNFENVSTPPMPYANSPRSGTNMMNTPSPQQHLTPQQQRQKLMQASQQQQLHAQQLRPSAAGMLAQSALPQLQDLQGQAQQKLQVPGQQQMQYNQALSQQFHNRQMQPGRMQPGMAQSQLNQGTQLRSHLGQFTGAANSAMFNAAQASSNSQMMANMPGSQSLMPQMQYGMAGGHPQRSHPQMLTDQMFGMGATNSSMMGMQQQQQQGVYGNMQAGAQNMQQGMVGLQNQTQNPNFTQQRQQNQQ

SEQ ID NO: 20556 - DNA, 3018 bp, Sorghum bicolor
  misc_feature: Ceres ANNOT ID no. 8655737
  misc_feature: Down-regulated in shoot tissues in response to methyl jasmonate treatment
  misc_feature: Encodes the peptide sequence at SEQ ID NO 20557
atgagcaatcttaaacttggtgttgaggttaccagtgctcatgatctcctcccgaaagagcagggcacagccaatacttttgttgaggtcgagttcgatggccagaagttccgcacagccatcaaagacagggacatcaaccctgtctggaacgagcagttctacttcaacatatctgatccatcccgcctcccagagctacaccttgaggcctatgtgtaccatgcagaccgtgccagtaattccaaggcctgcctaggcaaggttcgcatatcgggtacatcctttgtcagccaacctgatgctacgcccctgcactaccccctggagaagcgcacaatcttatcacgtgcgcgtggtgagcttggtctaagagtcttcctcacagatgatccatcggtgagggtgtctgctccaggtcaccaggagtttgatatgttaagcacgcctaccactgcacaggagcaggcagcagccaactccattccaaatcctttccaagagacgagagcaaatccagtgagacaattccagcacttaccaaaagaacagcagcgtccggcacagccatactacgctgaaggttcatatggagaccagcaacaaagaagcttttctgcagttgggaataaagctgcagcccctcagcctcaggttcaggtatcaaggatgtatgctccaggtccacagcagccaatagatttccaactaaaggaaacaagcccaacgcttggtggtggccgtgttattggtggccgggtgtaccctggtgagaaggctggggcatacgaccttgttgagaagatgcagtacctctttgtgcgtgtggtcaaggcccgcgatctgcccaacatggacatcactggaagtcttgatccttttgtggaggtgcaccttgggaactacaaaatgaaaacaaagtactttgagaagaatcagaggcccgagtgggatgaggtgttcgcattccctaaggaagtcatgcagtcaacgatgcttgaagttgttgtgaaggacaaggatgtcgttagggatgactatgtcggtcgagtgagtattgacctgaatgaggtccctctaagggtccctccagacagtccattggcaccagagtggtatcgtcttatgggcaaggatggcatgagggacagaggggagttgatgcttgcagtctggtatggtactcaagcagatgaatgcttcccaagcgccattcatgcagggtcaacaccagttgaatcccatcttcacaattatatccgtgggaaggtttaccctgcgccaagaatgtggtatgtgagagtcaatgtaattgaggcacatgatatatacccaatggagaaccacatacctgatgtactggtaaaagtgagactgggccatcaattgttgaagacaaggcaagttcgctcaccaaccagaaacttcatgtggaatgaggagctgatgtttgtcgcagcagagccttttgaggacgacttgatcatatcagtagaagaccgtgtagcacaaaacaaagatgaggtgattggtgaaactatcataccactcgcaaggcttccaaggcgggctgatcacaagccggtacggccagcatggtttgatttaagaagaccaggaataattgatgtgaaccagctaaaggaagacaagttctatgcaaaggtaaaccttcgtgtttgccttgaaggtggttatcatgtgcttgatgagtccacacaatattgcagtgatctccgtccaacaatgaagcagttgtggaagccaccaattggcatgcttgaagttggcattttaagtgcaaatggtctcaatccaacaaaaaccagaaacgaccgtgggtcgtgtgatgcatattgtgttgccaagtatggttcaaaatgggtccggacacgcacaatagttgacaacttgagccctcgattcaatgagcagtacacatgggaagtctttgatcatggaactgtactcacaattggtctatttgacaactgccacataagtggagataacaaccacggttcctcaggccacatggataaacccatcggcaaagtgagaattcggctttcaacacttgagacgtcgcgtgtgtacacacactcatatccattgctcgtcctcagcccatcaggagttaaaaagatgggtgaactacatcttgccatccggttcacaacatcatcccttatcaatgtgctctttacatactctaggcccctcttgcccaagatgcattatgcacagcctctgtcaatagttcagcaggaaatactccgccaccaggctgtgcagcttgttgcgcagcgcctggggcgcatggagccaccagttcgcagggaagttgttgagtttatgtcagatgctcgctctcatctgtggagcatgcgacggagcaaagctaacttcttccgtcttatgcaagtcttctcaggggtcattgctgcagggaagtggttcggtgatgtttgtcagtggaaaaacccggtcaccacagtgttggttcatgtgctctttatcatgcttgtgttctatccagaccttatcctgccaacagtcttcctctacatgttcttgatagggttgtggaattaccggttccggccacgcttcccaccacatatgaacacaagaatatcttacgctgatgttgcacatccagatgagcttgatgaagaatttgacacattcccaacctcaaggagcccagatctcattaggatgaggtatgataggttacgacatgttgctgggaggatacagacagttgttggggacattgccactcagggagagagattacagtcactgctgagctggagggacccaagggcaacagctatgttcctaatattttgcctgattactgcgattatactatatgtgacaccattccaagtgattgcactctgccttgggttcttctggatgaggcatcctcggtttcgccacaaggtgccgtcagcaccagcaaacttcttcaggaggctacctgcaaagacagattctttgctgtaa

SEQ ID NO: 20557 - protein, 1005 aa, Sorghum bicolor
  misc_feature: Ceres ANNOT ID no. 8655737
  misc_feature: Down-regulated in shoot tissues in response to methyl jasmonate treatment
  misc_feature (850)..(1005): Pfam ID: PRT_C Pfam Description: Plant phosphoribosyltransferase C-terminal
  misc_feature (272)..(352): Pfam ID: C2 Pfam Description: C2 domain
  misc_feature (6)..(90): Pfam ID: C2 Pfam Description: C2 domain
  misc_feature (594)..(687): Pfam ID: C2 Pfam Description: C2 domain
  misc_feature (433)..(514): Pfam ID: C2 Pfam Description: C2 domain
MSNLKLGVEVTSAHDLLPKEQGTANTFVEVEFDGQKFRTAIKDRDINPVWNEQFYFNISDPSRLPELHLEAYVYHADRASNSKACLGKVRISGTSFVSQPDATPLHYPLEKRTILSRARGELGLRVFLTDDPSVRVSAPGHQEFDMLSTPTTAQEQAAANSIPNPFQETRANPVRQFQHLPKEQQRPAQPYYAEGSYGDQQQRSFSAVGNKAAAPQPQVQVSRMYAPGPQQPIDFQLKETSPTLGGGRVIGGRVYPGEKAGAYDLVEKMQYLFVRVVKARDLPNMDITGSLDPFVEVHLGNYKMKTKYFEKNQRPEWDEVFAFPKEVMQSTMLEVVVKDKDVVRDDYVGRVSIDLNEVPLRVPPDSPLAPEWYRLMGKDGMRDRGELMLAVWYGTQADECFPSAIHAGSTPVESHLHNYIRGKVYPAPRMWYVRVNVIEAHDIYPMENHIPDVLVKVRLGHQLLKTRQVRSPTRNFMWNEELMFVAAEPFEDDLIISVEDRVAQNKDEVIGETIIPLARLPRRADHKPVRPAWFDLRRPGIIDVNQLKEDKFYAKVNLRVCLEGGYHVLDESTQYCSDLRPTMKQLWKPPIGMLEVGILSANGLNPTKTRNDRGSCDAYCVAKYGSKWVRTRTIVDNLSPRFNEQYTWEVFDHGTVLTIGLFDNCHISGDNNHGSSGHMDKPIGKVRIRLSTLETSRVYTHSYPLLVLSPSGVKKMGELHLAIRFTTSSLINVLFTYSRPLLPKMHYAQPLSIVQQEILRHQAVQLVAQRLGRMEPPVRREVVEFMSDARSHLWSMRRSKANFFRLMQVFSGVIAAGKWFGDVCQWKNPVTTVLVHVLFIMLVFYPDLILPTVFLYMFLIGLWNYRFRPRFPPHMNTRISYADVAHPDELDEEFDTFPTSRSPDLIRMRYDRLRHVAGRIQTVVGDIATQGERLQSLLSWRDPRATAMFLIFCLITAIILYVTPFQVIALCLGFFWMRHPRFRHKVPSAPANFFRRLPAKTDSLL

SEQ ID NO: 20558 - DNA, 1668 bp, Sorghum bicolor
  misc_feature: Ceres ANNOT ID no. 8655821
  misc_feature: Down-regulated in root tissues in response to salicylic acid treatment
  misc_feature: Encodes the peptide sequence at SEQ ID NO 20559
atgccgttcctctcgacgccgtcgttcgacctctccgccggcgcggagccaaccctgggcccgcgcccagcggccccgccgcctccacccaccggggccgcgcatcagcatcagcagccgccggtgtccgaggcggcggcccggcggctgcgggaggcggaggagcggctgcgggaagccatcgaggagctccaccggcaccagggcggcggcggcggtaagggagagggtgacgagcagctggagggagagcgggggtgcggccacgacggggagtcgtgcgcggcgcacgccgcggggaacctgtgccagagcttcctgctctcctacggcgtccgcgtcggcatcggcatcctcctccgcgctttcaagctcgtgcgccgcaggtcctatggctcgctcctcgaccttaagcaactggtttcggagaaagatcttatagtgagagaggaggcttgccgggtagggttgctttttggtggattcaccggatcatatcatgcacttcgatgtttccttaggagatttaggaaaaaggagacaccatacaatgcaatattagcaggttcggtggcaggattggccatactagcactggatgattcaagtaggaggcgtactctatctctgtatcttctagcgaggcttgctcagtgtgcatataattctgcgaaatctaagaacaaatttcatttttggggaagccattggagacatggagatgcattgcttttttcattggcatgtgcccaggttatgtatgcttttgttatgaggcctgaaagcttacctaagtcgtaccaagaatttatccttaagacaggaccagtagcagaacctgtctacaaggctgtcagagaatgctgcagaggtggtcctgtggatctaactgccctctcagcctatttatcaaataagcggaatctggatttgataaatttaacaacaaatccatccattatcccctgttctgcgatccatcctgacagagcatcatgcttggctcaaaatattaatgttgtttcatcaacattcaagaaaacattccctctatatttctcattgacatttgtgccctttgttgtcctacgtcttcaaaagttcttggaatcaccgactgcaacttgttggcgtgctcttgtgggtgcagttcgctccaccacctttttgtctgcctttgtcactatattccaggctgctatatgtttgcaccgaaaagttgcgaacaaagaccacaaacttgtatattggtttgctggtttgatgtcgggtctttcaattcttttggaaaagaaagctagaagggctgagctagccctctatgtgcttccccgtgctggagattctctatggtatatattgatcaatcgccacctgctcccaaatattaaaaatgctgaggtggctctcttctgcatgtgcatgggaggaatcatgtattttctggagtacgagccagacacaatggctccattcctcagagggctcatcaggcgcttcctggcaagcaaaatcagcaatccaagccctccgcctcccgatcgcaacgcttcctactcataccttcagacgctgaatgctctggagcaatcaagaacccagccaggggtggataacggactgacgacatcggagaaatataaccttgaatcaattcctggactttag

SEQ ID NO: 20559 - protein, 555 aa, Sorghum bicolor
  misc_feature: Ceres ANNOT ID no. 8655821
  misc_feature: Down-regulated in root tissues in response to salicylic acid treatment
  misc_feature (91)..(228): Pfam ID: Tim17 Pfam Description: Tim17/Tim22/Tim23 family
MPFLSTPSFDLSAGAEPTLGPRPAAPPPPPTGAAHQHQQPPVSEAAARRLREAEERLREAIEELHRHQGGGGGKGEGDEQLEGERGCGHDGESCAAHAAGNLCQSFLLSYGVRVGIGILLRAFKLVRRRSYGSLLDLKQLVSEKDLIVREEACRVGLLFGGFTGSYHALRCFLRRFRKKETPYNAILAGSVAGLAILALDDSSRRRTLSLYLLARLAQCAYNSAKSKNKFHFWGSHWRHGDALLFSLACAQVMYAFVMRPESLPKSYQEFILKTGPVAEPVYKAVRECCRGGPVDLTALSAYLSNKRNLDLINLTTNPSIIPCSAIHPDRASCLAQNINVVSSTFKKTFPLYFSLTFVPFVVLRLQKFLESPTATCWRALVGAVRSTTFLSAFVTIFQAAICLHRKVANKDHKLVYWFAGLMSGLSILLEKKARRAELALYVLPRAGDSLWYILINRHLLPNIKNAEVALFCMCMGGIMYFLEYEPDTMAPFLRGLIRRFLASKISNPSPPPPDRNASYSYLQTLNALEQSRTQPGVDNGLTTSEKYNLESIPGL

SEQ ID NO: 20560 - DNA, 1437 bp, Sorghum bicolor
  misc_feature: Ceres ANNOT ID no. 8655865
  misc_feature: Down-regulated in shoot tissues in response to salicylic acid treatment
  misc_feature: Encodes the peptide sequence at SEQ ID NO 20561
atgccgcggaccaccgtggtggagagccccggctgcccgccgctccgtgccctcaccactgacatcatcggcctcgtcaaagtcgtcgaggcccacacgaagccggcgggcgccgccaaggtcgtcgagacgtggggcgatcctgacgcctcccgcgccatcgtcgctgcctcccttgccgatcgtgccgccgaccccgtcttggctgtggcaaggaagaacggcgtggttgagttgctgaatcccctgaacggggatgctctggctgctgtcaagaccgtggggccatcaccaaatgatggtggcgcagaaggtgatcccctcgccgcattgcaccttttcacaagacaggcttcagactcgatcttaggaacgtttcttgcctgcacggagcaggggaaagcttctataaggtccatcacgaaagaaaatgcagcttcgggctcggatgttgggccatcagccacatgggatgtgtgcagtggggccaatgtgcaattttgctcagttgatcatggtgaaagctatgcgatgtttggagggaaaggtatagaagtgaacttgtgggatatcacatcttgtagtaagatatggtctgctaaatctccccgagcaaatagccttggtatattcactcgaccttggttcactgctgggaccttcttgtgcaaggatgatcatcgtaaaattgtagcctgcactaatgatcatcaggtccgcttgtatgatactgcattgcaaagaagacctgccatctctgttgattttagggagtcaccaatcaaggcagttgctgctgatccgaatggccatgatgtctatattggcacaggaacaggggatcttgcttcctttgacatgagaacagggaaattgctcggatgctatattggcaaatgcagtggaagtattagatctattgttaggcatccagagctacctttgatagcatcttgtggactggatagctacttacgtatctgggacacaaacacaagacagctgctatccgctgtctttctgaagcagcatcttactactgtggtccttgattcacatttttctcttgaagagcctgaagagataaaatccaagcaactggagttttcagtggaagctgaggctgaagtccgaaaagaaaagaagcaaaagagtaagacaacagaggatgagactgaggctcaagtccgaaaagaaaagaagaaaaagaagagtgaaacaattgaggaggatgaagaacaagttggagtggtcgaccatagcaatattaatggtgaaatatatgccagaaaagaaaagaagaaaaagaagagtagagctattgaacaggatgaggagccagacagcgatggtgaaatgtgcagtcccaacagaagaaaatctggagaaagaagcaaatgcctgaagaagaagagcaagaaacagctggtcgcctag

SEQ ID NO: 20561 - protein, 478 aa, Sorghum bicolor
  misc_feature: Ceres ANNOT ID no. 8655865
  misc_feature: Down-regulated in shoot tissues in response to salicylic acid treatment
MPRTTVVESPGCPPLRALTTDIIGLVKVVEAHTKPAGAAKVVETWGDPDASRAIVAASLADRAADPVLAVARKNGVVELLNPLNGDALAAVKTVGPSPNDGGAEGDPLAALHLFTRQASDSILGTFLACTEQGKASIRSITKENAASGSDVGPSATWDVCSGANVQFCSVDHGESYAMFGGKGIEVNLWDITSCSKIWSAKSPRANSLGIFTRPWFTAGTFLCKDDHRKIVACTNDHQVRLYDTALQRRPAISVDFRESPIKAVAADPNGHDVYIGTGTGDLASFDMRTGKLLGCYIGKCSGSIRSIVRHPELPLIASCGLDSYLRIWDTNTRQLLSAVFLKQHLTTVVLDSHFSLEEPEEIKSKQLEFSVEAEAEVRKEKKQKSKTTEDETEAQVRKEKKKKKSETIEEDEEQVGVVDHSNINGEIYARKEKKKKKSRAIEQDEEPDSDGEMCSPNRRKSGERSKCLKKKSKKQLVA

SEQ ID NO: 20562 - DNA, 2124 bp, Sorghum bicolor
  misc_feature: Ceres ANNOT ID no. 8655881
  misc_feature: Up-regulated in root tissues in response to methyl jasmonate treatment
  misc_feature: Up-regulated in shoot tissues in response to methyl jasmonate treatment
  misc_feature: Up-regulated in shoot tissues in response to salicylic acid treatment
  misc_feature: Up-regulated in root tissues in response to salicylic acid treatment
  misc_feature: Encodes the peptide sequence at SEQ ID NO 20563
atgtttactataaaggaatcatgcatcaatagggaatttaccttaggcagctgtattgtgctgactcttcagacactaggcgttgtctttggggatgttggtactagtccactgtatacctttgatgtaatgttcaacaaatacccaattactgcaaaggaggatgttctcggagctctctcacttgtaatatacactctcattctgataccatttctgaagtatacactgattgttttgtggggaaacgatgatggagaaggagggacatttgctttatactcgttaatatgcagaaatgcaaaggcaagcctgcttcctaaccaattaccttctgatacccgtatatcaagtttcaatctgaaggtgccttcagtagagctcgagagatctttgaagatcaaggagcgacttgagacttcatctatgctaaagaagctgcttttgatgcttgttctttttggtacttcgatggtaatagcagatggtgtggtcacaccagcaatgtcaggtgaagtggtcatgataactgctgcatttcttattgttctgttcagtctacaacggttcggaacgagcaaagtagggcttgctgttgggccggctttgttcatatggttttgctgccttgccgggataggaatttataacctcagaatatatggttcagaagtattccgtgcattcaatcctgtgtatatctactattattttgaaagaaataccactgaagcttggatgtccctggggggttgtcttttatgtgcaacaggatctgaggcaatgtttgctgatttatgctacttctctgttaagtctgttcagcttacctttgtgtttcttgttcttccatgccttctactgggatacctaggacaagctgcatttcttatggagaacttagataaaagtcagcagatcttctttttgtccattccaacactaattgctagtcgtgcaatgacaactgctatattttcaaccatcaagcaggcaacagctcttggctgtttcccacgcctcaagattatccacacctctagaaagttcatgggccaaatatacataccggtgatgaactggttcttgctggtttcttgcatagcagaacttggggtcatgatgatgactactgtcctggtaaccattataatgcttctgatatggcaggtcaacatcgtcatagttctatgctttctcaccctcttcctggggctggagttatttttcttttcctcagttttgggaagtgcagcagatggaagttgggtgcttttggtatttgcagctgtattgtatttggtaatgtacatatggaactatggaaccaaattgaagtacgaaactgaagtcaagcaaaaactttcaatggatttattgacacagctaggctgcaatcttggtacagtgagggcacctggtattggattgctctataatgaactggtcaggggtgttcctgcaatctttggtcacttcctcactacactgccagccatgcattcaatgatcatttttgtctgcatcaaatgggtcccagttccagttgtgcctcagaatgaaaggtttctcttccgtcgcgtctgcccaaagaactaccatatgttccgctgtattgctaggtatgggtacaaagatgtacgcaaggagaacacccaagcattcgaacagcttctgatagaaagccttgaaaagttcatacgccgagaggcccaggaacgctccctggagagcgaccataatgatgacacagactctgaagatgagattgcatcttcatcatcaagagtccttgttggtcccaatggtagcatctactcgctcggcgtcccacttgccgagccaggcggcggcaccgacaactcagccctgggatcaagcttgtcattcgacggatcgagcctggacaacgagctctctttcgtccacaaggccaaggagtcaggcgtggtgtaccttctcgggcacggagacatcagggcccggaaggagtcgttcttcctgaagaagctggtgatcaactatttctacgctttcctgaggaagaactgcaggaggggcatcgcgacgctgagcgtaccccacacgaggctgatgcaggtggcgatgcaatacatggtttag

SEQ ID NO: 20563 - protein, 707 aa, Sorghum bicolor
  misc_feature: Ceres ANNOT ID no. 8655881
  misc_feature: Up-regulated in root tissues in response to methyl jasmonate treatment
  misc_feature: Up-regulated in shoot tissues in response to methyl jasmonate treatment
  misc_feature: Up-regulated in shoot tissues in response to salicylic acid treatment
  misc_feature: Up-regulated in root tissues in response to salicylic acid treatment
  misc_feature (20)..(707): Pfam ID: K_trans Pfam Description: K+ potassium transporter
MFTIKESCINREFTLGSCIVLTLQTLGVVFGDVGTSPLYTFDVMFNKYPITAKEDVLGALSLVIYTLILIPFLKYTLIVLWGNDDGEGGTFALYSLICRNAKASLLPNQLPSDTRISSFNLKVPSVELERSLKIKERLETSSMLKKLLLMLVLFGTSMVIADGVVTPAMSGEVVMITAAFLIVLFSLQRFGTSKVGLAVGPALFIWFCCLAGIGIYNLRIYGSEVFRAFNPVYIYYYFERNTTEAWMSLGGCLLCATGSEAMFADLCYFSVKSVQLTFVFLVLPCLLLGYLGQAAFLMENLDKSQQIFFLSIPTLIASRAMTTAIFSTIKQATALGCFPRLKIIHTSRKFMGQIYIPVMNWFLLVSCIAELGVMMMTTVLVTIIMLLIWQVNIVIVLCFLTLFLGLELFFFSSVLGSAADGSWVLLVFAAVLYLVMYIWNYGTKLKYETEVKQKLSMDLLTQLGCNLGTVRAPGIGLLYNELVRGVPAIFGHFLTTLPAMHSMIIFVCIKWVPVPVVPQNERFLFRRVCPKNYHMFRCIARYGYKDVRKENTQAFEQLLIESLEKFIRREAQERSLESDHNDDTDSEDEIASSSSRVLVGPNGSIYSLGVPLAEPGGGTDNSALGSSLSFDGSSLDNELSFVHKAKESGVVYLLGHGDIRARKESFFLKKLVINYFYAFLRKNCRRGIATLSVPHTRLMQVAMQYMV

SEQ ID NO: 20564 - DNA, 2712 bp, Sorghum bicolor
  misc_feature: Ceres ANNOT ID no. 8655919
  misc_feature: Up-regulated in shoot tissues in response to salicylic acid treatment
  misc_feature: Up-regulated in root tissues in response to salicylic acid treatment
  misc_feature: Encodes the peptide sequence at SEQ ID NO 20565
atggctgacggtaatagccgctttgggcatgtgctgacaagcctcccaaagcccggtggtggagagtacgggaagtactacagcttaccagccctgaatgatcctaggatagaaagattgccatattctatccggtatctactggagtcagccatccgcaactgtgacggatttcagattacagagaaggatgtcgaaaacatcattgattgggagaatactgctcccaagctggtggagatacctttcaagcctgcccgtgtgcttctgcaggattttactggtgtcccagctatcgtagatcttgcaagcatgcgcgatgctatggctcaactgggcgatgatcctggcaagattgatcccatgattccagtggatctagtcattgatcattcggtacaggctgatgtggtaaaatcagagaatgccctccaagctaatatgcaacgcgaattcgacaggaacaaggagcgcttcgccttccttcggtggggctctacggcattcaataatatgcttattgttccaccaggttcaggaattgttcaccaggtgaatcttgaatatcttggacgagttgttttcaatacggatggcattttatatcttgacagtgtgctgggaacggattctcacactactatgattgatggaatgggggttgctggctggggtgttgggggaattgaagcagaagcaacaatgcttggtcagccaatgagcatggtcttgcccagtgtagttggatttaaactgacagggaaattgcgtgatggtgttactgcaaccgacttagtcctgacagtgacacatattcttaggaagcatggtgttgttggcaaatttgttgagttttatggtgaggggatgagtgagttagcagttgctaacagggcaacaattgctaacatgtcaccagaatacggtgcaacaatgggcttcttccctgttgatcatgtgacccttggatacctgaagctgacagggagaagtgatgaaaaggttgacatggtagaggcatatcttcgagctaacaaaatgtttgttgattacaacgagactcaaacagaaagagtttactcatcgtacctagagttagatcttgcagatgttgaaccatgtgtttcaggcccgaaaagacctcatgaccgtgttgctctgaaagatatgaaagcagactggcgtgcctgtctcagaaataaagttggttttaagggctttggcatacctaaagagcaacaggataaactagtcaagttcaccttccatggacaacctgcagagattagacatggtagcattgtgatcgctgccataacaagttgcacaaacacctcgaacccaagtgtcatgcttggtgctggccttgttgcaaagaaggcgtgtgagcttggccttgaggttaatccatggattaaaactagtcttgcgccaggatccggggcagtgaccaaatatctgctgaagagtggcttgcaaaagtatttagatcatctaggtttcaacttaattggatatggctgtacaacatgcattggtaactctggggagcttgatgaagatgttgctaaggcagttactgacaacgatatcattgctgctgcagtactctctggtaacaggaacttcgaagggcgaattcatgcattggttcgggccaattaccttgcctcccctcctctggttgtggcctatgcccttgctggcactgttgatattgattttgagacggaaccaattgggaaaggaaaaaatggaaaagatgtgtacttcaaggacatatggccatcaaatgaagaaattgcagaggttgagcaatcaagtgtgctgcctgacatgttcaggagcacctatgaagcaatcacacaaggcaacccaatgtggaaccagctgtcagttcccaaggcaaagcgcttcccatgggaccccagttccacctacattcatgatcctccgttcttcaaggatattacaccgactccgccaggtccacgcagcatagagaatgcctattgcctgttgaagtttggtgacagcatcacgacagaccacatctcaccagctgggagcatccccagggacagccctgctggcatgtacctgcttgagcgcggtgtgcagccaaaggatttcaattcttatggaagccgtcggggcaacgacgaagtgatggcacgaggaacttttgcaaatatcaggattgtgaataggctgttaaatggagaagttggaccgaagacgattcacgtccctacaagtgataagctcttcgtgtttgatgctgcaatgagatacaaagctgatgggcatcataccatagtgttggctggagaggaatatggcagtggaagttctcgggattgggctgccaagggaccaatgttactgggggtcaaagcagtgatcgccaagagtttcgagaggatccaccgcagcaacctcgtgggaatgggagtgttaccgctgtgcttcaagcctggtgaggatgctgattctctggggctcaccggtcatgagcgctacacaataaggctccctaccaatgtgagtgagatacaaccgggccaagatgtccaagtggtcactgacactgggaagtcatttacctgcaagctccggattgataccctggtggagctggcttactttgatcatggcgggatccttcactacgttctgaggaacctggtgaagcagcaacagcagcagtaa

SEQ ID NO: 20565 - protein, 903 aa, Sorghum bicolor
  misc_feature: Ceres ANNOT ID no. 8655919
  misc_feature: Up-regulated in shoot tissues in response to salicylic acid treatment
  misc_feature: Up-regulated in root tissues in response to salicylic acid treatment
  misc_feature (8)..(899): SWISSPROT Homolog: EC 4.2.1.3 Aconitate hydratase
  misc_feature (59)..(569): Pfam ID: Aconitase Pfam Description: Aconitase family (aconitate hydratase)
  misc_feature (697)..(827): Pfam ID: Aconitase_C Pfam Description: Aconitase C-terminal domain
MADGNSRFGHVLTSLPKPGGGEYGKYYSLPALNDPRIERLPYSIRYLLESAIRNCDGFQITEKDVENIIDWENTAPKLVEIPFKPARVLLQDFTGVPAIVDLASMRDAMAQLGDDPGKIDPMIPVDLVIDHSVQADVVKSENALQANMQREFDRNKERFAFLRWGSTAFNNMLIVPPGSGIVHQVNLEYLGRVVFNTDGILYLDSVLGTDSHTTMIDGMGVAGWGVGGIEAEATMLGQPMSMVLPSVVGFKLTGKLRDGVTATDLVLTVTHILRKHGVVGKFVEFYGEGMSELAVANRATIANMSPEYGATMGFFPVDHVTLGYLKLTGRSDEKVDMVEAYLRANKMFVDYNETQTERVYSSYLELDLADVEPCVSGPKRPHDRVALKDMKADWRACLRNKVGFKGFGIPKEQQDKLVKFTFHGQPAEIRHGSIVIAAITSCTNTSNPSVMLGAGLVAKKACELGLEVNPWIKTSLAPGSGAVTKYLLKSGLQKYLDHLGFNLIGYGCTTCIGNSGELDEDVAKAVTDNDIIAAAVLSGNRNFEGRIHALVRANYLASPPLVVAYALAGTVDIDFETEPIGKGKNGKDVYFKDIWPSNEEIAEVEQSSVLPDMFRSTYEAITQGNPMWNQLSVPKAKRFPWDPSSTYIHDPPFFKDITPTPPGPRSIENAYCLLKFGDSITTDHISPAGSIPRDSPAGMYLLERGVQPKDFNSYGSRRGNDEVMARGTFANIRIVNRLLNGEVGPKTIHVPTSDKLFVFDAAMRYKADGHHTIVLAGEEYGSGSSRDWAAKGPMLLGVKAVIAKSFERIHRSNLVGMGVLPLCFKPGEDADSLGLTGHERYTIRLPTNVSEIQPGQDVQVVTDTGKSFTCKLRIDTLVELAYFDHGGILHYVLRNLVKQQQQQ

SEQ ID NO: 20566 - DNA, 1068 bp, Sorghum bicolor
  misc_feature: Ceres ANNOT ID no. 8655907
  misc_feature: Up-regulated in root tissues in response to methyl jasmonate treatment
  misc_feature: Up-regulated in shoot tissues in response to methyl jasmonate treatment
  misc_feature: Up-regulated in shoot tissues in response to salicylic acid treatment
  misc_feature: Encodes the peptide sequence at SEQ ID NO 20567
atggccggcgcactgcagccgccgccccagctgctgccgctgctgcttgcactcctcctcgtctctgctgccgcccctcaggttgttggagtgggggtcggagacaactccctgagaatcatccaggaggatattattgagacagtcaacaaccatcccagtgctgggtggacagcctcacgtaatccttacttttcaaactataccattgcgcaatttaagcacatacttggagtgaaaccagcaccaaagaatgtactcagtgatgttcctgtcaaaacttatccaagatcactggaacttccaaaagagtttgatgctagatctgtgtggtcccgttgcagcacaattgggaacatacttgatcaaggtcattgtggctcttgttgggcttttggtgctgtggagtgcctccaggaccgtttttgcattcacttcaacacgagcattttactttcagtcaatgacctactggcatgctgtggttttatgtgcggcgatgggtgtgatggaggctatcctataatggcatggcactactttgttcaaaatggtgttgttactgatgagtgtgatccatactttgatcagctcggttgcaagcatcctggatgtgaacctgcttatgatacacctaagtgtgaaaagaaatgcaaggtgcagaaccaagtttggcaggaaaagaagcattttagcattgatgcgtatagaataaattcagatccacatgacataatggcagaggtctacataaatggtcctgtagaagtcgctttcacagtttacgaggatttcgcacactacaaatctggagtatacaagcacatcaccggtggcattatgggtggccatgccgtcaagttgattggatggggaaccagtgatgctggagaggattactggcttcttgcaaatcagtggaataggggctggggcgatgatggttacttcaagatcataaggggcacaaatgaatgtggcatcgaggaggacgttgttgctggaatgccatctacaaagaatatggttccaaacttcggcagtgcagttggaacagctgtagtttaa

SEQ ID NO: 20567 - protein, 355 aa, Sorghum bicolor
  misc_feature: Ceres ANNOT ID no. 8655907
  misc_feature: Up-regulated in root tissues in response to methyl jasmonate treatment
  misc_feature: Up-regulated in shoot tissues in response to methyl jasmonate treatment
  misc_feature: Up-regulated in shoot tissues in response to salicylic acid treatment
  misc_feature (37)..(339): SWISSPROT Homolog: EC 3.4.22.1 Cathepsin B
  misc_feature (101)..(336): Pfam ID: Peptidase_C1 Pfam Description: Papain family cysteine protease
  misc_feature (41)..(84): Pfam ID: Propeptide_C1 Pfam Description: Peptidase family C1 propeptide
MAGALQPPPQLLPLLLALLLVSAAAPQVVGVGVGDNSLRIIQEDIIETVNNHPSAGWTASRNPYFSNYTIAQFKHILGVKPAPKNVLSDVPVKTYPRSLELPKEFDARSVWSRCSTIGNILDQGHCGSCWAFGAVECLQDRFCIHFNTSILLSVNDLLACCGFMCGDGCDGGYPIMAWHYFVQNGVVTDECDPYFDQLGCKHPGCEPAYDTPKCEKKCKVQNQVWQEKKHFSIDAYRINSDPHDIMAEVYINGPVEVAFTVYEDFAHYKSGVYKHITGGIMGGHAVKLIGWGTSDAGEDYWLLANQWNRGWGDDGYFKIIRGTNECGIEEDVVAGMPSTKNMVPNFGSAVGTAVV

SEQ ID NO: 20568 - DNA, 561 bp, Sorghum bicolor
  misc_feature: Ceres ANNOT ID no. 8655959
  misc_feature: Down-regulated in shoot tissues in response to salicylic acid treatment
  misc_feature: Encodes the peptide sequence at SEQ ID NO 20569
atggccaggcccatcaagtgcgaaggcccaggacttggagccagcccaagtagacaggttttcctcggcttctcgctgccacgtgccatgggcccaccggcaagtccactccgccgtcagccaccggaagaaagcgcccaaccgagagcaccagggaaaggagagtgcggcggcctaggcatcggcatggaggacgactacgtcacgatcccctacggcctgctgctcctagccggtggcgtcgccggctacgtcaagcgcggcagcgccgcttctctggctgctgggggcggattcggcgccgcgctcctcctcgccggcgcgctcagcgcctgggccttcgcgcgtggcgctggtggtgctgccgccatcttcgccaccgtcctccagatcgtttgtgctgtgctattgactgttgtcatgggaataagatacgtcaaaacacgaaagataatgcctgctggaattattgctgctatcagtgcactcgtattgatattttacgtgtacaagatatctactggtggcaacaaggtttatatcccggtggctgccgagtga

SEQ ID NO: 20569 - protein, 186 aa, Sorghum bicolor
  misc_feature: Ceres ANNOT ID no. 8655959
  misc_feature: Down-regulated in shoot tissues in response to salicylic acid treatment
  misc_feature (66)..(172): Pfam ID: TMEM14 Pfam Description: Transmembrane proteins 14C
MARPIKCEGPGLGASPSRQVFLGFSLPRAMGPPASPLRRQPPEESAQPRAPGKGECGGLGIGMEDDYVTIPYGLLLLAGGVAGYVKRGSAASLAAGGGFGAALLLAGALSAWAFARGAGGAAAIFATVLQIVCAVLLTVVMGIRYVKTRKIMPAGIIAAISALVLIFYVYKISTGGNKVYIPVAAE

SEQ ID NO: 20570 - DNA, 1656 bp, Sorghum bicolor
  misc_feature: Ceres ANNOT ID no. 8655951
  misc_feature: Up-regulated in root tissues in response to salicylic acid treatment
  misc_feature: Encodes the peptide sequence at SEQ ID NO 20571
atggaggcagattctctcgtcccctgcacagacgagacgagacgagacgacgtcggagcggggtgggcgatggatccgtcgaattcgaaggcggtagcggcgtcgttgccgtcctacggcaaggtgctggagacctacaagaaagcggcggccacggccgccacggtgaccgcgtacgccgtgctggcgcgcggcatggcgcgggagctgctgcccgacgagctgcgcgaggccgcgcgctgggccgctgatttcctgctgcacggcggcgccaggctgcgcgcgccaccgcagcgacggaccttcgtcatcaagcggttcgaccaggagagccccagcggcgacaacgggctcttcgcggacgcgagcgcgtacctcgccacccggatcgacccgcacaccaccacgcgggtctgcatcgcccgccgcagcgccgtcggccccggcggcggcggcggcggaggaggaggaggctacgactacgactacgaatacgaagacgcgtacggagacggagactgcggcggccgcgaagccgaagcccgagatgacggcggcggcggcggcgggaggcacgtcctgtccttggaagtcggcgacaggatggcggacatcttcgagggcgtcaagttcacgtggatgaccgtcggacagggacaggccaaaggcaacaacgaccacgtgacgtcgctggagctcaccttcgacgcggagcacacggacatggcgctcaaacggtacatcccgttcatagcggcgaccgcggaggcggcgcggctgcgggagcgcaccctcaagatcttctcgagcgacttcgggtcgtggcgcggcagcagctaccaccacccggccacgttcgacacgctggccatggacctggacctcaagcgctccatcatcgctgatctcgaccgcttcctcaagcgcaaggattactaccggcgcatcggcaaggcgtggaagcgcgggtacctgctctacggcccgccgggcaccggcaagaccagcctcgtcgccgccatggcgtgctacctccggttcaacctctatgacctcgatctctccaaggtggactccaactcctcgctgcagcgcctgctcacttccatgtccaacaagtgcatcctcgtcatcgaggacatcgactgctgctttagcgcaacaagccgtggcggcggcccagtgaagagcggcgacgatgacgacgatgaagacgacccatctccaccaaacgatgaggacaactactccaataggcgtcatcagagagagggcataacactgtccggcctgctcaacttcatcgacgggctatggtcgaccagcggcgaggagcgcatcatcgtcttcaccaccaactacaaggaccgcctcgacccggcgctgctccggccaggccggatggacatgcacgtctacatgggctactgtggctgggaggcattcaagacgctggctcggaactacttcctcgtcgacgaccacgtgttgttcccggagatgcaggagctgctctcggcagtggaggtgacgccggccgaggtgtcggagatgatgctacggagcgaggatgccgacgtcgcgctccagggactcaaggagttcctcgaggagaagaagcagggcaagcaaacaggagatgcgggaaaggcatga

SEQ ID NO: 20571 - protein, 551 aa, Sorghum bicolor
  misc_feature: Ceres ANNOT ID no. 8655951
  misc_feature: Up-regulated in root tissues in response to salicylic acid treatment
  misc_feature (323)..(530): Pfam ID: AAA Pfam Description: ATPase family associated with various cellular activities (AAA)
MEADSLVPCTDETRRDDVGAGWAMDPSNSKAVAASLPSYGKVLETYKKAAATAATVTAYAVLARGMARELLPDELREAARWAADFLLHGGARLRAPPQRRTFVIKRFDQESPSGDNGLFADASAYLATRIDPHTTTRVCIARRSAVGPGGGGGGGGGGYDYDYEYEDAYGDGDCGGREAEARDDGGGGGGRHVLSLEVGDRMADIFEGVKFTWMTVGQGQAKGNNDHVTSLELTFDAEHTDMALKRYIPFIAATAEAARLRERTLKIFSSDFGSWRGSSYHHPATFDTLAMDLDLKRSIIADLDRFLKRKDYYRRIGKAWKRGYLLYGPPGTGKTSLVAAMACYLRFNLYDLDLSKVDSNSSLQRLLTSMSNKCILVIEDIDCCFSATSRGGGPVKSGDDDDDEDDPSPPNDEDNYSNRRHQREGITLSGLLNFIDGLWSTSGEERIIVFTTNYKDRLDPALLRPGRMDMHVYMGYCGWEAFKTLARNYFLVDDHVLFPEMQELLSAVEVTPAEVSEMMLRSEDADVALQGLKEFLEEKKQGKQTGDAGKA

SEQ ID NO: 20572 - DNA, 2490 bp, Sorghum bicolor
  misc_feature: Ceres ANNOT ID no. 8655964
  misc_feature: Down-regulated in shoot tissues in response to methyl jasmonate treatment
  misc_feature: Down-regulated in root tissues in response to methyl jasmonate treatment
  misc_feature: Down-regulated in shoot tissues in response to salicylic acid treatment
  misc_feature: Encodes the peptide sequence at SEQ ID NO 20573
atggcggagctcaagtcgcgcgtgctcgccgcgctcgccaagctctcggaccgcgacacgcaccacatcgccgtcgaggagctggaccgcatcatccgcgcgccgccgtcgaccgacgccgtgcccatgctgctcaacgcgctggcatccgactcccaggggctcgcctccccggccaggcgcgagtcgctgcgcctcctcgccacgctctgcgcgtcgcacccggacgccgccgcgccgcacctccacaaggtgctcgcccacctcgcgcggcggctcaaggacccggcgtccgacacctccgtgcgcgacgcgtgccgagacgtcgcgggccagcttgcggcagtgtacctccgccctctgtccgcttccggcgttgccgaggcgggcaatgcgaccgtgacgctgttcgtgaagccgctgttcgaggtgatgggggagcagagcaaagcggtgcagggtggggcggccgcatgcttggccaaggcggtggaaggggcggggcctgggccgggtgccatcgggatgtttggaaagctcggccctaggatttgcaagttactcagtgggcagggcgtgcaagccaaggcagcattgctcggcgtcatgggaagtttggcacaggtgggagcaatcagttcgcagaatatgcagcagactctgcaaagcatccgcgactgccttgagaacagcgattgggctactagaaaagcagctgctgatacattatgtgtctttgctacccattccggtcacttgataggtgatggaacagctccaaccattgctgctctagaagcttgccgttttgataaggtaaggcctgtcagagatagcatgattgatgcagtacagttgtggaaaaagttgtctggagaagatggaaatgattcacctagtaacaacgtgaagggcagtagcatagctgaaaaggcagcagttcttttgaagaaaagaccaacattaactgacagggaactgaaccctgagtttttccaaaagcttgagacaaggaaaacagatgacttggcagttgaggttgtagtcccccgcaagactctacaatctcacttacgaagtgaaggtgatacagaagaagatgatgatcctgttggtccagttgacagcaatggatcagctgaagatgaagcaaatctaactcaaatgcgtgctagctctaattttcaaaatatccgagataaatgggctggccaaaggggaaatagaaacaaagacacaaaagctaggacagctgatgttgaagataggggtgaacccagtacaaaagactccactgctgcaaccatgaacattcctggagaaggccctttcataaataataaaacaaattggttagcaatacagaggcaattgacacacttggagagacagcaaactagtctcatgaacatgttgcaggatttcatgggaggatctcatgacagtatggttactttagagaacagagtacgcggtcttgagagagttgttgaggaaatggctagggaaatatcactctcgtcaggcaggagaggtggtggtccagcgctgggctttgattcgtctcctggaagatcatctaaatacaatggctttcatgaatattctaattcgaaatttggaaggggtggtgatggacggatgggatttgcagaaaggtatttctctgcagatggtatggcttctggcacgaaaaacccatcttggagaccagattctgaaccatgggactcatatgcttattctggttcaagaagcggtatgaatgcacggagaggattagatcctgtttcatctgacaataggatgccaagaaatgaacggagtaatgatcaagcgggtccccgtagaggttgggacaaagggcagggacccttcaggtttggtgagggtccttctgcccgaagtgcatggcgggcctcaaaagatgaagcaacactggaagctattagagtggctggtgaagataatggaaatataagggctactgcaagagttgctattcctgaactggacggagaagctttgaatgatgacaaccaaggggatgaaagaggcccactttgggaggcctggactcgcgcaatggatgctgttcatgttgatgatatggactctgcttatgctgaggttctttcaactggtgatgctgaattacttgtaaagttgatggagcaaactggaccagttgttgatcaactttcaaatgaggttgcaaatgaagtcctacatgccgtgggacagtttctcgtggaagaaagcttctatgacgtagctttgaactggcttcagcagttgactgatctggtaatggaaaacggctctgattatctcggaatacctctagatgcaaagcaggacctcttacttggacttcatgaggctacagcgattgagctgcctgatgactgggagggagcgacacccatgcagataatgaagcagctagcttcgtcctggcgcatcgacctgcagcaacttatcaattag

SEQ ID NO: 20573 - protein, 829 aa, Sorghum bicolor
  misc_feature: Ceres ANNOT ID no. 8655964
  misc_feature: Down-regulated in shoot tissues in response to methyl jasmonate treatment
  misc_feature: Down-regulated in root tissues in response to methyl jasmonate treatment
  misc_feature: Down-regulated in shoot tissues in response to salicylic acid treatment
MAELKSRVLAALAKLSDRDTHHIAVEELDRIIRAPPSTDAVPMLLNALASDSQGLASPARRESLRLLATLCASHPDAAAPHLHKVLAHLARRLKDPASDTSVRDACRDVAGQLAAVYLRPLSASGVAEAGNATVTLFVKPLFEVMGEQSKAVQGGAAACLAKAVEGAGPGPGAIGMFGKLGPRICKLLSGQGVQAKAALLGVMGSLAQVGAISSQNMQQTLQSIRDCLENSDWATRKAAADTLCVFATHSGHLIGDGTAPTIAALEACRFDKVRPVRDSMIDAVQLWKKLSGEDGNDSPSNNVKGSSIAEKAAVLLKKRPTLTDRELNPEFFQKLETRKTDDLAVEVVVPRKTLQSHLRSEGDTEEDDDPVGPVDSNGSAEDEANLTQMRASSNFQNIRDKWAGQRGNRNKDTKARTADVEDRGEPSTKDSTAATMNIPGEGPFINNKTNWLAIQRQLTHLERQQTSLMNMLQDFMGGSHDSMVTLENRVRGLERVVEEMAREISLSSGRRGGGPALGFDSSPGRSSKYNGFHEYSNSKFGRGGDGRMGFAERYFSADGMASGTKNPSWRPDSEPWDSYAYSGSRSGMNARRGLDPVSSDNRMPRNERSNDQAGPRRGWDKGQGPFRFGEGPSARSAWRASKDEATLEAIRVAGEDNGNIRATARVAIPELDGEALNDDNQGDERGPLWEAWTRAMDAVHVDDMDSAYAEVLSTGDAELLVKLMEQTGPVVDQLSNEVANEVLHAVGQFLVEESFYDVALNWLQQLTDLVMENGSDYLGIPLDAKQDLLLGLHEATAIELPDDWEGATPMQIMKQLASSWRIDLQQLIN

SEQ ID NO: 20574 - DNA, 1302 bp, Sorghum bicolor
  misc_feature: Ceres ANNOT ID no. 8656017
  misc_feature: Down-regulated in shoot tissues in response to aminocyclopropane carboxylic treatment
  misc_feature: Down-regulated in shoot tissues in response to methyl jasmonate treatment
  misc_feature: Down-regulated in shoot tissues in response to salicylic acid treatment
  misc_feature: Encodes the peptide sequence at SEQ ID NO 20575
atgattgggagcgccaagccgctcgcggcgccgctgcagccgccgtcccccaccgctcgctgcctcgccccctcgtcctgcgcccctgactcccccccacctctcacccgcgccgtcaagagcccagctgcccagtctcagtctcagtctcagtctgacgccgccccggccccgccaccaccacgcccggctgaggccgccgcctcgtcccacgtgctgcgcgcgagcccgcagctcagccggtggtcccgggcgcgggcgctgcggtcgggccgccggccggggtcggagtcgtcggaccgcgccaagctgtcctcggcctcggtgctgccggcgaccaagtcgccgcggcccgaggacgctgcggtggcggtggaggatggcggggacgacgacgtgtgcgtggccgagagggacgccgcgcccgggaaggccatctacatcgtgtcggacgggaccgggtggaccgcggagcacgcggtgaacgccgcgctcggacagttcgagcactgcttcgtcgaccgcggctgcgctgtcaacacccacctcatctccatgattaacgacatggatcgaattcttgaggtaataaagcaagcagcaaaggaaggggcactggttctatatacccttgctgatccttcaatggctgaatcagctaagaaggcctgcgatttctggggtgttccgtccactgatgttcttcggcctacaattgaagccattgcttctcatattggtgttgctccatctggaattccacgaagctctcctagtcgacagggtaaactaacagaggactactttcgacggattgatgctattgattttaccatcaaacaagatgatggggctctgccacagaacctcaaccgtgcagacattgtacttgctggtgtttcacgtacagggaagacaccattgtcaatatatctagctcaaaagggatacaaggtagcaaatgtcccaattgtgatgggagtgaatcttccaaagaccctttttgagatcagccaagacaagatttttggattgacagtaaacccggtggttcttcaagcaattagaaagactagggccaaagctctaggttttggtgatgggtatcagagccattatgccgaaatggaacatgtgaggcaggaactgctccatgcaaatcaaatttttgctcaaaacccaacgtggccagtcattgggatcactggaaaagctatagaggaaacagctgctgtcattgtgaggatttaccatgacaggaaacagaagtgctccatgccacgcatatcaaaacggtactag

SEQ ID NO: 20575 - protein, 433 aa, Sorghum bicolor
  misc_feature: Ceres ANNOT ID no. 8656017
  misc_feature: Down-regulated in shoot tissues in response to aminocyclopropane carboxylic treatment
  misc_feature: Down-regulated in shoot tissues in response to methyl jasmonate treatment
  misc_feature: Down-regulated in shoot tissues in response to salicylic acid treatment
MIGSAKPLAAPLQPPSPTARCLAPSSCAPDSPPPLTRAVKSPAAQSQSQSQSDAAPAPPPPRPAEAAASSHVLRASPQLSRWSRARALRSGRRPGSESSDRAKLSSASVLPATKSPRPEDAAVAVEDGGDDDVCVAERDAAPGKAIYIVSDGTGWTAEHAVNAALGQFEHCFVDRGCAVNTHLISMINDMDRILEVIKQAAKEGALVLYTLADPSMAESAKKACDFWGVPSTDVLRPTIEAIASHIGVAPSGIPRSSPSRQGKLTEDYFRRIDAIDFTIKQDDGALPQNLNRADIVLAGVSRTGKTPLSIYLAQKGYKVANVPIVMGVNLPKTLFEISQDKIFGLTVNPVVLQAIRKTRAKALGFGDGYQSHYAEMEHVRQELLHANQIFAQNPTWPVIGITGKAIEETAAVIVRIYHDRKQKCSMPRISKRY

SEQ ID NO: 20576 - DNA, 1689 bp, Sorghum bicolor
  misc_feature: Ceres ANNOT ID no. 8656016
  misc_feature: Down-regulated in shoot tissues in response to aminocyclopropane carboxylic treatment
  misc_feature: Down-regulated in shoot tissues in response to methyl jasmonate treatment
  misc_feature: Down-regulated in shoot tissues in response to salicylic acid treatment
  misc_feature: Encodes the peptide sequence at SEQ ID NO 20577
atgattgggagcgccaagccgctcgcggtcgcggcgccgttgcagccgccgtcccccgccggtcgccgcctcgccccattgttctgcgcccctgactcctctccagctctcacccgcgccgtcgagagcccaggccaatctcagtctgacggcgccccaccaccacgcccggatgaggtcgcctcgtccctcacgcggcgagcgagcccgcagctcagtcggtggtcccgcttgcgaacgctgcggtcgaaccgccggcctgggctggaccgtggggtgctctcctcggcctcgtcctcggcctcggcgccgccggtgaccaagacgtcgcggcccgaggacggtgcggtggcggtggaggatggagaggacgacgacgtgcctggtgggaagtccatctacatagtgtcggatgggaccgggtggaccgcggagcactcggtgaacgccgcgctcggacagttcgagcactgcttcgtcgaccgcggctgtgctgtcaacacccacctcttctccatgattaacgacatggatcgaattcttgaggtaataaagcaagcagcaaaggaaggggcactggttctatatacccttgctgatccttcaatggctgagtcagctaagaaggcctgcgatttctggggtgttccatccactgatgtcctccggcctactgttgaagccattgcttctcatatgggtgttgctccatctggaattccacgaagctctcctagtcgaccgtgtcagctaacagaggattactttcgacggattgatgccatcgattttaccatcaaacaagatgatggggcacagccagagaacctcaaccgtgcagacattgtacttgccggcgtttcacgtacagggaagacaccattgtcgatatatctagcccaaaagggatacaaggtagcaaatgtcccaattgtgatgggagtgaatcttccaaagactctttttgagatcagccaagacaaggtttttggattgacaataaacccagtggttcttcaagcaattagaaagactagggccaaagctctaggttttgctgatgggcagagcaattatgctgaaatggatcatgtgaggcaggaactgctccatgcaaatcaaatttttgctcaaaatccaatgtggccagtcattgcggtcactgggaaagctatagaggaaacagctgctgtcgttgtgaggatttaccttgacaggaaacagaagtactccatgccacgcatatcaaaacgggtggctccagctctagtaacacttatatcgagtatcacaagcgtgtcgacgtcagggtcgcgtacgcgcatccgcttcgccgtggggcttccccacgatactccagccctctccttccacatctacctcggtgatttcctctcccgcatcttcccctctgctggccgtgtcattgccaacgccgacacgggcgtgcccgctatcgactgtgacaacgccggcacggagctcgtggtggcgcacgctgaggtgaggcaccaaccacctgctcgtggacggccacggcctgccggcgttgcccaacgcgtgggcggaggcacggagatactctgcaccgtcgtgcaccgcaactacgtggagtccgccacgacgtcgggtgtggtggacacgcgccacctgcagctagcagcgccaccatctcctctgcggcaatga

SEQ ID NO: 20577 - protein, 562 aa, Sorghum bicolor
  misc_feature: Ceres ANNOT ID no. 8656016
  misc_feature: Down-regulated in shoot tissues in response to aminocyclopropane carboxylic treatment
  misc_feature: Down-regulated in shoot tissues in response to methyl jasmonate treatment
  misc_feature: Down-regulated in shoot tissues in response to salicylic acid treatment
MIGSAKPLAVAAPLQPPSPAGRRLAPLFCAPDSSPALTRAVESPGQSQSDGAPPPRPDEVASSLTRRASPQLSRWSRLRTLRSNRRPGLDRGVLSSASSSASAPPVTKTSRPEDGAVAVEDGEDDDVPGGKSIYIVSDGTGWTAEHSVNAALGQFEHCFVDRGCAVNTHLFSMINDMDRILEVIKQAAKEGALVLYTLADPSMAESAKKACDFWGVPSTDVLRPTVEAIASHMGVAPSGIPRSSPSRPCQLTEDYFRRIDAIDFTIKQDDGAQPENLNRADIVLAGVSRTGKTPLSIYLAQKGYKVANVPIVMGVNLPKTLFEISQDKVFGLTINPVVLQAIRKTRAKALGFADGQSNYAEMDHVRQELLHANQIFAQNPMWPVIAVTGKAIEETAAVVVRIYLDRKQKYSMPRISKRVAPALVTLISSITSVSTSGSRTRIRFAVGLPHDTPALSFHIYLGDFLSRIFPSAGRVIANADTGVPAIDCDNAGTELVVAHAEVRHQPPARGRPRPAGVAQRVGGGTEILCTVVHRNYVESATTSGVVDTRHLQLAAPPSPLRQ

SEQ ID NO: 20578 - DNA, 1980 bp, Sorghum bicolor
  misc_feature: Ceres ANNOT ID no. 8656075
  misc_feature: Down-regulated in shoot tissues in response to salicylic acid treatment
  misc_feature: Encodes the peptide sequence at SEQ ID NO 20579
atggctcaagctcaatgccccttgccgccattgctgctggtccttgccgctgtcgtgctgctcgtgccgcgagccgcgggttacccatggcaggtatgcggcaagacgggcaacttcacggccaacagcacgtaccaggccaatctcgccctgctcgccgtcgccctgcccaagaacatctcatcgtccccggacctcttcgcgaccgccgtcgtcggcgccgtcccggagcaggtctcggcgctctcgctctgccgcggggacgccaacgccacgacctgctccgcctgcctcgtcacggccttccaggacgtccagaacatgtgctccttcgacaggagcgccgccatctactacgacccctgcattctctactactccgacgacggcggcttcctctcctccggcgacaacgtcgcgtcagcgtcgacggaccgcatcaacctccggaacgtcacgtcggacccggcccggttcaaccgcctcgtcggcgcgctggtgaacgccaccgccgactacgccgcgtacaactcgacgcggcggtacgccgccggggaggccgacttcgaccaggagtaccccaaggtcaaggtgtacagctgggcgcagtgcacgccggacctgacgccggcgcagtgcagggtatgcctcgccggcatcatcgccgagatgccgaggctgttcacggaccgcgtcggcggcagggttctcgggatcaggtgcagttaccggtacgaggtgtactccttcctcaacagcccggtgatggtccagttggcgttgggatccccaacaccggcgatggggcccacgagtgtcacgcctgcggctgctggaggagggaggaagtatagcgtccccgtctccgtacttgtaatactgctgccgaccatagcaggtttgctggtcattaacctgctcatctggctttgtttgtggagaaggagaccacaaacaggaggaacccaatcaaatcccactcattccactgaaacagaaggcatggagagcatagaatcgatgatcattgacatctccaccctgcgagctgcgacgcgggatttcgacgagagtaacaagctcggcgaaggcgggtttggtgcagtgtacaaaggtactctcccggacggcaatgaaatagcggtgaagaggctatcaaggcaatcagctcaaggaatcggagagctgaagaatgagctcgccctggttgccaagcttcagcacaagaatctcgtcagtctagtaggcgtctgcctggaacagcaggagaggttgctcgtctacgagtttgttcccaaccgcagccttgatcagatactcttcgacactgagaagcgtgaacagctggactggacaatgaggtgcagcatcatacacgggatagctcggggcctgcagtacctgcacgaagactctcagctcaaggtagtccaccgtgatctcaaagcgagcaacatcttgctggacatgaacatgaaccccaagatttcggacttcggccttgcgaggcttttcagacgagaccagacgcagggtgtcaccaatcatgtcgttggtacctacggttacatggcgccggagtacgtgatgcgcgggaactactccgtcaagtcagacgtgtacagcttcggcgtcatggtccttgagatcgtgacgggaaagaagcacaacgtctgccgggacgacgacgcctggcgatcgcgtgatgaagacgatctcttgagcctcgtatgggaccactggacggccggggtggtgccggaggcgatcgtagacccgtgcctgggaagaagctgcttctgccggagcgacgtgctaaggtgcatccaaattggtctgctatgcgtccaggaagacccggcagaccggccggtgatgtcgtccgtcgtaatgatgctcggaagcgacacggtctccctttggaacccgtccaacccggcgttctacggcaggaacagggcgccggccacctccagctag

SEQ ID NO: 20579 - protein, 659 aa, Sorghum bicolor
  misc_feature: Ceres ANNOT ID no. 8656075
  misc_feature: Down-regulated in shoot tissues in response to salicylic acid treatment
  misc_feature (348)..(636): SWISSPROT Homolog: EC 2.7.11.1 Non-specific serine/threonine protein kinase
  misc_feature (355)..(631): Pfam ID: Pkinase Pfam Description: Protein kinase domain
MAQAQCPLPPLLLVLAAVVLLVPRAAGYPWQVCGKTGNFTANSTYQANLALLAVALPKNISSSPDLFATAVVGAVPEQVSALSLCRGDANATTCSACLVTAFQDVQNMCSFDRSAAIYYDPCILYYSDDGGFLSSGDNVASASTDRINLRNVTSDPARFNRLVGALVNATADYAAYNSTRRYAAGEADFDQEYPKVKVYSWAQCTPDLTPAQCRVCLAGIIAEMPRLFTDRVGGRVLGIRCSYRYEVYSFLNSPVMVQLALGSPTPAMGPTSVTPAAAGGGRKYSVPVSVLVILLPTIAGLLVINLLIWLCLWRRRPQTGGTQSNPTHSTETEGMESIESMIIDISTLRAATRDFDESNKLGEGGFGAVYKGTLPDGNEIAVKRLSRQSAQGIGELKNELALVAKLQHKNLVSLVGVCLEQQERLLVYEFVPNRSLDQILFDTEKREQLDWTMRCSIIHGIARGLQYLHEDSQLKVVHRDLKASNILLDMNMNPKISDFGLARLFRRDQTQGVTNHVVGTYGYMAPEYVMRGNYSVKSDVYSFGVMVLEIVTGKKHNVCRDDDAWRSRDEDDLLSLVWDHWTAGVVPEAIVDPCLGRSCFCRSDVLRCIQIGLLCVQEDPADRPVMSSVVMMLGSDTVSLWNPSNPAFYGRNRAPATSS

SEQ ID NO: 20580 - DNA, 1344 bp, Sorghum bicolor
  misc_feature: Ceres ANNOT ID no. 8656219
  misc_feature: Down-regulated in shoot tissues in response to methyl jasmonate treatment
  misc_feature: Down-regulated in root tissues in response to methyl jasmonate treatment
  misc_feature: Down-regulated in shoot tissues in response to salicylic acid treatment
  misc_feature: Encodes the peptide sequence at SEQ ID NO 20581
atggggaaggagaaggttcacatcaacattgtggtcattggtcatgttgactccggcaagtccaccaccaccggccacctcatctacaagcttggaggcatcgacaagcgtgtcatcgagaggtttgagaaggaggctgccgagatgaacaagaggtccttcaagtacgcctgggtgcttgacaagctcaaggccgagcgcgagaggggcatcaccattgacattgccctgtggaagtttgagaccaccaagtactactgcactgtgatcgacgctcctgggcaccgtgacttcatcaagaacatgatcaccggcacctcccaggctgattgtgcggtgctcatcattgactccaccactggtggctttgaggctggtatctccaaggacggccagacccgtgagcacgcactccttgctttcactcttggtgtcagacagatgatctgctgctgcaacaagatggatgccaccacccccaagtactccaaggctcggtacgacgagatcgtcaaggaagtgggttcctacctcaagaaggtggggtacaacccggacaagatccccttcgtgcccatctctgggttcgagggtgacaacatgatcgagaggtctacgaacctggactggtacaagggccccaccctccttgaggcgctggaccagattaacgagcccaagcggccctcggacaagcccctgcgccttcccctgcaggacgtgtacaagatcggcggcatcggcaccgtcccggtgggccgtgtggagaccggcctcattaagcccggcatggtggtcacctttggccccacgggcctgacgacggaggtcaagtcggtggagatgcaccacgagtcgatgcaggaggcgcttcccggcgacaacgtcggcttcaacgtcaagaacgtggcggtcaaggacctgaagcgtggctacgtggcctccaactccaaggacgaccccgccaaggaggctgccagcttcaccgcgcaggtgatcatcatgaaccaccccgggcagatcggcaacggctacgccccggtgctggactgccacacctcccacatcgccgtcaagttctcggagctgctcaccaagatcgaccggcggtcgggcaaggagctggagagcgcccccaagttccttaagaatggtgatgccggcttcgtcaagatgatccccacaaagcccatggtggtggagaccttctcggagtatcctccactggggcgcttcgctgttcgtgacatgaggcagacggttgcggtcggtgtgataaagagcgtggagaagaaggacccgacgggagccaaggtgaccaaggcggctgccaagaagaaatga

SEQ ID NO: 20581 - protein, 447 aa, Sorghum bicolor
  misc_feature: Ceres ANNOT ID no. 8656219
  misc_feature: Down-regulated in shoot tissues in response to methyl jasmonate treatment
  misc_feature: Down-regulated in root tissues in response to methyl jasmonate treatment
  misc_feature: Down-regulated in shoot tissues in response to salicylic acid treatment
  misc_feature (3)..(424): SWISSPROT Homolog: EC 2.7.7.4 Sulfate adenylyltransferase
  misc_feature (5)..(225): Pfam ID: GTP_EFTU Pfam Description: Elongation factor Tu GTP binding domain
  misc_feature (322)..(430): Pfam ID: GTP_EFTU_D3 Pfam Description: Elongation factor Tu C-terminal domain
  misc_feature (248)..(315): Pfam ID: GTP_EFTU_D2 Pfam Description: Elongation factor Tu domain 2
MGKEKVHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVRQMICCCNKMDATTPKYSKARYDEIVKEVGSYLKKVGYNPDKIPFVPISGFEGDNMIERSTNLDWYKGPTLLEALDQINEPKRPSDKPLRLPLQDVYKIGGIGTVPVGRVETGLIKPGMVVTFGPTGLTTEVKSVEMHHESMQEALPGDNVGFNVKNVAVKDLKRGYVASNSKDDPAKEAASFTAQVIIMNHPGQIGNGYAPVLDCHTSHIAVKFSELLTKIDRRSGKELESAPKFLKNGDAGFVKMIPTKPMVVETFSEYPPLGRFAVRDMRQTVAVGVIKSVEKKDPTGAKVTKAAAKKK

SEQ ID NO: 20582 - DNA, 3363 bp, Sorghum bicolor
  misc_feature: Ceres ANNOT ID no. 8656371
  misc_feature: Up-regulated in root tissues in response to methyl jasmonate treatment
  misc_feature: Encodes the peptide sequence at SEQ ID NO 20583
atggcgtccgccgaggaccaggccgcggccgccgcgctgctggggggcgacccggcggcgttcgacgcgctgctctcgacgctcatgtcgtcctccaacgccgaccgctccgccgccgaggccgccttccaccgcctccgggcctcgcacccggagcccctcgcgctgaggctcgccacctcgctcgcggcgcctgccacccccgctgacctgcgcgccatggcgggggtcctcctccggaaggtcctctccccgaccccgtcctccgacgcatcctccaacaacgcagccgcgtccccggcgccgctctggccgcagctctctcccgcggggcagaccgcgctcaaggcgcacctcctctccgcgctccagtccgatcctcccaagcccatcgctaagaaggtctgcgacgccgtctctgagctcgccgcctcgctgctgcccgagaacgcctggcccgagctgctgccgttcctcttccgcgctgcgtcgggtgctgaggcgcccaacctccaggagtcagcgctgcttatcttcgcgaggctggcggattacatcgcggagtcgctcctcgaccatctgatgactatccacaacctcctcgcctccgccctggcgcatcccacgtcccctgatgttcggattgccgccctgggtgccgcagtcaacctcgtccagtgcctgccaaccaactccgaccgggataagatgcaggatttgctcccagcaatgatgagggcgctcactgattgcctaaactctggccaggaggcctctgcgcaggaggcactggagctgctcgtcgagcttgctggcgctgagccaaggttcctgaggaggcagattgctgatgtggtgggggcaatgttgcaagttgctgaggctgcacagctggaagatgggaccagacacttggcggtggagtttgtgattacccttgctgaggctagggagcgtgcaccaggaatgatgcggcgactcccccagtttgttggtaggctgtttgcagtgctgatgcagatgctgcttgatgtcgaggatgaccctgcatggcactctgctgaaactgaagatgaggacgcaggggaagggaacaactatggagtggcacaggagtgccttgaccgccttgccatcgccattggagggaacgcaattgtgccaattgcatctgagctgctaccacagtacctgtctgctcctgagtggcagaagcaccatgctgcgctcattacacttgcacagattgcggaaggatgtgcaaaggttatgcttaaaaatttggaacaagtcgtttcgatgatattgaatggatttcaacatccccacccgcgtgtgagatgggctgctatcaatgccattggtcagctctctacggatttgggtcctgatcttcaagttcattaccaccagcaggtgctgcctgcattggcgaacgctatggatgatttccagaatccacgagttcaggcacatgcagcttcagcaattttgaattttagtgagaattgtacaccggaaattttgacgccttacctggatggaatcgtgaacaaattacttgttcttcttcaggagggagcattgacagctctagcgtcagtagcagattcatcacaggaccacttcaagaaatactatgatgctgttatgccatacctaaaatctatcttgatgcatgcaactgataagtccaataggatgcttcgtgccaagtccatggagtgtataagtttggtaggaatggctgtgggtaaggacaagttcagagacgacgcaaggcaggttatggaagtacttatggctttgcaaggagctccgatggaaacagatgatccaattaccagctacatgttgcaggcttgggccaggctatgcaaatgtcttggacaggattttcttccttacatgagtgttgttatgcctccactgcttcagtctgctcagctgaagcctgatgttacgattacttcagccgaatcagatgatgatattgagtcagatgatgatagcattgaaacaatcacacttggtgacaaaagaattggaatccgaactagtgtgctggaagagaaagcaacagcttgcaacatgctgtgctgctatgctgatgagcttaaggagggtttcttcccatggattgatcaggttgccccaacgttggtccctctgctgaagttttacttccacgaggaagtcagaagagctgctgttgcagccatgcctgaactcctacgctcggcaaagttggctgttgagaaggggcaggctcaaggccgtgatcagtcttatgttaaacagttgtctgactacataattccagcacttgttgaagcactgcacaaggagccagaaacagaaatgtgctcatccatgctggattctttaaatgagtgtatgcagctttctggtcttctgcttgatcaaacccaagtacgagctatctcggatgagattaaaaatgtcattatagccagcgctacccggaaaagagaacgttctgagagaacaaaagcggaagattttgatgctgatgaaggagagctactcaaagaagagaatgaacaggaggaggaagtatttgatcaggtcagcgagtgcctaggaactttgattaaaaccttcaaagcttctttcttgcccttttttgaagagctctctatgtacattacaccaatgttgggaaaggataaaacacccgaagagagaaggatagctatctgtatttttgatgatgttgcagagcaatgccgtgaatcagctttgaagtattatgacacataccttcctttccttttggaggcttcaaacgatgaaaattcagatgttcggcaggctgctgtctatggtgtgggtgtatgtgccgagtttggtggtcatgtttttcgccctctagtaggagaggccctatcgaaattaaacaatgttataagacatcctgaggcacgacttccagacaatatcatggcatatgataatgctgtttcggcacttggaaaaatatgccaatttcatcgtgatggtattgatgcagctcaggttattccagcctggcttagctgcttgcctataaaagacgacaagattgaagctaaagttgtacatgaacaactttgctcaatggtggagaggtcggattctgaaattctcggtcctcaaagccagtatcttcctaaaattgtttcaatttttgcagaggttttgtgcaatggaacagaactcgccacagatgaaactagaaacaggatggtgaatatcttgaggcgtttccagcagactttgcctcctgattttcttgcatcaacgttttccaacttgcaaccgcagcaacagctactgctacagtccatcttgtcgacatag

SEQ ID NO: 20583 - protein, 1120 aa, Sorghum bicolor
  misc_feature: Ceres ANNOT ID no. 8656371
  misc_feature: Up-regulated in root tissues in response to methyl jasmonate treatment
  misc_feature (425)..(461): Pfam ID: HEAT Pfam Description: HEAT repeat
  misc_feature (922)..(958): Pfam ID: HEAT Pfam Description: HEAT repeat
MASAEDQAAAAALLGGDPAAFDALLSTLMSSSNADRSAAEAAFHRLRASHPEPLALRLATSLAAPATPADLRAMAGVLLRKVLSPTPSSDASSNNAAASPAPLWPQLSPAGQTALKAHLLSALQSDPPKPIAKKVCDAVSELAASLLPENAWPELLPFLFRAASGAEAPNLQESALLIFARLADYIAESLLDHLMTIHNLLASALAHPTSPDVRIAALGAAVNLVQCLPTNSDRDKMQDLLPAMMRALTDCLNSGQEASAQEALELLVELAGAEPRFLRRQIADVVGAMLQVAEAAQLEDGTRHLAVEFVITLAEARERAPGMMRRLPQFVGRLFAVLMQMLLDVEDDPAWHSAETEDEDAGEGNNYGVAQECLDRLAIAIGGNAIVPIASELLPQYLSAPEWQKHHAALITLAQIAEGCAKVMLKNLEQVVSMILNGFQHPHPRVRWAAINAIGQLSTDLGPDLQVHYHQQVLPALANAMDDFQNPRVQAHAASAILNFSENCTPEILTPYLDGIVNKLLVLLQEGALTALASVADSSQDHFKKYYDAVMPYLKSILMHATDKSNRMLRAKSMECISLVGMAVGKDKFRDDARQVMEVLMALQGAPMETDDPITSYMLQAWARLCKCLGQDFLPYMSVVMPPLLQSAQLKPDVTITSAESDDDIESDDDSIETITLGDKRIGIRTSVLEEKATACNMLCCYADELKEGFFPWIDQVAPTLVPLLKFYFHEEVRRAAVAAMPELLRSAKLAVEKGQAQGRDQSYVKQLSDYIIPALVEALHKEPETEMCSSMLDSLNECMQLSGLLLDQTQVRAISDEIKNVIIASATRKRERSERTKAEDFDADEGELLKEENEQEEEVFDQVSECLGTLIKTFKASFLPFFEELSMYITPMLGKDKTPEERRIAICIFDDVAEQCRESALKYYDTYLPFLLEASNDENSDVRQAAVYGVGVCAEFGGHVFRPLVGEALSKLNNVIRHPEARLPDNIMAYDNAVSALGKICQFHRDGIDAAQVIPAWLSCLPIKDDKIEAKVVHEQLCSMVERSDSEILGPQSQYLPKIVSIFAEVLCNGTELATDETRNRMVNILRRFQQTLPPDFLASTFSNLQPQQQLLLQSILST

SEQ ID NO: 20584 - DNA, 1533 bp, Sorghum bicolor
  misc_feature: Ceres ANNOT ID no. 8656424
  misc_feature: Up-regulated in root tissues in response to methyl jasmonate treatment
  misc_feature: Up-regulated in shoot tissues in response to methyl jasmonate treatment
  misc_feature: Down-regulated in root tissues in response to salicylic acid treatment
  misc_feature: Up-regulated in shoot tissues in response to salicylic acid treatment
  misc_feature: Encodes the peptide sequence at SEQ ID NO 20585
atggcttccgccgacctcgcagaggccatcgagcccacgaagaagagcaacgtcaagtatgcctccatctgtgctatcctcgcctccatggcctccgtcatactcggctatgacattggggtgatgagtggagcggcgatgtacatcaagaaggacctgaagatcacggacgtgcagctggagatcatgataggaattctcagtgtctactcgctgatcggatccttcgctggcgcgcggacgtccgacaggatcggtcgccgcttgactgtcgtcttcgctgctgtcatcttcttcgtgggcgcgttgctcatgggtttcgccgtcaactacggcatgctcatggtgggacgcttcgtggccggagttggtgtgggcttcgggggtatgatcgcgcccgtgtacaccgccgagatctcgccggcggcatcccgcggcttcctcacgtccttcccggaagtgttcatcaacatcggtatcctgctcggctacttgtcgaacttcacgttcgctcgcctcccgctccacctcggctggcgtgtcatgctcggcatcggcgcagcgccgtccgccctgctcgcgctcatggtgttctgcatgcccgagtcgcctcggtggcttgtcatgaagggccgcctcgcggacgccagggctgtgctagagaagacctctgcctcgccagaggaggccgcagagcggctggctgacatcaaggtcgccgcggggattccaaaggacctcgacggagacgtggtcaccgtaccaaaggagcggaacggtggcgagatgcaggtgtggaaggcgctcatcttttccccaatcccggcgatccgacgcatactgctatcgggcgtcggcctgcacttcttccagcaggcttctggcagcgattccgtcgtcctgtacagcccgagcgtgttcaagagcgcggggatcaccgacgacaacaagctcctgggcgtcacctgcgcggtgggcgtcagcaagacgcttttcatcctggtggccacgttcctgctggaccgcgtcgggcgtcggcctctgctgctgaccagcgcgggtggaatgatcgtagctctcatcggcctcgggacggggctcaccgtcgtggggcatcacccggacgccaagatcccgtcggccgtagctctgtgcatcgcgtccacgctggcctacgtcgccttcttctcgatagggctcggccccatcacgggcgtgtacaactcggagatattcccactgcaggtgcgcgcgctaggcttcgcggtcggcatggcgtgcaaccgcgttaccagcgccgtgatctccatgaccttcctgtccctctcgaagggtatcaccatcggcggcagcttcttcctctactccggcatcgccgcggtggggtgggttttcttcttcacgtgccttccggagacccgcggtcgtacgctggaggagatgggcaagctgttcggcatgccagacatcgacatggctcaagcagacgacaccgctgccaaggagaaggtggtggaaatgcccaccatgtag

SEQ ID NO: 20585 - protein, 510 aa, Sorghum bicolor
  misc_feature: Ceres ANNOT ID no. 8656424
  misc_feature: Up-regulated in root tissues in response to methyl jasmonate treatment
  misc_feature: Up-regulated in shoot tissues in response to methyl jasmonate treatment
  misc_feature: Down-regulated in root tissues in response to salicylic acid treatment
  misc_feature: Up-regulated in shoot tissues in response to salicylic acid treatment
  misc_feature (24)..(485): Pfam ID: Sugar_tr Pfam Description: Sugar (and other) transporter
MASADLAEAIEPTKKSNVKYASICAILASMASVILGYDIGVMSGAAMYIKKDLKITDVQLEIMIGILSVYSLIGSFAGARTSDRIGRRLTVVFAAVIFFVGALLMGFAVNYGMLMVGRFVAGVGVGFGGMIAPVYTAEISPAASRGFLTSFPEVFINIGILLGYLSNFTFARLPLHLGWRVMLGIGAAPSALLALMVFCMPESPRWLVMKGRLADARAVLEKTSASPEEAAERLADIKVAAGIPKDLDGDVVTVPKERNGGEMQVWKALIFSPIPAIRRILLSGVGLHFFQQASGSDSVVLYSPSVFKSAGITDDNKLLGVTCAVGVSKTLFILVATFLLDRVGRRPLLLTSAGGMIVALIGLGTGLTVVGHHPDAKIPSAVALCIASTLAYVAFFSIGLGPITGVYNSEIFPLQVRALGFAVGMACNRVTSAVISMTFLSLSKGITIGGSFFLYSGIAAVGWVFFFTCLPETRGRTLEEMGKLFGMPDIDMAQADDTAAKEKVVEMPTM

SEQ ID NO: 20586 - DNA, 2262 bp, Sorghum bicolor
  misc_feature: Ceres ANNOT ID no. 8656412
  misc_feature: Down-regulated in shoot tissues in response to salicylic acid treatment
  misc_feature: Encodes the peptide sequence at SEQ ID NO 20587
atggacccaagcgattccaactccgccgcaggaggaaagacacaaaatgtttcagtaccgcctgttgaaggtgtagctggaggagggactagctatggatgggtggatggaggcttgcggggtacaaatcttggtgctggtgtgattgatcctacaaaagtacactcagaagatcttttgcatgtttggtctatgcccagcacagcaaatgttagccagcaagaagtgcctcgacctctagagaaagtcaaccttttggcagcaagaaatgaaagggaaagttttcaaattgctttacggccaaaggtttcgtgggcaacttcaggtattgcagggtctgtgcagatacaatgcacagatctctgctcctcctcaggagacaggttagtcgttggtcagtccataactttgcgacgtgtggtgcctatcttaggtgtaccagatgctcttgttcctattgatccactcagtcctcaagtaactcttcaaccaggggagacagctgcagtttgggtatcattaaatgttccatgtgggcaaccacctggtttatatgagggtgaaatattcattactgcagttaagacagaattagattccagaacagaatctctaccaaaatctgaaaagtacaggctatatagagaattaagaagttgtcttgacctcactggacccagagactactcatcaccagaggaaatggtacaaagactaacatcagcttctagtgcactgaggagggtgttggataatccagcactccaggactgtcaagagaataatggatttggagacatgatggatgaagatgttatgaacaatgtttcagttcgcttgaagctaagccttactgtttgggatttcactctcccagtgacaccttctttacctgctgtttttgatcgattctgtttggagcatggcactgaaggatggtatagtgcactggatcatcactttaggtggctcctccaatatagaatcagtccatttttctgcagatggggtgatagcatgcgcattctagcgtacacatgcccttggcctgctgatcatccgaaggctaatgaatattactctgacccaagattagcagcatatgctgtaccctatgcacctatcctatcatgtacagatgctgcaaaaaattccctgagaagagaggttgaaatcttaaaatcaaagcctcattggtccaaagcttacttctatttgtgggatgagccattaaatgtggaacagtatgacatgatatgcaacatctcaaatgagctgcggtcatatgcacctgatgtgcgaattttgacaacttactattgtggcccaagtggctctgaactggctccctctacatttgaagcttttgtgaaagttccaaatgttctgcgtccgcacacacaaatcttttgcacaagtgaatgggttcttggcacaagagaagacctagtgaaggatattattgctgaattacggcctgatcttggtgaggagtggtggacatatgtttgtatgggcccttctgatcctcaaccaaactggcacattggaatgcgtggaacccagcaccgggctgtgatgtggagagtgtggaaggaaggtgggacaggattcctttattggggtaccaactgctatgagaaggctatgatcccaagtgctgagatctgtttccgacgtggccttcctcctggcgacggtgtcctgttttaccctggtgaagtgttttcttcgtcacatgaaccagttgcttccacccggctagagcgcattctcagtggcatgcaggacatcgaatacctgaagctttattcttcacggtatggaagggaggaaggcctggcccttatggagaagactggcatgtatcttggcccggatcgatatacgctggatcatggaccggtagatgtgatgcggggtgagcgcaggtttacaccctccgaaggcgcattcaatcgcgttcctgccgtgacgacgattctcgtctcgcgacggaagctgacgctgccgccgcggtgccccgtctctttcgaggtagtaataagcttccaaaaacagggtggttcctggctttcggcacgggcgcgccgtcgctgtcgcccatccacccacgatgatttccccccaaacatgtccgtccgattaatatctatctatatatctatatataccccatgtgaaccgagggagagaacacacacaaacgcttgcatcgaggtcgttgtcacgggttccacagaagccatccctggagagtga

SEQ ID NO: 20587 - protein, 753 aa, Sorghum bicolor
  misc_feature: Ceres ANNOT ID no. 8656412
  misc_feature: Down-regulated in shoot tissues in response to salicylic acid treatment
MDPSDSNSAAGGKTQNVSVPPVEGVAGGGTSYGWVDGGLRGTNLGAGVIDPTKVHSEDLLHVWSMPSTANVSQQEVPRPLEKVNLLAARNERESFQIALRPKVSWATSGIAGSVQIQCTDLCSSSGDRLVVGQSITLRRVVPILGVPDALVPIDPLSPQVTLQPGETAAVWVSLNVPCGQPPGLYEGEIFITAVKTELDSRTESLPKSEKYRLYRELRSCLDLTGPRDYSSPEEMVQRLTSASSALRRVLDNPALQDCQENNGFGDMMDEDVMNNVSVRLKLSLTVWDFTLPVTPSLPAVFDRFCLEHGTEGWYSALDHHFRWLLQYRISPFFCRWGDSMRILAYTCPWPADHPKANEYYSDPRLAAYAVPYAPILSCTDAAKNSLRREVEILKSKPHWSKAYFYLWDEPLNVEQYDMICNISNELRSYAPDVRILTTYYCGPSGSELAPSTFEAFVKVPNVLRPHTQIFCTSEWVLGTREDLVKDIIAELRPDLGEEWWTYVCMGPSDPQPNWHIGMRGTQHRAVMWRVWKEGGTGFLYWGTNCYEKAMIPSAEICFRRGLPPGDGVLFYPGEVFSSSHEPVASTRLERILSGMQDIEYLKLYSSRYGREEGLALMEKTGMYLGPDRYTLDHGPVDVMRGERRFTPSEGAFNRVPAVTTILVSRRKLTLPPRCPVSFEVVISFQKQGGSWLSARARRRCRPSTHDDFPPNMSVRLISIYISIYTPCEPRERTHTNACIEVVVTGSTEAIPGE

SEQ ID NO: 20588 - DNA, 1533 bp, Sorghum bicolor
  misc_feature: Ceres ANNOT ID no. 8656421
  misc_feature: Up-regulated in shoot tissues in response to methyl jasmonate treatment
  misc_feature: Up-regulated in root tissues in response to methyl jasmonate treatment
  misc_feature: Encodes the peptide sequence at SEQ ID NO 20589
atggcttccgctgcgctgccagaggccgtcgagcccgggaagaagggcaacgtccgcttcgccttcgcctgcgccatcctcgcctccatgacctccatccttcttggctatgatatcggagtgatgagcggtgcgtcgctatacatcaagaaggacctgggaatcaccgacgtgcagctggagatcctgatgggcatcctcaacgtctactccctcatcggctccttcgccgcgggacggacgtccgactggatcggccgccgctacaccatcgtcttcgctgcggtcatcttcttcgcgggcgccttcctcatgggcttcgccgtcaactacgggatgctcatgttcggccgcttcgtcgccggcgtcggcgtgggctacgcgctcatgatcgcgcccgtgtacaccgctgaggtgtcccccgcgtcggcccgcggcttcctgacgtccttcccggaggtgttcatcaacttcggcatccttctgggctacgtctccaactacgccttctctcacctctcgctccgcctcggctggcgcgtcatgctcggcatcggcgcggcgccgtccgtcgtgctcgccctcatggtgctgggcatgcccgagtcgccccggtggctcgtcatgaagggccgcctggcggatgccaaggtggtgctggggaagacctccgacacgccagaggaggccgcggagaggctcgctgatatcaaggcggccgccggcatcccacaggagctcgacggcgacgtggtcgccgtgcccaagaaacagaacagcggcgaggcgcgggtgtggaaggagctcatcctgtccccgaccccggccatgcgccgcatcctcctctcgggcctcggcatccacttcttccagcaggcgtccggcatcgacgccgtggtgctctacagcccgcgcgtgttcaaggccgccggcatcaccagcgacaaccagctcctgggcaccacctgcgcggtgggcgtcaccaagacgctcttcatcctggtggccacgttcctgctcgacagagtcggccggcggccgctgctcctgagcagcgtgggcggcatgatcatctcgctggtcggcctcgccgccgggctcaccgtcattgagcaccacccggacggcaagatcccctgggccatcggtgtggccatcgcgtccaccatggcctacgtggccttcttctccatcggcatgggccccatcacgtgggtgtacagctccgaggtgttcccgctgcacgtgcgcgcgctcggctgcgcactgggcgtggcctccaaccgcgtgaccagcggcgtgatctccatgaccttcatctcgctgaccaaggccatcaccatcggcggcgccttcttcctctacgccggcgtcgcggtgctcgcgtgggtgttcttcttcaccttcctcccggagacccgcggccggacgctggaggcgatgcacaagctgttcggcgccaccgacgacgacctgaaaccccaggacggagccacgaaagacaagaagctcgaaatggccgccaccaactaa

SEQ ID NO: 20589 - protein, 510 aa, Sorghum bicolor
  misc_feature: Ceres ANNOT ID no. 8656421
  misc_feature: Up-regulated in shoot tissues in response to methyl jasmonate treatment
  misc_feature: Up-regulated in root tissues in response to methyl jasmonate treatment
  misc_feature (24)..(485): Pfam ID: Sugar_tr Pfam Description: Sugar (and other) transporter
MASAALPEAVEPGKKGNVRFAFACAILASMTSILLGYDIGVMSGASLYIKKDLGITDVQLEILMGILNVYSLIGSFAAGRTSDWIGRRYTIVFAAVIFFAGAFLMGFAVNYGMLMFGRFVAGVGVGYALMIAPVYTAEVSPASARGFLTSFPEVFINFGILLGYVSNYAFSHLSLRLGWRVMLGIGAAPSVVLALMVLGMPESPRWLVMKGRLADAKVVLGKTSDTPEEAAERLADIKAAAGIPQELDGDVVAVPKKQNSGEARVWKELILSPTPAMRRILLSGLGIHFFQQASGIDAVVLYSPRVFKAAGITSDNQLLGTTCAVGVTKTLFILVATFLLDRVGRRPLLLSSVGGMIISLVGLAAGLTVIEHHPDGKIPWAIGVAIASTMAYVAFFSIGMGPITWVYSSEVFPLHVRALGCALGVASNRVTSGVISMTFISLTKAITIGGAFFLYAGVAVLAWVFFFTFLPETRGRTLEAMHKLFGATDDDLKPQDGATKDKKLEMAATN

SEQ ID NO: 20590 - DNA, 1533 bp, Sorghum bicolor; identical to SEQ ID NO: 20588
  misc_feature: Ceres ANNOT ID no. 8656423
  misc_feature: Up-regulated in shoot tissues in response to methyl jasmonate treatment
  misc_feature: Up-regulated in root tissues in response to methyl jasmonate treatment
  misc_feature: Encodes the peptide sequence at SEQ ID NO 20591

SEQ ID NO: 20591 - protein, 510 aa, Sorghum bicolor; identical to SEQ ID NO: 20589
  misc_feature: Ceres ANNOT ID no. 8656423
  misc_feature: Up-regulated in shoot tissues in response to methyl jasmonate treatment
  misc_feature: Up-regulated in root tissues in response to methyl jasmonate treatment
  misc_feature (24)..(485): Pfam ID: Sugar_tr Pfam Description: Sugar (and other) transporter

SEQ ID NO: 20592 - DNA, 573 bp, Sorghum bicolor
  misc_feature: Ceres ANNOT ID no. 8656524
  misc_feature: Up-regulated in shoot tissues in response to methyl jasmonate treatment
  misc_feature: Up-regulated in root tissues in response to methyl jasmonate treatment
  misc_feature: Encodes the peptide sequence at SEQ ID NO 20593
atggagggaagaaccagatgggaactcaccaggcgctggggccgcggcgcttcgcgcggatggacagcgagaggggatgcggcgcccgacgctgccacgaggaagcggagcctcgaggccggggagctgctcgtggcgcgcaagcacggcgccgcgtcggtggccggccgcaggagggagatggaggacatcgtgtccgtgcgcgaggcgttcgcgctcgcggagggctcccacggcgggaggcgcgacttctacggggtgttcgacggccacggctgctcgcacgtcgccgaggcgtgccgggaccgcatgcacgagctgctcgccgaggagctcgctgtcgccgccgacgacgtctcctggaccgcggcgatggagcacagcttcgcgcggatggacagcgagaggggatgcggcgtggaccggatgcacgagctgctcgccgaggagctcgctgtcgccgccgacgacgtctcctggaccgcggcgatggagcgcagctttgcgcggatggacagcgagaggggatgcggcgtgggagaggggatgcggcgtgggaggaacggtttctga

SEQ ID NO: 20593 - protein, 190 aa, Sorghum bicolor
  misc_feature: Ceres ANNOT ID no. 8656524
  misc_feature: Up-regulated in shoot tissues in response to methyl jasmonate treatment
  misc_feature: Up-regulated in root tissues in response to methyl jasmonate treatment
  misc_feature (28)..(140): SWISSPROT Homolog: EC 3.1.3.16 Phosphoprotein phosphatase
MEGRTRWELTRRWGRGASRGWTARGDAAPDAATRKRSLEAGELLVARKHGAASVAGRRREMEDIVSVREAFALAEGSHGGRRDFYGVFDGHGCSHVAEACRDRMHELLAEELAVAADDVSWTAAMEHSFARMDSERGCGVDRMHELLAEELAVAADDVSWTAAMERSFARMDSERGCGVGEGMRRGRNGF

SEQ ID NO: 20594 - DNA, 3174 bp, Sorghum bicolor
  misc_feature: Ceres ANNOT ID no. 8656606
  misc_feature: Up-regulated in shoot tissues in response to aminocyclopropane carboxylic treatment
  misc_feature: Up-regulated in shoot tissues in response to salicylic acid treatment
  misc_feature: Encodes the peptide sequence at SEQ ID NO 20595
atggcgtatccggattcgggcatgcatgcagtcacttcgtccccgcccgatcccggctgtgacccgattttaccttattactacttgccaggcccacaacgctgcaaactgaatctgtacactactatactctaccccccgtcagatcgatcagcgtcacatgtacaagcaggatcacactggctgggtctgcaggtacgaactgcttctccttcagcctttgctctgaccggtgactgccgcctccgaagcttctcctccttcggaacgactccggtcggtggcgccgccggcctggccacaccggtcgtcgcacctgaatgcgacccggcgatcgtcctgcaggccgcacgtcgttccgcgccgcctgatcgggctgacaacgacgagagcttgtcaaagatgcccgccaggatgcgcggcgccgccgccggcggcttggcggacgacacgcgggacctccagcgccaaatggggtgcatggccggcatcttccagatcttcgaccgccagcggctcatcactggggccggtcgccgcgccgcccggcaggcgcaaaagaggctgcctccgccttccactccaccaggcaatactcatccaaagagcagcagcaatgttccagttcaaagttcaagtacctcaaagatcgttctggagaaaacattcagcaaatgtatgaccgagaacagcagcctttcaattgaatcatcaagagcttcttcttcctcctcttcgtgctcatccttctcctcccttgatggcaacaaatcagtccaacaggagcctccttacatcaatgaggagctgtttgtgcagaggtcactgaagagctcgccaagtttgaaggaatctgacatgaacactaagtctgggcatcctaatgtcggtttcagagacatagtgaaggactccatcaaccgggaccctggaggcctgactgtaaaaacctcggtgcaggaggcaaggagaaacggacagtacaaggactcaccgaggccactgctgctgtccaaatcaatggatggaacctgtatcattgggatcgataggaccacaaaggttcctgcaaatgtcactgaatctagaaggtgtttgcaggagcagtcacgcttctcatgtgatgaccgaagactcctgcggccagctgaaacccaggaaagcaagaggcctccctcgaggccaaaagagcttcctagattgtccttggacagtaggaaggagtctctgagtccaggctcacgtcagaagaacctcagttacaggagaactgatgatattcttctggatactttgaggcctcaagattcgcccagccatagaagagctaacagtgttattgcaaagctgatggggttggaagaagcaacaaatgctacagggaagcacttgccaggattcctgcagcatgcagctgaagaacgactcctcagtactgaaaaccaagcctccccacgaattgtcacagaagcagctccttggaggcagcaggacagaagtgccaccaatatcaaggcacaacaatgtcgagaagctgaagggaggccaagaactgcatctgtctatgctgatatagagagaagggtcgggggctttgacttcttagagtgtaataacaaggacttcagggctctcagaatattgggtgcattgaacgcaaaagatgctaagagcaagaatgacagcagtggtggatcaattgctaatcacaggacaggatatgatctcaccactaactctggaaccttccaggcacctattgtggtcatgaagcctgcaagaaccattgagaagcatggggtttcactggcttctgttgctcccatggcaggccttagaagcctcagaaagttgccggctagatattcatctttcaccagcacaaatgagagtagcacaaatgagaagatgcatcttcggatgtcaagagctcaactgaagtctgaagaaattgtcagcaatgctagctcgccaaggcctacaagctcatcaagccccagaaatgtgctaaagaaggcagagccagaaaggaggtctcgtccacctgtttcgccaaaatctccaagcaagaagtccaatgaagctgtctctccaaaaggaagaataagatcaaagccttctcaggtgaaatgccaccgtgaagaggtcttgcagagtacagggaacagaataagcttagcaaagcaggttgatgtcagtgttatggatcgtgcaaagcctctgggtggcaactcaaccttcactccaccaagcaatgctgctgcaacagcaagtcacaaggctccttcaattctgggttcagaccaaaacattcattcactggacaacattccaagccctgtctctgtccttgatacatccttctatcataaaaggatctcagattcattcagagaggaatgctggaacccaaacagcttgcctgacacaccacagtcaaaagcgagcagtgaagtcaaccagattaaaccagaaaatttggaagttctgatccagaagcttgagcaactgcaatcaatgaatgaagaagacgcaagtatcaaagaagtcatggcatcagtcactgcaaataaagatcaccagtatatctatgagatactgttggcatctggtcttttgcacaaagaacatagtatcgcagtattacctggtcaactccaaccatcaaattatccaatcaatccggagctcttcctcattcttgagcaaacaaaaccagacttagtttctgccttccaaactgtcagcggagctaagaaaagttgtaagccttgcacagggaggcttcatcgaagacttgtgtttgacctggtaaatgaaacaatagctcagaagatgagcgtctgtagatctggaaggcagacagtaaagtttcttcaatcaaggaagttaagtgggtggcaactattcaaggatttgtgcactgaggttgacaggctaataaaatgctccgacgaggaggagaatgaaaacatgatatttgatgaggatacagttaatggaacgaaagactggatgagcttcgacactgtgctacatggcatggtttgggaaattgaacgatccatcttcaagggccttatcgacgaggtcatcggtggtgagactacagagaagatgcaatttgtacaaaggaaactgcagaggcagctttctttcagtagtataaactga

SEQ ID NO: 20595 - protein, 1057 aa, Sorghum bicolor
  misc_feature: Ceres ANNOT ID no. 8656606
  misc_feature: Up-regulated in shoot tissues in response to aminocyclopropane carboxylic treatment
  misc_feature: Up-regulated in shoot tissues in response to salicylic acid treatment
MAYPDSGMHAVTSSPPDPGCDPILPYYYLPGPQRCKLNLYTTILYPPSDRSASHVQAGSHWLGLQVRTASPSAFALTGDCRLRSFSSFGTTPVGGAAGLATPVVAPECDPAIVLQAARRSAPPDRADNDESLSKMPARMRGAAAGGLADDTRDLQRQMGCMAGIFQIFDRQRLITGAGRRAARQAQKRLPPPSTPPGNTHPKSSSNVPVQSSSTSKIVLEKTFSKCMTENSSLSIESSRASSSSSSCSSFSSLDGNKSVQQEPPYINEELFVQRSLKSSPSLKESDMNTKSGHPNVGFRDIVKDSINRDPGGLTVKTSVQEARRNGQYKDSPRPLLLSKSMDGTCIIGIDRTTKVPANVTESRRCLQEQSRFSCDDRRLLRPAETQESKRPPSRPKELPRLSLDSRKESLSPGSRQKNLSYRRTDDILLDTLRPQDSPSHRRANSVIAKLMGLEEATNATGKHLPGFLQHAAEERLLSTENQASPRIVTEAAPWRQQDRSATNIKAQQCREAEGRPRTASVYADIERRVGGFDFLECNNKDFRALRILGALNAKDAKSKNDSSGGSIANHRTGYDLTTNSGTFQAPIVVMKPARTIEKHGVSLASVAPMAGLRSLRKLPARYSSFTSTNESSTNEKMHLRMSRAQLKSEEIVSNASSPRPTSSSSPRNVLKKAEPERRSRPPVSPKSPSKKSNEAVSPKGRIRSKPSQVKCHREEVLQSTGNRISLAKQVDVSVMDRAKPLGGNSTFTPPSNAAATASHKAPSILGSDQNIHSLDNIPSPVSVLDTSFYHKRISDSFREECWNPNSLPDTPQSKASSEVNQIKPENLEVLIQKLEQLQSMNEEDASIKEVMASVTANKDHQYIYEILLASGLLHKEHSIAVLPGQLQPSNYPINPELFLILEQTKPDLVSAFQTVSGAKKSCKPCTGRLHRRLVFDLVNETIAQKMSVCRSGRQTVKFLQSRKLSGWQLFKDLCTEVDRLIKCSDEEENENMIFDEDTVNGTKDWMSFDTVLHGMVWEIERSIFKGLIDEVIGGETTEKMQFVQRKLQRQLSFSSIN

SEQ ID NO: 20596 - DNA, 1257 bp, Sorghum bicolor
  misc_feature: Ceres ANNOT ID no. 8656586
  misc_feature: Down-regulated in shoot tissues in response to salicylic acid treatment
  misc_feature: Encodes the peptide sequence at SEQ ID NO 20597
atggacggcgacccctcgcgccaggtgcgcgtgcgcttcgtcacgaagctgccgcctccgctgcgggcgccgcccgctgccatcgccgtccctgcggacctcacccgcatgggcctctccgagatcgtcaacagcctcctcgccgccgccgagccggaccaccagacacagcccttcgacttcattgtggacggcgagctcgtgcggctgccactccaggagttcctcctcgccaagggcatctcggcggagagggtgcttgagctcgagtatgtgaaagcagtggcgccaaggaagcaggaggaaccttgcccccatgatgactgggttagtgctgtggatggatcgaactcaggttttatattatctggatgctatgatggctttgcaagattatggaaagatgcagcagtgtgtacacaaattttggagggacacgctgatgcaattacttctgccagattcataaataaaagatctgaaactgagggcagtctgcatgtagtgactggctcaaaggataggtcgctacggctatacaagtgtgacacatcagtcagtatggactacccaaagcgggttggggcttacaaaattcttcgtggccacacggcatctgttaaaagtatctccgtagacccttctggcgatatgctatgttctggatcctgggataacaccatcaagttgtgggcagttgaacgatctgaagatgatgatgctgtttcattgaagaagagaaggatgaattctgactcatctggacctgaagagtctcagttagagggttcagccacttcaacacttctgggacatacacaaggtgtaacttctgttgcctggcctgaacagaaaacgatatattcagcatcttgggatcattctgtaaggcagtgggatatccaaacagtgaaagaaacatggaatatgttttgtgggaaggccttgaattgcttggactgtggaggtgagggttcttcattgattgctgctggtggctctgatcctgtgttgaggttctcctcccattctggctggatcactgcttgtaaatggcatccaagttcatgtttccatttggtatcatcttcatttgatgggaaagtgatgttgtgggatctaagaacatggccgctggcgtctgtggattcacacgaagataaggttttatgtgccgactggtggaaagggaacagcgtgataagcggcggagctgattccaagctatgtatctcatctggtattcatattgtgtga

SEQ ID NO: 20597 - protein, 418 aa, Sorghum bicolor
  misc_feature: Ceres ANNOT ID no. 8656586
  misc_feature: Down-regulated in shoot tissues in response to salicylic acid treatment
  misc_feature (106)..(299): SWISSPROT Homolog: EC 2.7.11.7 [Myosin heavy-chain] kinase
  misc_feature (334)..(373): Pfam ID: WD40 Pfam Description: WD domain, G-beta repeat
  misc_feature (194)..(232): Pfam ID: WD40 Pfam Description: WD domain, G-beta repeat
  misc_feature (263)..(300): Pfam ID: WD40 Pfam Description: WD domain, G-beta repeat
  misc_feature (137)..(181): Pfam ID: WD40 Pfam Description: WD domain, G-beta repeat
  misc_feature (8)..(76): Pfam ID: NLE Pfam Description: NLE (NUC135) domain
MDGDPSRQVRVRFVTKLPPPLRAPPAAIAVPADLTRMGLSEIVNSLLAAAEPDHQTQPFDFIVDGELVRLPLQEFLLAKGISAERVLELEYVKAVAPRKQEEPCPHDDWVSAVDGSNSGFILSGCYDGFARLWKDAAVCTQILEGHADAITSARFINKRSETEGSLHVVTGSKDRSLRLYKCDTSVSMDYPKRVGAYKILRGHTASVKSISVDPSGDMLCSGSWDNTIKLWAVERSEDDDAVSLKKRRMNSDSSGPEESQLEGSATSTLLGHTQGVTSVAWPEQKTIYSASWDHSVRQWDIQTVKETWNMFCGKALNCLDCGGEGSSLIAAGGSDPVLRFSSHSGWITACKWHPSSCFHLVSSSFDGKVMLWDLRTWPLASVDSHEDKVLCADWWKGNSVISGGADSKLCISSGIHIV

SEQ ID NO: 20598 - DNA, 2514 bp, Sorghum bicolor
  misc_feature: Ceres ANNOT ID no. 8656653
  misc_feature: Up-regulated in shoot tissues in response to methyl jasmonate treatment
  misc_feature: Up-regulated in root tissues in response to methyl jasmonate treatment
  misc_feature: Up-regulated in shoot tissues in response to salicylic acid treatment
  misc_feature: Up-regulated in root tissues in response to salicylic acid treatment
  misc_feature: Encodes the peptide sequence at SEQ ID NO 20599
atggcgagggaggacggcccgcagttcgtgcggtggagggaggagttcgtgtcgcaggagcgcggcagccgcgtcgtgcactactacctcgaagacgcggccggcgtgtcgcatctcgccgtcgtcggcaccgagaggagcctgcgccacatgctctacgtggtatcggaggacttcagcgccgcgtgggggtgcggtggcggcgctgacgacggcggcgcgccgcccgtttttgcgcgcaagtggcggtcacgccgtgaggtggtcgattggctcgcgtccttccttccggtgaaggcacttgactcaagtaaaaaattctcaaaatacagatcttttgcggataatgacattgggtcagatgggtatggggaaactgatagctttttgcaccaaaatctggggaaagactgcagctcagacattacatggtctggttctttctggacatgtggcaaggagcgtcggcactatcaagctttttgtcgcaatgggaccacaatctccacccacacttttgtgctgatcttgtcagaggaagaaaatcgctatcttgcatacttggaagacatgtatgaagataagaagggactgaagaagatcaaagtgcgatggtttcatcaaaaccaggaattcgcttgtgctatacctcctcctccccctcatccttgtgaagttttcatcactccttttacacaagtaataagtgtggaatgtgttgatgatattgcaactgttttaactcctgaccattatgaaaaatgctccaatgcaatgcctacttcttctttggccgggatccgtttctgctttcgccagtataataaaaataagttcaagcattttgatttaagatcactgcgcgggtattttagtcaagctgttgttctgtccttaaaaattccagctgagtcagaaaaggatggtgaatattgtacacctgggaaaactaagtttccgaagcagttagagaggctttattcaaaatgtttgggcactaaaatttgtcgaagcccacagacagactccataccatcttatcagatattaagtaatgagcaacctcctgggaagcatctctcgatcaagtttacagtgcctcagaagcaactaatgccaaaatataatactggtgacagattagagatcttgtctcaagacagtggcattattggttgctggttcaggtgcactgttctgaagtcatgcactaatcataacaaattgaaggttcagtatgatgatctccaaaatgctgatgatagtgggagattggaggagatggtacctgcctctgcattggctcttcctgataaactgggactgagatgccaagaccgactaagaatcaggccgcgtcctcaagaaaatagttctgttgatggtgcttctctcttacctggaactgctgttgatgtctggcaatttagtggctggtgggaaggagttgttgtcagtttggacaacattgtggcagatagccttcaagtatattttccaggagagaactttttccgtgcatgccaactaaggaatgttagaatctctaaagattgggtcaagaacggatgggttcatattgaaacaaagtcagatgtgttgtcacggataccttcagatagtgtccgaacaaagcaagctgataatgcaccatctgttggtctgatagactccagcagttctgcaatgcctgagcaagagcttgcagctacccaagcaaactcccatggagataaaccactacctaagcaagagcttgcagccacccaagcaaactccaacgcagagaaaccattgcctgagcaagagcttgcagctacccaatcaaactccaatggagataaacctgtgcctaagcaagagcttgcagctacccaagcaaacttcaatggagataaacctgtgcctgagcaagagtttgcagctacccaagcaaactccaatggagataaacccgtgtctgagcaagagcttgcagctacccaagcaaactccaatggagataaacctgcgtctgagcaagagcttgcagctactgaagcaaactccaatggagataaaccagtgcctgagcaagagcttgcagctaccgaagcaaactccactggagataaaccagtgcctaagcaagagcttgcagctacccaatcaaattccaatggagataaacctgtgcctgagcaagagcttgcagctactcaagccaacttcaatggagataataaacaaacagaagcaaataaccaatccgaggttagtatgactgatgaggacttcaatggagataataaacaaacagaagcaagtaagcaatccgaggttagtatgactgatgagaaccctctagtggaggatgacaagcgaacaattctagggaagcatcccagggattttagtatggctgatgaagcctcagcttttgtggaggatgacaagcgaaagcgtcccagggatgacaatgatgctgaacagaaatgcaacggggaagtaggtgtagatgttagcaagacatga

SEQ ID NO: 20599 - protein, 837 aa, Sorghum bicolor
  misc_feature: Ceres ANNOT ID no. 8656653
  misc_feature: Up-regulated in shoot tissues in response to methyl jasmonate treatment
  misc_feature: Up-regulated in root tissues in response to methyl jasmonate treatment
  misc_feature: Up-regulated in shoot tissues in response to salicylic acid treatment
  misc_feature: Up-regulated in root tissues in response to salicylic acid treatment
  misc_feature (518)..(809): SWISSPROT Homolog: EC 3.2.1.11 Dextranase
  misc_feature (375)..(458): Pfam ID: Agenet Pfam Description: Agenet domain
  misc_feature (166)..(283): Pfam ID: BAH Pfam Description: BAH domain
MAREDGPQFVRWREEFVSQERGSRVVHYYLEDAAGVSHLAVVGTERSLRHMLYVVSEDFSAAWGCGGGADDGGAPPVFARKWRSRREVVDWLASFLPVKALDSSKKFSKYRSFADNDIGSDGYGETDSFLHQNLGKDCSSDITWSGSFWTCGKERRHYQAFCRNGTTISTHTFVLILSEEENRYLAYLEDMYEDKKGLKKIKVRWFHQNQEFACAIPPPPPHPCEVFITPFTQVISVECVDDIATVLTPDHYEKCSNAMPTSSLAGIRFCFRQYNKNKFKHFDLRSLRGYFSQAVVLSLKIPAESEKDGEYCTPGKTKFPKQLERLYSKCLGTKICRSPQTDSIPSYQILSNEQPPGKHLSIKFTVPQKQLMPKYNTGDRLEILSQDSGIIGCWFRCTVLKSCTNHNKLKVQYDDLQNADDSGRLEEMVPASALALPDKLGLRCQDRLRIRPRPQENSSVDGASLLPGTAVDVWQFSGWWEGVVVSLDNIVADSLQVYFPGENFFRACQLRNVRISKDWVKNGWVHIETKSDVLSRIPSDSVRTKQADNAPSVGLIDSSSSAMPEQELAATQANSHGDKPLPKQELAATQANSNAEKPLPEQELAATQSNSNGDKPVPKQELAATQANFNGDKPVPEQEFAATQANSNGDKPVSEQELAATQANSNGDKPASEQELAATEANSNGDKPVPEQELAATEANSTGDKPVPKQELAATQSNSNGDKPVPEQELAATQANFNGDNKQTEANNQSEVSMTDEDFNGDNKQTEASKQSEVSMTDENPLVEDDKRTILGKHPRDFSMADEASAFVEDDKRKRPRDDNDAEQKCNGEVGVDVSKT

SEQ ID NO: 20600 - DNA, 2283 bp, Sorghum bicolor
  misc_feature: Ceres ANNOT ID no. 8656667
  misc_feature: Down-regulated in shoot tissues in response to salicylic acid treatment
  misc_feature: Encodes the peptide sequence at SEQ ID NO 20601
atgtcttgcagtttacgttctggagcagaacatttgtctcaagttttgcatggagctgtgccagatggcttttgggattctgatgcgcacatagcatctagtgaagttgcagttcatattctcgaccatctcttcaagaaattaaatgaaggtgagccatttcatatgctgctagtgatatttactggaagcttgttaccttatcttcaatgtctagattcctggatatatgatggtatccttgatgacccttatgaagagatgttcttttatgcaaataatgcggttacaatagatcagccggcattctgggaaatgagctatatgctcagagtaagaggttccagagttgacagttcaaccactttaactgatagtgaatctatcaagaaaaaggaatcaagcaaccatgaatctattactgcaggagcttgcttgaaagtgaacaatcaaggttgtgtggatatattatgcccagtattcttgaaggatattgcaagggccattgtatctgctggaaaatcctttcaacttgtccaacacgttcaagacgtacaccagattcaaactcacaaaggtacacatgggtccaatttctatcaggatactaattgcagtggtcaacagaaattctggccagatatgtcaaggaaaatcactgagaagacttgggtaaagctcctaaaggatgctacatcaggaaggaaatgtgatggtatggagaagaccataaatgttgttatggagaagacagtctttgcccctggttgcccaaaagatgcatcttccaatgccgtagaagggtttttcactttatcttgttatgaaaatccagctgtcactgcttgcagagaagtgctactgaggaacccaacttcttggagtgaactgaatatctctgaaagttttcatctccctccacttgatgatgggaacatgcgaagagctatatttgctgatggacattctgcaggaactagcactgattataagtttggtttccagttcaatgatttggaatatgtccgccaagaagatgaaagaaggaccttggaggacctttatgcatttccaactcttcttccttgtgcaaaagaaaatgcgctgctgtcagaaattttacctatgcagaaagatagtgcactagcatcaagagttttgaagtttattcagaatatgagcgtgaaagatcctcttcagccagtgggtatcatccaagaatgcctttccaaatgcataaagagacaggtcgatcacataggcaatcaaatcctgtccaagctaatgggcgaatggagattaatggatgaactgcttgttttacgtgctatttatttgctaggatcaggtgacatgctgcagcagtttctgataacaatttttgataagcttgatagagggaattcctgggatgatgactttgagttgaataatttgttgcaggaatccataagaaactcagctgacaaaatgctcctgacagcaccagattctttggttgtttcgttagcaaaacatgacacacacaatggtgaggaaggtccatcaacttctaaaaaaggtcgtgcacttggttttggcattgatgcgcttgacatgcttaattttacatataaggtgtcttggcctcttgatctaattgttaatacagaggcactgaagaagtataatcaggtaatgggattcttactgaaggtcaaacgagcaaagttcgttttggatgaaacccgaaagtggatgtggaaggccagaggcaggactgcacataatttcaaacaacacctaatagtggcgcagaagctcctccattttgtcgatgcatttcatcagtatgtcatggaccgagtttatcatagtgcatggactgagctttgtgatggcatggcgtctgctactacactggatgaagtcatggaagttcatgaggcatatctctcttctatccaacgacaatgctttgtggcctctgataagttgtgggctctcattgccagtcgagttaagactattcttggattggcattggactttcacaatgttgaacaaactctcagtactggtgggatagcttcagctgtgagggcacgatgcgagatggaaatcgacaggattgagaagcaatttgatgagtgtgtcgtatttctcctgaggatcctatctttcaagctcaatgtgggccattttccccatcttgccgatctagtcacaagaatcaactacaatcactatttcatgtccgataatgggagcttctctgctattcctagttcccggccacggtag

SEQ ID NO: 20601 - protein, 760 aa, Sorghum bicolor
  misc_feature: Ceres ANNOT ID no. 8656667
  misc_feature: Down-regulated in shoot tissues in response to salicylic acid treatment
  misc_feature (1)..(625): Pfam ID: Spc97_Spc98 Pfam Description: Spc97 / Spc98 family
MSCSLRSGAEHLSQVLHGAVPDGFWDSDAHIASSEVAVHILDHLFKKLNEGEPFHMLLVIFTGSLLPYLQCLDSWIYDGILDDPYEEMFFYANNAVTIDQPAFWEMSYMLRVRGSRVDSSTTLTDSESIKKKESSNHESITAGACLKVNNQGCVDILCPVFLKDIARAIVSAGKSFQLVQHVQDVHQIQTHKGTHGSNFYQDTNCSGQQKFWPDMSRKITEKTWVKLLKDATSGRKCDGMEKTINVVMEKTVFAPGCPKDASSNAVEGFFTLSCYENPAVTACREVLLRNPTSWSELNISESFHLPPLDDGNMRRAIFADGHSAGTSTDYKFGFQFNDLEYVRQEDERRTLEDLYAFPTLLPCAKENALLSEILPMQKDSALASRVLKFIQNMSVKDPLQPVGIIQECLSKCIKRQVDHIGNQILSKLMGEWRLMDELLVLRAIYLLGSGDMLQQFLITIFDKLDRGNSWDDDFELNNLLQESIRNSADKMLLTAPDSLVVSLAKHDTHNGEEGPSTSKKGRALGFGIDALDMLNFTYKVSWPLDLIVNTEALKKYNQVMGFLLKVKRAKFVLDETRKWMWKARGRTAHNFKQHLIVAQKLLHFVDAFHQYVMDRVYHSAWTELCDGMASATTLDEVMEVHEAYLSSIQRQCFVASDKLWALIASRVKTILGLALDFHNVEQTLSTGGIASAVRARCEMEIDRIEKQFDECVVFLLRILSFKLNVGHFPHLADLVTRINYNHYFMSDNGSFSAIPSSRPR

SEQ ID NO: 20602 - DNA, 921 bp, Sorghum bicolor
  misc_feature: Ceres ANNOT ID no. 8656711
  misc_feature: Down-regulated in shoot tissues in response to salicylic acid treatment
  misc_feature: Encodes the peptide sequence at SEQ ID NO 20603
atggcggcggcaccggcaggcggcgccgcgcgggcgctgtcgcagcgtgagcaggacatccagatgatgctcgccgccgacgtccaccttggcaccaagaactgcgacttccagatggagcgctacgtttacaagcgccgctctgatggtatctacattattaaccttgggaagacctgggagaagctacagttggctgcgagggtcattgttgcaattgaaaatcctcaagatattatagtacagtctgctaggccctatggccagagggctgtactcaagtttgcccagtacactggggctcatgccatcgccggcaggcacactcctggtacattcaccaaccagctgcaaacctcattcagcgagccgcgccttcttatcctgactgaccctaggaccgatcatcagcccattaaggagtctgcacttggaaacattcccaccattgccttctgtgacactgactcccctatgcgctatgttgatattggcattcctgccaataacaaggggaaacagagcattggttgtctgttttggctgcttgctagaatggtcctccagatgcgtggtacaattcttccaggacacaagtgggacatcatggttgatctgttcttctacagagacccggaggaagcaaaggagcaggaggaagaagaggctctggttgctcctgactatggcgcagttgcagaatatactgctccagtgggtgagaactggggtggtgccgactggggaactggtgaagccgcagcgcctcctgctggcattccagctgctggtgcagactgggcttctgctccagctcctcctgctgatggtgtctgggatgccgctgccgctcctccagcagccaccggatgggaagaaagcgctgctcccgtggcagctcctacccctaactgggcttaa

SEQ ID NO: 20603 - protein, 306 aa, Sorghum bicolor
  misc_feature: Ceres ANNOT ID no. 8656711
  misc_feature: Down-regulated in shoot tissues in response to salicylic acid treatment
  misc_feature (23)..(191): Pfam ID: Ribosomal_S2 Pfam Description: Ribosomal protein S2
MAAAPAGGAARALSQREQDIQMMLAADVHLGTKNCDFQMERYVYKRRSDGIYIINLGKTWEKLQLAARVIVAIENPQDIIVQSARPYGQRAVLKFAQYTGAHAIAGRHTPGTFTNQLQTSFSEPRLLILTDPRTDHQPIKESALGNIPTIAFCDTDSPMRYVDIGIPANNKGKQSIGCLFWLLARMVLQMRGTILPGHKWDIMVDLFFYRDPEEAKEQEEEEALVAPDYGAVAEYTAPVGENWGGADWGTGEAAAPPAGIPAAGADWASAPAPPADGVWDAAAAPPAATGWEESAAPVAAPTPNWA

SEQ ID NO: 20604 - DNA, 576 bp, Sorghum bicolor
  misc_feature: Ceres ANNOT ID no. 8656771
  misc_feature: Up-regulated in root tissues in response to salicylic acid treatment
  misc_feature: Encodes the peptide sequence at SEQ ID NO 20605
atggcatacctcgttaggagagaaaggtccatgaagatgaggctctggatgctctcgccttcaattgcctcctcctcgaactcctcaagcaggtccttcgctgctgcacgcggcagcaggaggggtcgggtttttctcgaagaggcagtgctcctactccacaccccagaaccgacgagattcatcgctggtgagcagccgcagagccactcgtggcgaaatccagcagaagcggtggcggtggcgccgcacctcaccccgactgtcctccacctcgcggcctcccatcttacccctatcgcgcacctcgcggcggcgctcctgcccacgacacaggattggcccgtggcagacactgggacgactggctcgaccgcagcgcgaccaccgacaccggaacgaaggaccgcgccggtgatagcagagctagtcgagcaggcggacgttgacgccgatggtgaagtgcgtccagtggcgagcgggtggtggggacctgcgatggaaggacgtgctgggggagctgctggggggctgcgtggaaccgcagaagaagggagctgcggcggttggtcgtag

SEQ ID NO: 20605 - protein, 191 aa, Sorghum bicolor
  misc_feature: Ceres ANNOT ID no. 8656771
  misc_feature: Up-regulated in root tissues in response to salicylic acid treatment
MAYLVRRERSMKMRLWMLSPSIASSSNSSSRSFAAARGSRRGRVFLEEAVLLLHTPEPTRFIAGEQPQSHSWRNPAEAVAVAPHLTPTVLHLAASHLTPIAHLAAALLPTTQDWPVADTGTTGSTAARPPTPERRTAPVIAELVEQADVDADGEVRPVASGWWGPAMEGRAGGAAGGLRGTAEEGSCGGWS

SEQ ID NO: 20606 - DNA, 753 bp, Sorghum bicolor
  misc_feature: Ceres ANNOT ID no. 8656768
  misc_feature: Down-regulated in root tissues in response to methyl jasmonate treatment
  misc_feature: Down-regulated in shoot tissues in response to aminocyclopropane carboxylic treatment
  misc_feature: Down-regulated in shoot tissues in response to methyl jasmonate treatment
  misc_feature: Down-regulated in shoot tissues in response to salicylic acid treatment
  misc_feature: Encodes the peptide sequence at SEQ ID NO 20607
atgaagttcaacatcgcgaacccgaccaccgggtgccagaagaagctggaaatcgatgacgaccagaagctgcgtgccttttatgaccgaaggatctcccaggaggtcagtggtgatgctctgggcgaggagttcaagggttatgtcttcaagatcatgggtggatgtgacaagcaaggcttcccaatgaagcaaggagttctgacttctggtcgtgttcgccttctgctccacaggggtactccctgcttccgtggttatgggaggcgtaatggtgagcgcaggaggaagtctgtccgtggttgtattgttagccaagacctttctgttatcaacttggtgattgttaagaagggtgagaatgatcttcctggtttgactgacactgagaagccaaggatgaggggtcccaagagggcctccaagatcaggaagctctttaacctttccaaggatgatgatgtacgcaagtatgtgaacacataccgcaggacattcactaccaagagcggcaagaaggtgagcaaggcacctaagatccagcggcttgtgacccccttgaccctccagaggaagcgcgctagaattgctgacaagaagaagaggatcgctaagaagaagtctgaggctgctgagtaccagaagcttcttgcccagaggctgaaggaacagagggatcgccgtagcgagagcttggccaagaggaggtccaagctttcatctgctgccaaggccgctgcctccaccgcttaa

SEQ ID NO: 20607 - protein, 250 aa, Sorghum bicolor
  misc_feature: Ceres ANNOT ID no. 8656768
  misc_feature: Down-regulated in root tissues in response to methyl jasmonate treatment
  misc_feature: Down-regulated in shoot tissues in response to aminocyclopropane carboxylic treatment
  misc_feature: Down-regulated in shoot tissues in response to methyl jasmonate treatment
  misc_feature: Down-regulated in shoot tissues in response to salicylic acid treatment
  misc_feature (1)..(129): Pfam ID: Ribosomal_S6e Pfam Description: Ribosomal protein S6e
MKFNIANPTTGCQKKLEIDDDQKLRAFYDRRISQEVSGDALGEEFKGYVFKIMGGCDKQGFPMKQGVLTSGRVRLLLHRGTPCFRGYGRRNGERRRKSVRGCIVSQDLSVINLVIVKKGENDLPGLTDTEKPRMRGPKRASKIRKLFNLSKDDDVRKYVNTYRRTFTTKSGKKVSKAPKIQRLVTPLTLQRKRARIADKKKRIAKKKSEAAEYQKLLAQRLKEQRDRRSESLAKRRSKLSSAAKAAASTA

SEQ ID NO: 20608 - DNA, 1059 bp, Sorghum bicolor
  misc_feature: Ceres ANNOT ID no. 8656841
  misc_feature: Down-regulated in root tissues in response to methyl jasmonate treatment
  misc_feature: Down-regulated in shoot tissues in response to methyl jasmonate treatment
  misc_feature: Down-regulated in shoot tissues in response to salicylic acid treatment
  misc_feature: Encodes the peptide sequence at SEQ ID NO 20609
atggccaccaccgcgtccagcctcctcaagtcctccttcgcgggcgccaggctcccggcgtccacgcgcacgccgtcgtcgcccgccgtcgtggccaccccgcgcggcgccggggcgatccgcgcgtcgtccatctcctcctcgaacccgccctacgacctgacgtccttccggttcagccccatcaaggagtcggtcgtctcccgcgagatgacccggcggtacatgacggacatgatcacctacgccgacacggacgtggtcatcgtgggcgccggctccgcggggctctcctgcgcgtacgagctctccaaggacccgtccgtgagcatcgccatcgtggagcagtcggtgtcaccgggcggcggcgcgtggctgggcgggcagctgttctcggccatggtggtgcgcaagccggcgcacctgttccttgacgagctgggcgtcgcctacgacgaggccgaggactacgtggtcatcaagcacgccgcgctcttcacgtccaccgtcatgagccgcctcctggcgcgccccaacgtgaagctgttcaacgccgtcgccgtggaggacctgatcgtcaagggagggcgcgtcggcggcgtcgtcaccaactgggcgctcgtgtccatgaaccacgacacgcagtcgtgcatggacccaaacgtgatggaggccaaggtggtggtcagctcctgcggccacgacgggccgttcggggccaccggcgtcaagaggctgcaggacatcggcatgatcagcgacgtgcccgggatgaaggcactcgacatgaacaccgccgaggacgagatcgtgcgcctcacgcgcgaggtcgtgccaggcatgatcgtcaccggcatggaggtcgccgagattgacggcgccccgaggatgggcccgacgttcggcgccatgatgatctccgggcagaaggcggcgcacctggcgctgaaggcgctggggaggcccaacgccgtggacgggaccatcaaggtggtgtcgccggcgttgcgtcaggagttcgtgattgcgtccaaggacgatgaggtcgtggacgcgtga

SEQ ID NO: 20609 - protein, 352 aa, Sorghum bicolor
  misc_feature: Ceres ANNOT ID no. 8656841
  misc_feature: Down-regulated in root tissues in response to methyl jasmonate treatment
  misc_feature: Down-regulated in shoot tissues in response to methyl jasmonate treatment
  misc_feature: Down-regulated in shoot tissues in response to salicylic acid treatment
  misc_feature (59)..(301): Pfam ID: Thi4 Pfam Description: Thi4 family
MATTASSLLKSSFAGARLPASTRTPSSPAVVATPRGAGAIRASSISSSNPPYDLTSFRFSPIKESVVSREMTRRYMTDMITYADTDVVIVGAGSAGLSCAYELSKDPSVSIAIVEQSVSPGGGAWLGGQLFSAMVVRKPAHLFLDELGVAYDEAEDYVVIKHAALFTSTVMSRLLARPNVKLFNAVAVEDLIVKGGRVGGVVTNWALVSMNHDTQSCMDPNVMEAKVVVSSCGHDGPFGATGVKRLQDIGMISDVPGMKALDMNTAEDEIVRLTREVVPGMIVTGMEVAEIDGAPRMGPTFGAMMISGQKAAHLALKALGRPNAVDGTIKVVSPALRQEFVIASKDDEVVDA

SEQ ID NO: 20610 - DNA, 1110 bp, Sorghum bicolor
  misc_feature: Ceres ANNOT ID no. 8656833
  misc_feature: Up-regulated in root tissues in response to methyl jasmonate treatment
  misc_feature: Up-regulated in shoot tissues in response to methyl jasmonate treatment
  misc_feature: Encodes the peptide sequence at SEQ ID NO 20611
atggcgaccgtcatgcagaagatcaaggacatcgaggacgagatggcaaggacacagaagaataaagccactgctcaccatcttggtcttctgaaggctaaacttgcaaaactgcggcgggagttgctcactccgacatccaaaggtggtggtggtggtgctggtgaaggatttgatgtgacgaagagtggagatgcacgtgttggtttagttggctttccttcggtcggaaaatcaacattgttgaacaagctgacggggacattttcagaggttgctgcctacgagtttacaactttaacatgtatccctggagttatcatgtataagggtgctaaaatccagcttctagatctcccagggatcattgaaggtgctaaagatggaaagggcagaggaagacaggtcatcagcacagctaggacatgcaatgttattttgattgttcttgatgctataaaaccaataactcacaagcgtcttatcgagaaggagcttgaaggatttggcattaggttgaacaagacaccacccaatttgactttcagaagaaaggacaagggcggaatcaacttcacatcaacagttacaaacacacatttggaccttgatacagtaaaagcaatatgcagcgagtacaggatacataatgctgatgtctctctgagatatgatgctacagcagatgatctcatagatgttattgaaggaagccggatttacactccttgcatatatgttgttaacaagattgatcagataacacttgaagagctggaaatcttggacaaacttccccattactgcccggttagtgctcatcttgaatggaatcttgatggacttctggagaaggtatgggaatacttggatttggttaggatatacacaaaacctaaagggctgaacccagattatgaggatcctgttatcgtatcatctaagaagaaaactgtggaagatttctgcaacagaatccacaaggacatggtcaaacaatttaaatacgctctagtatggggttccagcgtcaagcataagccacagagagttggcaaggagcatgaacttgaggatgaggacgttgtccagatcattaagaaaatatag

SEQ ID NO: 20611 - protein, 369 aa, Sorghum bicolor
  misc_feature: Ceres ANNOT ID no. 8656833
  misc_feature: Up-regulated in root tissues in response to methyl jasmonate treatment
  misc_feature: Up-regulated in shoot tissues in response to methyl jasmonate treatment
  misc_feature (293)..(367): Pfam ID: TGS Pfam Description: TGS domain
  misc_feature (66)..(177): Pfam ID: MMR_HSR1 Pfam Description: GTPase of unknown function
MATVMQKIKDIEDEMARTQKNKATAHHLGLLKAKLAKLRRELLTPTSKGGGGGAGEGFDVTKSGDARVGLVGFPSVGKSTLLNKLTGTFSEVAAYEFTTLTCIPGVIMYKGAKIQLLDLPGIIEGAKDGKGRGRQVISTARTCNVILIVLDAIKPITHKRLIEKELEGFGIRLNKTPPNLTFRRKDKGGINFTSTVTNTHLDLDTVKAICSEYRIHNADVSLRYDATADDLIDVIEGSRIYTPCIYVVNKIDQITLEELEILDKLPHYCPVSAHLEWNLDGLLEKVWEYLDLVRIYTKPKGLNPDYEDPVIVSSKKKTVEDFCNRIHKDMVKQFKYALVWGSSVKHKPQRVGKEHELEDEDVVQIIKKI

SEQ ID NO: 20612 - DNA, 1329 bp, Sorghum bicolor
  misc_feature: Ceres ANNOT ID no. 8656884
  misc_feature: Up-regulated in root tissues in response to methyl jasmonate treatment
  misc_feature: Down-regulated in root tissues in response to methyl jasmonate treatment
  misc_feature: Down-regulated in root tissues in response to aminocyclopropane carboxylic treatment
  misc_feature: Down-regulated in shoot tissues in response to methyl jasmonate treatment
  misc_feature: Up-regulated in shoot tissues in response to salicylic acid treatment
  misc_feature: Up-regulated in root tissues in response to salicylic acid treatment
  misc_feature: Encodes the peptide sequence at SEQ ID NO 20613
atgagcgcgtcggaggaggacgcggcgcccgctgcggcggatgggggatccggaggcgggagcagcggcgcggggtcgtcggaagggggcgcgcggcgccggttcgacgacaagggcctcgtcgcccgcacctcgctcatcctgtggcacacgcaccagaacgacgtcggcgccgtgcggaagctgctggaggaggacgccgcgctcgtcaacgcccgggactacgacagccgcacgccgctccacgtcgccgcgctccacggctggcacgacgtcgccgagtgcctcatcgccaacggcgccgatgtcaacgcccaagaccgctggcagaacacgccactagctgatgcggagggcgcaaagaggcagtccatgattgagctgctcaaggagcacggtggattgacatatgggaaaactggaagccattttgaaccaaagacgattccaccacctctaacaaataaggctgactgggagattaatccacttgaattggacttcacaaaagcactcgttatcggaaagggctctttcggtgaaattctgaaagcaaattggcgaggaacacctattgctgtcaagcgcattcttccatccttatctgatgacaggctggtgatccaagactttaagcatgaagtcaacttgctaataaagctgaggcatccaaatattgtccagttccttggagcagttacagaaactaagcctctaatgctaattactgagtttctacgaggaggcgatcttcatcaatatctgaaggaaaaaggtgcactcaacccacttactgctgttagttttgcgctggatattgcaagaggaatggcatatcttcacaatgagcctaatgttgtgattcaccgagatttaaaaccaagaaatattcttctggtgaattctgctgccaaccacttaaaggttggagatttcggccttagcaagatcatcagagcgcagcatgcgaatgatgtatacaagatgactggagagacaggaagctatcggtacatggcccctgaagttttcaagcaccggaaatatgacaagaaagttgatatcttctcttttgccatgattctatatgagatgatggaaggtgatccacccttctccagctacgaaccttatgaggctgctaagtacgtggcagatgggcatcgccccattttccgtaaaagtcataccaatgagttgaaggatttggttgagctatgttggtctggggatatcagtctgagaccatctttcttggagatcctcaagaggcttgagaagcttaaggagcattattcgcatgagaaccactggcatttgttccagtag

SEQ ID NO: 20613 - protein, 442 aa, Sorghum bicolor
  misc_feature: Ceres ANNOT ID no. 8656884
  misc_feature: Up-regulated in root tissues in response to methyl jasmonate treatment
  misc_feature: Down-regulated in root tissues in response to methyl jasmonate treatment
  misc_feature: Down-regulated in root tissues in response to aminocyclopropane carboxylic treatment
  misc_feature: Down-regulated in shoot tissues in response to methyl jasmonate treatment
  misc_feature: Up-regulated in shoot tissues in response to salicylic acid treatment
  misc_feature: Up-regulated in root tissues in response to salicylic acid treatment
  misc_feature (165)..(418): SWISSPROT Homolog: EC 2.7.11.1 Non-specific serine/threonine protein kinase
  misc_feature (168)..(425): Pfam ID: Pkinase_Tyr Pfam Description: Protein tyrosine kinase
  misc_feature (76)..(108): Pfam ID: Ank Pfam Description: Ankyrin repeat
MSASEEDAAPAAADGGSGGGSSGAGSSEGGARRRFDDKGLVARTSLILWHTHQNDVGAVRKLLEEDAALVNARDYDSRTPLHVAALHGWHDVAECLIANGADVNAQDRWQNTPLADAEGAKRQSMIELLKEHGGLTYGKTGSHFEPKTIPPPLTNKADWEINPLELDFTKALVIGKGSFGEILKANWRGTPIAVKRILPSLSDDRLVIQDFKHEVNLLIKLRHPNIVQFLGAVTETKPLMLITEFLRGGDLHQYLKEKGALNPLTAVSFALDIARGMAYLHNEPNVVIHRDLKPRNILLVNSAANHLKVGDFGLSKIIRAQHANDVYKMTGETGSYRYMAPEVFKHRKYDKKVDIFSFAMILYEMMEGDPPFSSYEPYEAAKYVADGHRPIFRKSHTNELKDLVELCWSGDISLRPSFLEILKRLEKLKEHYSHENHWHLFQ

SEQ ID NO: 20614 - DNA, 1539 bp, Sorghum bicolor
  misc_feature: Ceres ANNOT ID no. 8656911
  misc_feature: Up-regulated in root tissues in response to methyl jasmonate treatment
  misc_feature: Up-regulated in shoot tissues in response to methyl jasmonate treatment
  misc_feature: Up-regulated in root tissues in response to salicylic acid treatment
  misc_feature: Up-regulated in shoot tissues in response to salicylic acid treatment
  misc_feature: Encodes the peptide sequence at SEQ ID NO 20615
atggatctggcgtggatggtggcggcggccgtcgcgtcggtgctggcgtcgtgggcgttcaacgcgctggtgcacctcgtctggcgcccctacgccatcacccggagcctccgcgcgcagggcgtccgcgggccggactacaggttcttcaccgggagcctcggcgagatcaagcggctccgcgccgagggcgccgccgtcacgctggacgtcgacgaccatgacttcatccccatggtgcagccgcatctgcgcaagtggatcgcgctctacggacggacgttcgtgtactggaccggcgcgaggccgaacgtgtgcgtggcggacgtcaacgtggtcaggcaggtgctcttcgaccgcaccggcctctaccccaagaacctcatgaacccgcacgtctcccgcctcctcggcaagggcttcgtcctcaccgacggcgacgactggaagcgccaccgcaaggtcgtgcacccggctttcaacatggacaagctcaagatgatgacggtcaccatgtccgactgtgctcgctccatgatgtccgagtgggaggcacagctcgcgaagggcggtgaagtggaggtcgagctgagcagccggttcgaggagctcaccgccgatgtcatctcgcacactgcgttcgggagcagctacaacgaggggaaacaggtgtttctggcgcagagggagctccagtacatcgccttctcgaccgttttcaatgtccagatcccggtgttcaggtaccttccaaccgagaagaacctcaagacacggaagctggacaggcaggtgaggggcatgctcatggacatcatcaagacccgcctcgccagcaaggacaccgccggctacgggaacgacctgctcgggctcatgctggaggcgtgcgcgccggagcacggcgagacgccggtgctgagcatggacgagatcatcgacgagtgcaagacattcttcttcgccgggcacgacaccacgtcgcacttgctcacctgggcctcgttccttctgagcacgcacccggagtggcaggacaggctccgggaggaggtccggcgggagtgcggcgacgaggtccccaccggcgacgcgctcaacaagttgaagctcgtcaacatgttcctcctggagacgctgcggctgtacggcccggtgtccctgatccagaggaaggcgggatcggacctcgatcttggcggcatccgggtacccgagggcgcgatcctgaccatcccaatcgcgacgatccaccgcgacaaggaggtctggggcgacgacgccggcgagttcaagccggagaggttcgagaacggggtgacgagggcggccaagcaccccaatgcgctgctgtccttctccagcgggccaaggtcgtgcatcggtcagaacttcgcgatgatcgaggctaaggctgtggtcgccatgatcctgcagaggttcgcgctcgagctgtcccccaaatacgtccacgcgcccatggacgtgatcaccctgcgcccaaggcacgggctccccatgctcctcaagcgcctgtag

SEQ ID NO: 20615 - protein, 512 aa, Sorghum bicolor
  misc_feature: Ceres ANNOT ID no. 8656911
  misc_feature: Up-regulated in root tissues in response to methyl jasmonate treatment
  misc_feature: Up-regulated in shoot tissues in response to methyl jasmonate treatment
  misc_feature: Up-regulated in root tissues in response to salicylic acid treatment
  misc_feature: Up-regulated in shoot tissues in response to salicylic acid treatment
  misc_feature (28)..(512): SWISSPROT Homolog: EC 1.3.3.9 Secologanin synthase
  misc_feature (42)..(507): Pfam ID: p450 Pfam Description: Cytochrome P450
MDLAWMVAAAVASVLASWAFNALVHLVWRPYAITRSLRAQGVRGPDYRFFTGSLGEIKRLRAEGAAVTLDVDDHDFIPMVQPHLRKWIALYGRTFVYWTGARPNVCVADVNVVRQVLFDRTGLYPKNLMNPHVSRLLGKGFVLTDGDDWKRHRKVVHPAFNMDKLKMMTVTMSDCARSMMSEWEAQLAKGGEVEVELSSRFEELTADVISHTAFGSSYNEGKQVFLAQRELQYIAFSTVFNVQIPVFRYLPTEKNLKTRKLDRQVRGMLMDIIKTRLASKDTAGYGNDLLGLMLEACAPEHGETPVLSMDEIIDECKTFFFAGHDTTSHLLTWASFLLSTHPEWQDRLREEVRRECGDEVPTGDALNKLKLVNMFLLETLRLYGPVSLIQRKAGSDLDLGGIRVPEGAILTIPIATIHRDKEVWGDDAGEFKPERFENGVTRAAKHPNALLSFSSGPRSCIGQNFAMIEAKAVVAMILQRFALELSPKYVHAPMDVITLRPRHGLPMLLKRL

SEQ ID NO: 20616 - DNA, 6618 bp, Sorghum bicolor
  misc_feature: Ceres ANNOT ID no. 8656948
  misc_feature: Down-regulated in shoot tissues in response to salicylic acid treatment
  misc_feature: Encodes the peptide sequence at SEQ ID NO 20617
atggccaacctcggcggcggcgccgaggcgcacgcgcggttcaagcagtacgagtaccgcgccaactccagcctcgtcctcaccaccgactcccgcccgcgcgacacccacgagcctaccggtgagcccgagacgctctggggcaggatcgaccccaggtccttcggcgaccgcgccgtccagaacaagccgcccgagctcgaggagaagctctccaagtcgcgcaccaagaagtctaagcgcgacgctgctgctgcggcggaccccgccgacctcccccgtcgcgacgccaagcgcaggcgccgcgccgcttctacccaggaggtctccgtcctctccctcaccgacgacgccgtctacaagccccagaccaaggagacgcgcgctgcctacgaggccctgctcagcctcatccagcagcagcttggcggccagccccttgacgtcctcgccggggcagctgatgaggtgcttgccacgctcaagaatgacaaggtcaagaaccctgataagaagaaggacattgagcagctgctcaaccctatctccagccagctctttgaccagcttgtctccatcggcaagctcatcaccgacttccatgatgcggcggccggtgacgctgccggtgtgccttctgccgatggcacggacaccaccctggatgatgatgttggtgttgctgtcgagtttgaagaagatgaagatgaggagagtgattttgatcagatgggcggcgagttagacgatgatgacatgcagaacgccaaccaggggctggccgtcaatgttcaggacatcgatgcttactggctccagaggaagatatcccaggcatatggggatggggacattgatgcccagcagagccagaagcttgccgaggatatcttgaagatcattgctgagggcgacgatagagacgtcgagaatcgccttgtcatgctcttggactatgagaagtttgatctcattaagttgctgctgcgcaaccgtctcaagattgtttggtgcacccgcttagccagggccgaagatcaggaacagaggaagaagatagaggaagagatggcaagtgacccaagtttggctccaatattggagcagctacatgcaaccagagcatctgcaaaggagaggcagaagaacctggagaaaagtatcagggacgaggcgaagaggctcctcaacaatgatgctggcgctgatggtgccagggaccgcagggcagctgagcgggacatggagagtggatggctgaaaggacagagacagctgcttgatctcgaaagcctctcgttccatcagggtggtctctttatggctaacaagaaatgtgaactgccgactggatcgtttagaacccctcataaggggtatgaggaggttcatgtgccagcactgaaggctaagccctatgaaacatcggagaagattgtcaagatatctgatatgccagagttcgcacggtcagctttcgatgggatgacccagctgaacagagttcagagcagggtctatgatactgctcttttcaaaccagacaatatccttctctgtgctccgactggtgctggcaaaacaaatgtggctgtgcttaccatccttcagcagatcggtctgcatatgcaggatgatgggcagtttgataataccaagtacaaaattgtctatgtggccccgatgaaagcgttggttgctgaagtcgttggaaacttgtcgaatcgtttggcaggttacaatgttactgttagggagctcagtggagaccagaacttgaccaagcaacagattgatgaaacacagattatcgtcacgacacctgagaaatgggatattgtgaccaggaaatcaggggacagaacctatacccaaatggtgaagctgttaatcattgatgagatccatctgctacatgataacagagggcctgttctggagagcattgttgctaggacagtcaggcagattgagacgaccaaggagcatattcgtctggttgggctctctgcgactctaccaaactatgaagatgttgcattattcttgcgtgttcgcaaagaaagcctcttctattttgacaacagttaccgaccttgccctcttgctcagcaatacattgggatcactgtgaggaagccactacagaggatgcagttgatgaatgagatctgttacgagaaggttatggctgccgctggtaagcatcaagtgctgatatttgtacactcaaggaaggagacggcaaagactgccaaagccatcagagatacggcgttggcaaatgacacagtcagccgctttctgaagaacgagagtgcaagccaagagatccttggcactcatgctgaacttgtcaaaaacaatgatcttaaagaccttttgccttatgggtttgctattcatcatgctgggatggcaagagttgaccgtgagcttgttgaggagctttttgctgacaagcacattcaagtacttgtatccactgctacccttgcatggggtgtcaatttgcctgcacatactgttatcataaagggtacgcagatttacaacccagaaaaaggtgcttggacagaactaagccctctggatgttatgcagatgcttggtcgtgcaggaaggcctcagtatgatacacatggagagggaataatcttgactggccacagtgaattgcagttctacctgtctcttatgaaccagcagttgcctattgagagtcagttcatatccaaattggctgatcaattgaatgcagaaattgttctggggactattcagaatgctcgtgaagcatgctcgtggcttggctatacttacctctatattcggatgctccgcaatccaacattgtatggtttgccagcagatatcttggagagtgataaaacgcttgatgaaaggagagctgatttgatacattccgctgcaaatctactggataggaacaatctgataaagtatgacaggaaaacaggatactttcaagttactgacctgggaaggattgccagttattactatatcagtcatggaactatttcaacatacaatgagtacctaaaacctacaatgggtgatatcgaactgtgccgactgttttctcttagtgaagaatttaagtatgtcggtgtcaggcttgatgagaaaatggaactggctaagcttttggatcgtgtaccaatacccgtgaaagagagcttggaggaaccaagtgcaaagatcaacgttctgctgcaagcatatatttctaggttgaaactggaaggcctttctcttagttctgatatggtctacatcagacagagtgctggccgtctcttacgagcactatttgagattgttttgaagaggggatgggctcaactagcagagaaagcgctgaatctttgcaagatggtcgataaacaaatgtggagtgttcaaactcccttgcggcagtttactggaattccaaaggagatcttgatgaaactcgagaagaaggagttggcttgggagaggtactacgatctgtcctcacaagaaattggtgaactgatccgctatcccaagatggggaggcagctgcacaagtgcatccaccagttaccaaagctgaatctttcagcccatgtccagcccattactcgtacagttttgggttttgagctgacaattacacctgattttcagtgggatgataaggtacatggatatgtggagcccttttgggttattgttgaggataatgatggcgagtacattcttcaccatgaatatttcatgcttaagaaacagtatgttgatgaagatcatacattgaacttcacagtgccgatatatgagccactgcctcctcagtatttcattcgtgttgtgtctgacaagtggcttggttctcagacaattctccctgtctgctttaggcacttaattctaccagaaaaatatgctccaccaactgaattgcttgatctgcagcctctgcctgttagtgcattgagaaatgcaagatatgagggcctctatagtgcttttaagcatttcaatcccatccaaactcaagtattcactgtcttgtataacagtgatgacagcgtgttggttgctgcaccaactggcagtgggaagacgatatgtgcggagtttgctatactaaggaaccaccagagggcagtgtctggtgagagcaacatgcgggttgtttatatagctcccatcgaaggtcttgcaaaagaaagatacagggactgggagcggaaatttggagagtttgccaaggtagtcgagctcactggtgaaacagcagctgatttgaagcttctggataaaggtgagatcataatcagtactcctgaaaagtgggatgcactgtctcgccggtggaaacagcgaaagcacatccaacaggtcagcttattcatagttgatgaacttcatctacttggatctgataagggacatgttttggaagtcattgtatctaggatgaggcgcatttccagtcacattggcagtaacatacggatcgtagcactttcagcatcacttgctaatgctaaagatctcggtgaatggattggtgccacttctcatggccttttcaacttccctccagcagtgagacctgtgccattggaaattcatatccagggtgtggatatagcaaactttgaggcaaggatgcaagcaatgacaaagcctacctacactgccatcacacagcatgcaaagaacagtaaacctgccctggtgtatgtaccaacaaggaagcatgcaaggttgactgcactggacttgtgtgcgtactctagtgttgagggtgctggaacaccatttcttcttgggtcagaagatgagatggatactttcaccagaggtgtcgaagaagagacgcttaagaatacacttaaatgtggtgtaggctatttgcatgagggtctaagtgagcttgatcaggaacttgtaacccagttgttccttggtgggaggatccaagtgtgtgttgcaagcagcacaatgtgttggggaagaccattgcctgctcatttggttgttgtcatggggactcagtattatgatggccgggagaatgctcacaccgattatccaattacagatctgcttcaaatgatgggtcacgccagcagaccacttcaagataactcagggaaatgtgttatattgtgtcatgcacctcgcaaagagtactacaagaagttcctttttgaggccttccctgtcgagagcaatcttcaccatttcttgcatgatcacatgaatgctgaggtggtggttggtgttgtagaaaataagcaagatgctgtggattatcttacttggactttcatgtatcggcggttgacaaagaatcctaacttctacaatcttcagggtgtaagtcacaggcatctgtcagatcatctttctgagctagttgagactgtcctgaatgatcttgaatcaagcaagtgtgtggctatagaggaggacatgtacctgaagcccctcaaccttggccttattgcttcatactactatattagctacacaactattgagcgttttagttctatgctgacccagaagactaaggtgaaaggactcctagagattctagcatctgcttcagaatatgcagagcttccgggtcgtcctggtgaggaagaattcattgagaggcttgttcgccaccagaggttctctatcgagaaacccaagtatggcgatccacatgtgaaggccaatgctctactgcaagcccatttttcaaggcacacagtggtcgggaacctggcagctgatcagcgtgagattctcctttctgctcataggttgctccaggcaatggttgatgttatatccagcaatggttggcttagtcttgctcttagtgcaatggagctgagtcaaatggtgacacaaggcatgtgggatcgggattctgtgctgcttcaagttccacacttcacaaaggacttggctcggaggtgccaggaaaatgaagggaagcccattgagagtatctttgatcttgctgagatgggtgtcgatgagatgcgggatctcttacagctatcaaactctcagctgcaagacattattgaattctttaagcggttcccaaatgttgatatgacctatgaggtccgtgagggtgatgatataactgctggtgacaatgtaaccgtgcaggtaactctggagcgtgacatgactaatgtgtcatctgaggttggtccagttcatgcgccaaggtttcccaagcctaaggaagaaggctggtggctggttattggcgacagctccacaaaccagttactggcaatcaaaagagtggcactccagaagagggcgagagtgaaacttgagttctctgctcctgcagaggctgggagaaaggattacatgatttacttaatgtcagactcttacttgggctgcgatcaggagtatgagttcaccgttgatgtcaaggatgataggactgcttatatgtttctgttgtttccatctatcttcctacaaagatggtggatatggatggatgccttccagcattggccgttcaaatttaccaggcttggttacacaagctttgctttgcgtgagaatgtattaattgcgaactga

SEQ ID NO: 20617 - protein, 2205 aa, Sorghum bicolor
  misc_feature: Ceres ANNOT ID no. 8656948
  misc_feature: Down-regulated in shoot tissues in response to salicylic acid treatment
  misc_feature (998)..(1303): Pfam ID: Sec63 Pfam Description: Sec63 Brl domain
  misc_feature (1831)..(2151): Pfam ID: Sec63 Pfam Description: Sec63 Brl domain
  misc_feature (500)..(679): Pfam ID: DEAD Pfam Description: DEAD/DEAH box helicase
  misc_feature (1345)..(1518): Pfam ID: DEAD Pfam Description: DEAD/DEAH box helicase
  misc_feature (793)..(877): Pfam ID: Helicase_C Pfam Description: Helicase conserved C-terminal domain
MANLGGGAEAHARFKQYEYRANSSLVLTTDSRPRDTHEPTGEPETLWGRIDPRSFGDRAVQNKPPELEEKLSKSRTKKSKRDAAAAADPADLPRRDAKRRRRAASTQEVSVLSLTDDAVYKPQTKETRAAYEALLSLIQQQLGGQPLDVLAGAADEVLATLKNDKVKNPDKKKDIEQLLNPISSQLFDQLVSIGKLITDFHDAAAGDAAGVPSADGTDTTLDDDVGVAVEFEEDEDEESDFDQMGGELDDDDMQNANQGLAVNVQDIDAYWLQRKISQAYGDGDIDAQQSQKLAEDILKIIAEGDDRDVENRLVMLLDYEKFDLIKLLLRNRLKIVWCTRLARAEDQEQRKKIEEEMASDPSLAPILEQLHATRASAKERQKNLEKSIRDEAKRLLNNDAGADGARDRRAAERDMESGWLKGQRQLLDLESLSFHQGGLFMANKKCELPTGSFRTPHKGYEEVHVPALKAKPYETSEKIVKISDMPEFARSAFDGMTQLNRVQSRVYDTALFKPDNILLCAPTGAGKTNVAVLTILQQIGLHMQDDGQFDNTKYKIVYVAPMKALVAEVVGNLSNRLAGYNVTVRELSGDQNLTKQQIDETQIIVTTPEKWDIVTRKSGDRTYTQMVKLLIIDEIHLLHDNRGPVLESIVARTVRQIETTKEHIRLVGLSATLPNYEDVALFLRVRKESLFYFDNSYRPCPLAQQYIGITVRKPLQRMQLMNEICYEKVMAAAGKHQVLIFVHSRKETAKTAKAIRDTALANDTVSRFLKNESASQEILGTHAELVKNNDLKDLLPYGFAIHHAGMARVDRELVEELFADKHIQVLVSTATLAWGVNLPAHTVIIKGTQIYNPEKGAWTELSPLDVMQMLGRAGRPQYDTHGEGIILTGHSELQFYLSLMNQQLPIESQFISKLADQLNAEIVLGTIQNAREACSWLGYTYLYIRMLRNPTLYGLPADILESDKTLDERRADLIHSAANLLDRNNLIKYDRKTGYFQVTDLGRIASYYYISHGTISTYNEYLKPTMGDIELCRLFSLSEEFKYVGVRLDEKMELAKLLDRVPIPVKESLEEPSAKINVLLQAYISRLKLEGLSLSSDMVYIRQSAGRLLRALFEIVLKRGWAQLAEKALNLCKMVDKQMWSVQTPLRQFTGIPKEILMKLEKKELAWERYYDLSSQEIGELIRYPKMGRQLHKCIHQLPKLNLSAHVQPITRTVLGFELTITPDFQWDDKVHGYVEPFWVIVEDNDGEYILHHEYFMLKKQYVDEDHTLNFTVPIYEPLPPQYFIRVVSDKWLGSQTILPVCFRHLILPEKYAPPTELLDLQPLPVSALRNARYEGLYSAFKHFNPIQTQVFTVLYNSDDSVLVAAPTGSGKTICAEFAILRNHQRAVSGESNMRVVYIAPIEGLAKERYRDWERKFGEFAKVVELTGETAADLKLLDKGEIIISTPEKWDALSRRWKQRKHIQQVSLFIVDELHLLGSDKGHVLEVIVSRMRRISSHIGSNIRIVALSASLANAKDLGEWIGATSHGLFNFPPAVRPVPLEIHIQGVDIANFEARMQAMTKPTYTAITQHAKNSKPALVYVPTRKHARLTALDLCAYSSVEGAGTPFLLGSEDEMDTFTRGVEEETLKNTLKCGVGYLHEGLSELDQELVTQLFLGGRIQVCVASSTMCWGRPLPAHLVVVMGTQYYDGRENAHTDYPITDLLQMMGHASRPLQDNSGKCVILCHAPRKEYYKKFLFEAFPVESNLHHFLHDHMNAEVVVGVVENKQDAVDYLTWTFMYRRLTKNPNFYNLQGVSHRHLSDHLSELVETVLNDLESSKCVAIEEDMYLKPLNLGLIASYYYISYTTIERFSSMLTQKTKVKGLLEILASASEYAELPGRPGEEEFIERLVRHQRFSIEKPKYGDPHVKANALLQAHFSRHTVVGNLAADQREILLSAHRLLQAMVDVISSNGWLSLALSAMELSQMVTQGMWDRDSVLLQVPHFTKDLARRCQENEGKPIESIFDLAEMGVDEMRDLLQLSNSQLQDIIEFFKRFPNVDMTYEVREGDDITAGDNVTVQVTLERDMTNVSSEVGPVHAPRFPKPKEEGWWLVIGDSSTNQLLAIKRVALQKRARVKLEFSAPAEAGRKDYMIYLMSDSYLGCDQEYEFTVDVKDDRTAYMFLLFPSIFLQRWWIWMDAFQHWPFKFTRLGYTSFALRENVLIAN

SEQ ID NO: 20618 - DNA, 1665 bp, Sorghum bicolor
  misc_feature: Ceres ANNOT ID no. 8656985
  misc_feature: Up-regulated in shoot tissues in response to salicylic acid treatment
  misc_feature: Encodes the peptide sequence at SEQ ID NO 20619
atggcgttcctattcggtgcattcctgggcctggtggtgggcgtggccgtcgtgatggcgtttgcgcgattcgagaacagccgcgccgagcagcgccgtgagctggctgctatagctgctgctttctcgaagttgactgtacaggatttgaggaagctcatcccacctgagttctatccatcatggcttaaatggctgaatcaagagttggtaaaaatctggccatatgtcaatgaggctgcatcagagttgattaaaacttctgtggagcctgtttttgagcagtacaagtcattcatcttggcttccctccatttctcaaagttgacacttggcactgttgcccctcagtttactggtgtttcaatcttggagagtgatgattctgccatcaccatggaactcgagttgcaatgggatggcaatcccaatatcgtacttgacatccaaacaacacttggaatttctcttcctgtacaggtgaaaaatattggattcacaggagtacttcggctcgtattcaaacctcttgtggctgaattaccctgttttggagccgtttgttgttctttaagggagaagagcaaggtggaatttaccctcaaggtcattggtggcgaaatgactgctattccaggaatttctgatgcaattgagggtacgatacgtgatacaatcgaggatacactgacatggccgaatcgcataattgttcccattgtacctggtgactatagtgacttggagttgaaacctactggggtattagaagtaaaactggtggaagctagggacctaacgaacaaggaccttgtgggaaagtcagacccttttgcagtgctatacatacgtccattgcgtgagaaaacaaagaaaagcaaaacaattaacaatgatttgaaccccatctggaacgagcactatgaatttgtggttgaggacatatctacacagcacttgactgtaaaaatttatgatgacgaaggactccaatcatcagagatcattggctgtgctcgagtagacttagctgatctacagccaggaaaagtgaaagatttatggttagatcttgtgaaggacctggaaattcaacgagacaagaaacctcgtggtcaggttcacttggagctcctctactacccttacgctaagcatgaaggggttcctaatccttttgctaatcagattcaattaacttcattggagaaggttctcaaaaccgagtctaatggatatgatgttaatcagaggaaaaatgttattatgagaggagtcctttcggtaacagtcatatctgcagaggacttgccacctatggacattggtggcaaggctgacccatttgtggtcctgtacttgaagaagggagaaaccaaaaagaagacaagggttgtgacagacacgctaaatccaatatggaaccagacatttgatttcatggtagaagatgcactgcatgatttgctcatggtggaagtatgggaccatgatacatttggaaaggattacgtagggaggtgcatcttgacactcacgagagttatacttgaaggtgaattccaagatacctttgtcttgcaaggtgccaaatcgggaaaactgaacctgcacttcaagtggacgccacagccaatctatcgagatcgtgaccgggaccagtga

SEQ ID NO: 20619 - protein, 554 aa, Sorghum bicolor
  misc_feature: Ceres ANNOT ID no. 8656985
  misc_feature: Up-regulated in shoot tissues in response to salicylic acid treatment
  misc_feature (419)..(534): SWISSPROT Homolog: EC 2.7.11.13 Protein kinase C
  misc_feature (427)..(509): Pfam ID: C2 Pfam Description: C2 domain
  misc_feature (256)..(340): Pfam ID: C2 Pfam Description: C2 domain
MAFLFGAFLGLVVGVAVVMAFARFENSRAEQRRELAAIAAAFSKLTVQDLRKLIPPEFYPSWLKWLNQELVKIWPYVNEAASELIKTSVEPVFEQYKSFILASLHFSKLTLGTVAPQFTGVSILESDDSAITMELELQWDGNPNIVLDIQTTLGISLPVQVKNIGFTGVLRLVFKPLVAELPCFGAVCCSLREKSKVEFTLKVIGGEMTAIPGISDAIEGTIRDTIEDTLTWPNRIIVPIVPGDYSDLELKPTGVLEVKLVEARDLTNKDLVGKSDPFAVLYIRPLREKTKKSKTINNDLNPIWNEHYEFVVEDISTQHLTVKIYDDEGLQSSEIIGCARVDLADLQPGKVKDLWLDLVKDLEIQRDKKPRGQVHLELLYYPYAKHEGVPNPFANQIQLTSLEKVLKTESNGYDVNQRKNVIMRGVLSVTVISAEDLPPMDIGGKADPFVVLYLKKGETKKKTRVVTDTLNPIWNQTFDFMVEDALHDLLMVEVWDHDTFGKDYVGRCILTLTRVILEGEFQDTFVLQGAKSGKLNLHFKWTPQPIYRDRDRDQ

SEQ ID NO: 20620 - DNA, 2505 bp, Sorghum bicolor
  misc_feature: Ceres ANNOT ID no. 8656987
  misc_feature: Down-regulated in shoot tissues in response to aminocyclopropane carboxylic treatment
  misc_feature: Down-regulated in shoot tissues in response to methyl jasmonate treatment
  misc_feature: Down-regulated in shoot tissues in response to salicylic acid treatment
  misc_feature: Encodes the peptide sequence at SEQ ID NO 20621
atgagttcaatcgtgggcctcgttatctccatgatagccaaggtctgcgatgacatggagaaagacagggagcgccatgccaaactctgcggtggcctccgatccatcaagcgggagatggagacggtgattgccttgatgaaggacaaggacacggagtgccgaggagcggtgcaggagatcaggtttcagcagctgcaggagtttgcctacgacgtcgaagatttcgtggaaggtctctgggatccagcagcctatggcaaactcctcgtggccataaggatggatccccgtactgaacagcttattcgcatcgagcagttcaaggagacaatctcgtctctagcaaatgatttgaatcatcagagcgctgataaagatcatcagggtgctgctatatcagcagacgacccggatgaagaagaatatgcagaggagcagcagtttgaggccatggacgggcccaagagtaaaattattgagctgctcaagccctcgccaggggaggggcagcagctgcgagtgatctccatcgtgggatgccgcggcgtgggaaagactgccctcgcaagagcagtatatgacaagtattattcctcctccgatgaattcgactgcgttgcttgggttgtagcttctggatgcaacaacaagaaggctcttctagacaagattctcgagagtcaagtaaaagtgtggaaagatacagttgatgcctgcccaaaacttggcagcaaaagcagaatagttgtgaccacgagtgttctctctgtcgccacagcctgcagctctggaagttatgtgtacagaatgggctatcttagtgatgatgattcaaagagtttattctggagaaaggtttatggatgtcaaaataaggaacctccatattcactggtaacggattcagaatgcatcttcagtaaatgtggtggcttaccactggcactaactagtgtagccaaacatttaaatataataggagaaaagctggagagtactcactgtagagaggtgggacaaaaccttggcaaagactacctgtcagctggtaacaacaatgcagcagtgagcgtctttaaggaaatgagaagagcacttaggcattgctacgacagcttgcctgactatgaccacaggtcctgcatgctttacctgggcattttccctaagggccatcagattaaaagcaagagcctagtgagaagattaaaggctgaaggattagtcaatgaaggctgtaaatgttttgatgagttgattgaccggtgtattgtcgagccagtgcagatctgcaacaattcggtagttgccaaaaggtgtcaagttcacagtgtagtgctagagtacatcattcaaaagtcagtagctaaaaatgtggtcactcttattcaagaccttgagcccgtacttaaaggaagcactgaggcctgtgtccgccgactctctattcagtccagcaccaaagaaagatttgatgaactggatgatgacaagtctgctttaaggtcgttaacaatgttcaacaccgagccttgtgatttacagaagtgcaagatgctgcggatccttgatcttgaaggttgcaatgggcttgaccaggaatttcttgaaggcctatgtgagttgttgtttctcaagtatctcaacctcaggaaaactcgcatcaacaagcttcccccaaaaatagagaaacttcaacgtttggagacgctggatatccgagagacaaaggtggaaagattgcccatgcaggtcatcatgttgcccaagttagcttatctgtttggcaagtttcagctacctgaggttcccaccaaaggaaaagaagccgacaagctttatgcgttcctgaaaaagaatagtgtactgcacacacttgctggatttgttaccaataagagacgaagccccgaacatgttatacttctcgcaagaaacctgaaaaaggttaaagtatgtgaactttgcaatgacttcttgggttcactagagggtccgtgcaccatcagttctatcaaactgcggggaattttgaacagtctgcctgactctaacaagttagctgagctaggtagaattaagaagctgcagctcttctcaactggtctcaccatcaaagatctatcggccttgcaatgtttacgtggcttggaatatctgaagatggtagagcataacactgatagattttgcaacggtgttttcattgtggagaaaaaggggtttgaaagccttaagagcctgtgcattgacgccccaaagcttccaaaaatgcaattcaaagaaggttccatgagaagcctaacatccctttacctcctttgtccaaattctcagctgccgtcaggaaccatcgagggcatctcacatcttgcaaatctcagtgaggtgatgctacacagttcaatggaaaaagcgtgggaaacagtagcaaatggacaccctaaccgcccgtgtgtgaagaggcaaccagctgaaccaattggcatcacagcagcataa

SEQ ID NO: 20621 - protein, 834 aa, Sorghum bicolor
  misc_feature: Ceres ANNOT ID no. 8656987
  misc_feature: Down-regulated in shoot tissues in response to aminocyclopropane carboxylic treatment
  misc_feature: Down-regulated in shoot tissues in response to methyl jasmonate treatment
  misc_feature: Down-regulated in shoot tissues in response to salicylic acid treatment
  misc_feature (132)..(415): Pfam ID: NB-ARC Pfam Description: NB-ARC domain
MSSIVGLVISMIAKVCDDMEKDRERHAKLCGGLRSIKREMETVIALMKDKDTECRGAVQEIRFQQLQEFAYDVEDFVEGLWDPAAYGKLLVAIRMDPRTEQLIRIEQFKETISSLANDLNHQSADKDHQGAAISADDPDEEEYAEEQQFEAMDGPKSKIIELLKPSPGEGQQLRVISIVGCRGVGKTALARAVYDKYYSSSDEFDCVAWVVASGCNNKKALLDKILESQVKVWKDTVDACPKLGSKSRIVVTTSVLSVATACSSGSYVYRMGYLSDDDSKSLFWRKVYGCQNKEPPYSLVTDSECIFSKCGGLPLALTSVAKHLNIIGEKLESTHCREVGQNLGKDYLSAGNNNAAVSVFKEMRRALRHCYDSLPDYDHRSCMLYLGIFPKGHQIKSKSLVRRLKAEGLVNEGCKCFDELIDRCIVEPVQICNNSVVAKRCQVHSVVLEYIIQKSVAKNVVTLIQDLEPVLKGSTEACVRRLSIQSSTKERFDELDDDKSALRSLTMFNTEPCDLQKCKMLRILDLEGCNGLDQEFLEGLCELLFLKYLNLRKTRINKLPPKIEKLQRLETLDIRETKVERLPMQVIMLPKLAYLFGKFQLPEVPTKGKEADKLYAFLKKNSVLHTLAGFVTNKRRSPEHVILLARNLKKVKVCELCNDFLGSLEGPCTISSIKLRGILNSLPDSNKLAELGRIKKLQLFSTGLTIKDLSALQCLRGLEYLKMVEHNTDRFCNGVFIVEKKGFESLKSLCIDAPKLPKMQFKEGSMRSLTSLYLLCPNSQLPSGTIEGISHLANLSEVMLHSSMEKAWETVANGHPNRPCVKRQPAEPIGITAA

SEQ ID NO: 20622 - DNA, 585 bp, Sorghum bicolor
  misc_feature: Ceres ANNOT ID no. 8657026
  misc_feature: Down-regulated in root tissues in response to aminocyclopropane carboxylic treatment
  misc_feature: Down-regulated in shoot tissues in response to salicylic acid treatment
  misc_feature: Encodes the peptide sequence at SEQ ID NO 20623
atggattccaggatctccgtcctctgctccctcgtcctcgcctcctccctcctgcactgcgccagatccgacggtaatgacgctcagcttctcaagggcatcaacagctacaggtcctccctcaaggtcccggcgctgacggagaacacgaacgcggcgtgcctcgccgagcagctcgcgaagcagttcaaggggcagcagtgcaccaacaccacgggcgccaacaccgtcatcggcaccgagcagcagttcccggactaccccaagtacctggaccactgccacctcaatgcgtcggtgaccgaggacggccaggtgatgccggcgtgtgtgccggggctcgtccccgccgtcgtcctcaccaactacaccaagtcgcagtacaacaggttcttgaacgacacccagttctccggtgtcgggatcgccaatgagggcgactgggtggtggttgtcctcagcaccagcacgggctccggtgactactcgccggctccgccgggctccaattgggcggcttcggctctgccgttcacccaactggttcttttgctgataggatttgtgatcttgctcatcaagtga

SEQ ID NO: 20623 - protein, 194 aa, Sorghum bicolor
  misc_feature: Ceres ANNOT ID no. 8657026
  misc_feature: Down-regulated in root tissues in response to aminocyclopropane carboxylic treatment
  misc_feature: Down-regulated in shoot tissues in response to salicylic acid treatment
MDSRISVLCSLVLASSLLHCARSDGNDAQLLKGINSYRSSLKVPALTENTNAACLAEQLAKQFKGQQCTNTTGANTVIGTEQQFPDYPKYLDHCHLNASVTEDGQVMPACVPGLVPAVVLTNYTKSQYNRFLNDTQFSGVGIANEGDWVVVVLSTSTGSGDYSPAPPGSNWAASALPFTQLVLLLIGFVILLIK

SEQ ID NO: 20624 - DNA, 1719 bp, Sorghum bicolor
  misc_feature: Ceres ANNOT ID no. 8657023
  misc_feature: Up-regulated in root tissues in response to methyl jasmonate treatment
  misc_feature: Up-regulated in shoot tissues in response to methyl jasmonate treatment
  misc_feature: Encodes the peptide sequence at SEQ ID NO 20625
atggcctcctcctcctcctcctcctcctcctgcgacgccgcgggcgtgccgttcaccctcctgggcgcgctcatcaccgccggtcccgccgcctggccggcctgcgtcggcggcggtcgcgccttcctccgggactacgcgcggcgcgggaccaacgcgctgctgtgggcgggtctcctcgccgtcacctggatcctgctcctccgcgtcaccgcgctgcttcgcctctgggcgctcggctcccgcatcccggggccccgcgcgctcctcgccgaccccggactcgccgccgtcttgcgcgacggcggcgacatcaccggttttctgtcaaaattgcatgggagatatggcccagttgttcgcctgtgggtaggaccctctcagctacttgtatcagttatagatcctactctagttaaggaggtgctaacaaaggctgaagataagttaccattgactgggagaacatataatttagcttgtggaaaacttggcttatttgtgtccttattccaaaaggtcaaaaggacaagagattctctgaaaatgtttctgaatgaaaaaattacagttggtgctagtcaaagctcatttaaaattatcgatgctgtcctgaatagaatcaacactattatgtccaaggattttatggacactagatctttctcccagcacatggcatttaatatcattggtgcaacccttttgggtgatgccttcttcgaatggtctgacgcttctgcttatgaggaacttcttatgctggtcgcaaaggatggttgcttctgggcttcttatgcaattccaccgttctggagacctagttataggaggtatcggaccctatgtgctaagctgaagatattaacagagagcgttgtcagaaaatcaagacaaaatagttcacttaatcattttgatcagagatcttatctgaaaagtaaagggacagatccaaatagacgtgttttagacaacatgatggcaagtcattgtctccatggggctattggaggaccacttaattcagaagaggaaatatgtggaaacatcatgggtttgatgttgcatggtatttccgcttctgctaacttgattggtaacattttgacaaagcttgtcttgtccccagaattgcaagatcagctacatgtggagattgtttcagtctgtaatgaatcatctaaactggaggttgacgatctgctaaggatgcaagtcctacttgctactgtatgtgaatctgctcgccttttgcctgctggacctcttctgcagcgatgttctttgaaacatgatttgaagcttggctcgggtataactgtgccagctcaatcaatactagtagttcctttgcatctcgtgcaaatggatgcttctgtttggggtgatgatgctgaccagttcaatcctcatcggttccttaaaaaggatgtcgatcttagagaaatatttggagcacctaaaggatcaaataggataaatgttttcagtgagtgtgccaagaccgaatcatttcttccatttggttctgggagtcgagaatgtgttgggcagaagtttgtggttcttgcaatatcgatgttgattgccagcctgctccgcagctatgaggtacatcctcatccaagtttgtctaaagaaatggacacagcagttgacagcagccaccttcatatgccaaaccctaagatcatcctcaccaaaagaaggatctga

SEQ ID NO: 20625 - protein, 572 aa, Sorghum bicolor
  misc_feature: Ceres ANNOT ID no. 8657023
  misc_feature: Up-regulated in root tissues in response to methyl jasmonate treatment
  misc_feature: Up-regulated in shoot tissues in response to methyl jasmonate treatment
  misc_feature (83)..(480): SWISSPROT Homolog: EC 1.14.14.1 Unspecific monooxygenase
  misc_feature (483)..(537): SWISSPROT Homolog: EC 1.14.13.93 (+)-abscisic acid 8'-hydroxylase
  misc_feature (83)..(569): Pfam ID: p450 Pfam Description: Cytochrome P450
MASSSSSSSSCDAAGVPFTLLGALITAGPAAWPACVGGGRAFLRDYARRGTNALLWAGLLAVTWILLLRVTALLRLWALGSRIPGPRALLADPGLAAVLRDGGDITGFLSKLHGRYGPVVRLWVGPSQLLVSVIDPTLVKEVLTKAEDKLPLTGRTYNLACGKLGLFVSLFQKVKRTRDSLKMFLNEKITVGASQSSFKIIDAVLNRINTIMSKDFMDTRSFSQHMAFNIIGATLLGDAFFEWSDASAYEELLMLVAKDGCFWASYAIPPFWRPSYRRYRTLCAKLKILTESVVRKSRQNSSLNHFDQRSYLKSKGTDPNRRVLDNMMASHCLHGAIGGPLNSEEEICGNIMGLMLHGISASANLIGNILTKLVLSPELQDQLHVEIVSVCNESSKLEVDDLLRMQVLLATVCESARLLPAGPLLQRCSLKHDLKLGSGITVPAQSILVVPLHLVQMDASVWGDDADQFNPHRFLKKDVDLREIFGAPKGSNRINVFSECAKTESFLPFGSGSRECVGQKFVVLAISMLIASLLRSYEVHPHPSLSKEMDTAVDSSHLHMPNPKIILTKRRI

SEQ ID NO: 20626 - DNA, 3312 bp, Sorghum bicolor
  misc_feature: Ceres ANNOT ID no. 8657094
  misc_feature: Up-regulated in root tissues in response to salicylic acid treatment
  misc_feature: Up-regulated in shoot tissues in response to salicylic acid treatment
  misc_feature: Encodes the peptide sequence at SEQ ID NO 20627
atggcgtgcatcaagagcgcgcagcgggcggcgctgacggcgctggcgccggacgcgccgtacctcgccgcgggcaccatgaccggcgccgtcgacctgagcttctccaactctgccaacatcgagatcttccgcctcgacttccagtcggactccccggacctgccgctcctcgcctcggcgcccgccccggaccgcttcaaccgcctctcctggtcgcgcccgggcgccgtcgagggcgactccttcgccctcggactcctcgccggtggcctcagcgatggctccgtcgccgtgtggaacccgctgagcatgatcagctccgaggggaaagcggaggacgccatggtcgcgcgtctggagaagcacaccgggccggtttgtggactggagttcagtgagctcacgccgaatcggctcgcttctggggctgagcagggggagctttgcatctgggatctcaagaaccctattgagccaattgtgtacccaccactcaagagtgttgggtcccatgctcaagctgaaatctcttgtttatcctggaatcccaagtttcaacatatagttgcttcaacttcgagtaatgggatgacagttgtttgggatttaaggaatcagaaaccactgactagtttttcagattcaaatcgaaggaaatgctctgttctccaatggaatccagatatgtccacccagctgattgttgcatcagatgatgacaactctccctcactgagagtttgggatgtgaggaagaccatctcaccagtaagagaattcgttggccattcaaaaggtgtaattgctatgtcgtggtgcccctatgatagttcattcttgcttacatgttcaaaagacaatagaacaatttgctgggatactgttagtggagagattattagtgaactacctgcaagtgctaattggaactttgaccttcactggtaccggaaaataccaggtgtcattgcagcatcctcatttgatgggaaaattggcatatacaacctagagttctctggtctttatgctgctggtgatgctgttggtgccccagcacgtccaagggctccggctccaaaatggttgaaatgccccactggtgcatcttttggcttcggtggtaaacttgtttctttccatccggtggcacccacccaaggtgcacaagcatctacatctgaggtgcatgtgcacaatttggtgattgagcaaagtctggtgagccgatcaactgaatttgaagctgctattcagaatggcgacaaaagttcgcttcgtgctctatctgacgaggagagagaaacatggggcttcttaagggttatgtttgaggacggcgattttgcaaggacaaaattgcttactcatcttggcttcgaaccacctcaggaaccacctgcaagttcaactgatgaattgagccaaacattggcagatacacttaatctggatcatgccacagtaactgataatacggatgcccagtttcttattgataatggggatgattttttcaacaatcctcaaccttcagaggctagcttgcctgaagaaccagtttctacaaatggtcaacagatagagcaggaagtgtctggagatgttgtgccatcagatccatccattgacaaaagcattcaacatgcactggtggttggagactacaaaggggcagttaaccagtgtcttgctgctaatcgtatggctgatgctttggttatagcccatgccggtggttctgctctctgggaaagcacaagaaatcattatcttaagaacagtatctcgccctacttaaaggttgtctctgctatggtgggcaatgatttaatgagttttgtgagtacctggccactaagttcatggaaggaaactcttgctctgctttgcacatttgcacggaaagaggagtggcatattttgtgtgacacacttgcgtctagacttgtgaacgttggagatacactagcggcaactctctgttatatttgtgctggaaatattgacaaagctgttgaaatatggtcccgcaccttgaaatctgaagatggtgggaagacttatgttgatcttctccaggatttgatggaaaaaaccattactcttgcccttgctacgggccacaagagatttagcgcgtcactgtctaagcttgttgagaactatgctgaattgctggctagtcaagatgaacattcgcaagagctggcaattttgagagatcgaattgcatgttctacagaagaaaatgataatgctaggagttctgtttctgaaaacaccagcactccttccccctatgtcccaaatcaaccatatactaccccagaacatcctcagaatgtttaccaggtacctcaaccatacaatgtaccaagtacatattcagaagcttacccacaacctactggaccttatggatacaacaatgcatatcaacctccacaaccagccaatatgtttgttccacctagcacacctgccaactctcagcaacagccaggcccttcacctgtaccagtgcctcagcaaacagtgaagacatttactcctgcgaacccaactggtctaaaaaatcctggacaatatcatcaacctaataccttaggttcccagctttacacgggtgctgcaaatcaaccgtattcttctggaccatctgctccttatccaagcggacctccaacaacatttcatcagcctgtatcgcctgttcaatatcagcctgctgctccaccagtatcttcttttggtccgagcgcccctgtaccaggaacagtccctaaccagatgtttccccattctgctgctactaactcaacttctaggtttatgccatcgaacaatcaaagctttgctcccaggccaggtttaagtcctgcacagccctcaagtccgacgcaggtgcaggcacagcccactcctcctgcacctcccccgactgtgcagacagctgatacgacaaaagtgtctgctgagctgagacctgttattggtacactaaccagactatttgatgagacatccaaagctctgggaggatcacaagctactcaagcaaaaaagcgtgaaattgaggacaattcaaggaaaataggggcattgttttcaaaactaaatagtggcgacatatcttcaaatgtttcatctaaactcattcaattgtgcagtgcaattgatgctagtgattttgccactgcgatgcacctccaggtactcttaacaacaagtgactgggatgagtgcaacttctggcttgcggcattgaagcggatgatcaagacaaggcagaatttcagaatgtaa

SEQ ID NO: 20627 - protein, 1103 aa, Sorghum bicolor
  misc_feature: Ceres ANNOT ID no. 8657094
  misc_feature: Up-regulated in root tissues in response to salicylic acid treatment
  misc_feature: Up-regulated in shoot tissues in response to salicylic acid treatment
  misc_feature (114)..(294): SWISSPROT Homolog: EC 2.3.1.48 Histone acetyltransferase
  misc_feature (255)..(294): Pfam ID: WD40 Pfam Description: WD domain, G-beta repeat
MACIKSAQRAALTALAPDAPYLAAGTMTGAVDLSFSNSANIEIFRLDFQSDSPDLPLLASAPAPDRFNRLSWSRPGAVEGDSFALGLLAGGLSDGSVAVWNPLSMISSEGKAEDAMVARLEKHTGPVCGLEFSELTPNRLASGAEQGELCIWDLKNPIEPIVYPPLKSVGSHAQAEISCLSWNPKFQHIVASTSSNGMTVVWDLRNQKPLTSFSDSNRRKCSVLQWNPDMSTQLIVASDDDNSPSLRVWDVRKTISPVREFVGHSKGVIAMSWCPYDSSFLLTCSKDNRTICWDTVSGEIISELPASANWNFDLHWYRKIPGVIAASSFDGKIGIYNLEFSGLYAAGDAVGAPARPRAPAPKWLKCPTGASFGFGGKLVSFHPVAPTQGAQASTSEVHVHNLVIEQSLVSRSTEFEAAIQNGDKSSLRALSDEERETWGFLRVMFEDGDFARTKLLTHLGFEPPQEPPASSTDELSQTLADTLNLDHATVTDNTDAQFLIDNGDDFFNNPQPSEASLPEEPVSTNGQQIEQEVSGDVVPSDPSIDKSIQHALVVGDYKGAVNQCLAANRMADALVIAHAGGSALWESTRNHYLKNSISPYLKVVSAMVGNDLMSFVSTWPLSSWKETLALLCTFARKEEWHILCDTLASRLVNVGDTLAATLCYICAGNIDKAVEIWSRTLKSEDGGKTYVDLLQDLMEKTITLALATGHKRFSASLSKLVENYAELLASQDEHSQELAILRDRIACSTEENDNARSSVSENTSTPSPYVPNQPYTTPEHPQNVYQVPQPYNVPSTYSEAYPQPTGPYGYNNAYQPPQPANMFVPPSTPANSQQQPGPSPVPVPQQTVKTFTPANPTGLKNPGQYHQPNTLGSQLYTGAANQPYSSGPSAPYPSGPPTTFHQPVSPVQYQPAAPPVSSFGPSAPVPGTVPNQMFPHSAATNSTSRFMPSNNQSFAPRPGLSPAQPSSPTQVQAQPTPPAPPPTVQTADTTKVSAELRPVIGTLTRLFDETSKALGGSQATQAKKREIEDNSRKIGALFSKLNSGDISSNVSSKLIQLCSAIDASDFATAMHLQVLLTTSDWDECNFWLAALKRMIKTRQNFRM

SEQ ID NO: 20628 - DNA, 2814 bp, Sorghum bicolor
  misc_feature: Ceres ANNOT ID no. 8657145
  misc_feature: Down-regulated in shoot tissues in response to salicylic acid treatment
  misc_feature: Encodes the peptide sequence at SEQ ID NO 20629
atgactccagtgagtcattgctccgttggcagtatcagcctgtttcacattggaagcttcaggaccagccgagaaatccaagtaagaagattccagggcacagcaaggtattcaagagtagcatcaccatcgcctcggagactgctgcagccacaggcagcgttccacctgattagtatctacaagagaagaagctggtcctcggccgagaggccaacaaccttgtctgcggcgaccgtgggaactgatgtcacggtggaggatcaaaatccggaaacttcagatgagaactctgaggctgcacctgacgccgttgaagcgagtgagcaggccgaggctagcacgggacaagcttcttctcctcgcaagttgggacgcaacattcggaagagcgagatgcctccgctgaatgaggaggatctagttcctggcgcgtcttttactgggaaggtgatgtccatcaagccatttggagttttcgttgacattggagcatacacagaaggccttgttcatatctctagagtaagtgatgggtttgtaaaagatatatcttccctcttcactgttggacaagaggtgtcagtcaggttgcttgaagcaaataaggaaacaaagcgtatctctctgacgatgagggaaggtgatgactatgtcaagcctaaaaaggaaacacctaaagctgcaaacggtgggcgcagtgccaccgcaactccaaggcaaacaagggaaaggcaggaagccaaggagacggttgagtcaaagtatgtaccagggcagtctctgaatggcactgtgaaaagtacgacgagggcagggacatttgtgacattgcctgatggtagtgaaggattccttcccagagaagaggaagcattggcattgtttacccttattggacaatctgcaatggaagttggtaaacagataagggttaaagtactgaatgtagcacaaggtcaggccactttgacgatgaaaggggtggaagatgatgaagacgatctgaagacactaaacatggagcttaagcgggactggtctagagggaccaatgcattcgagttggctttccgtaggaacaaggagatctctgcattcttggatcagaggcaaaagacaaaagtgccggaagtacaagcagctgctgaggaaagtagtgaagaattgagctccttgtcagaagtagcaactgatgttcctgctcctgtatctgatgcctcttctcaggtggtaatcgaggattctacttctgtggcaactgctgctgagggccaaactgtagaatctgaaagctcacctgtaattagtgttgaactgtcctccaacgggatcccagatagcactagtgtgtctccagtttcagaaactgcggagaaacctgctgaacctgaagaatcttcagcagttgaagaggtccttgtaactgcaagtagcgaggtggagaaagaaccagctgctgctgctggagttgcacaaacaagcaccacgacagccactatttctcctgcccttgtcaagcaattgcgtgaggcaactggagcaggcatgatggactgcaaaaaggctcttgctgaaacggcgggtgacattgataaagctcaagagttcctacgaaagaaagggttggcggctgctgacaagagggctggcagagcaacagctgagggaagagttggctcctacatacatgacagcagaattggggtccttattgaagtgaattgtgagactgactttgtgtcccgaggcgacatcttcaaagagttagttgatgatcttgccatgcaagttgctgcctgccctcaagtacagtacatctctattgatgacgtccctgaggaggttgtgaagaaggagaccgagctggagatgcagagggaggaccttttgtcaaagcctgagcagatccgggctaagattgtcgaagggcgtgtaaagaagaggctcggagaatttgcattgtttgaacaaccattcatcaagaatgacaaggtcacaataagtgagtggctgaagcaaactatagctacaaccggagagaatatgaaggtcaagagatttgcccgatacaacctaggtgaagggttggagaagaaaagccaggattttgctgctgaagttgcagcccagacagcagcgaagccgccgccatctgctcctccgaaggatgacaagcctgctgaaacaacagaatccgccgagaagaagccggctgttgcagtttcagcttcattggtaaagcaactccgagacgaaaccggtgctggtatgatggactgcaagaaagctctggctgagtctgatggtgatcttcagaaggctcaggagttcctcaggaagaagggcctctcatctgcagacaagaaatcttctcggctagctgctgaaggactgattggctcctacatccacgacaaccgcatcggatgcatgatcgaggtcaactccgagaccgactttgtggctcgcaatgagaagttcaaggagcttgtgaacgatcttgcaatgcaagtggtggcatgcccacaggtcgactatgtctcggtggacgacatcccagagagcatcatcagcaaagagaaagagatcgagatgcagagggacgacctgcagtcgaaacccgagaacatcagggagaagatcgttgaagggcggatatcaaagaggctcggagtgatggccctcctggagcaaccctatatcaaggatgacagtaagaccgtgaaggatctcgtgaaggagatgatcgcctcgctcggggagaacatcaaggtgcggaggtttgttcgatacaccctgggtgagaactga

SEQ ID NO: 20629 - protein, 937 aa, Sorghum bicolor
  misc_feature: Ceres ANNOT ID no. 8657145
  misc_feature: Down-regulated in shoot tissues in response to salicylic acid treatment
  misc_feature (554)..(695): Pfam ID: EF_TS Pfam Description: Elongation factor TS
  misc_feature (795)..(936): Pfam ID: EF_TS Pfam Description: Elongation factor TS
  misc_feature (501)..(538): Pfam ID: UBA Pfam Description: UBA/TS-N domain
  misc_feature (742)..(779): Pfam ID: UBA Pfam Description: UBA/TS-N domain
  misc_feature (140)..(213): Pfam ID: S1 Pfam Description: S1 RNA binding domain
MTPVSHCSVGSISLFHIGSFRTSREIQVRRFQGTARYSRVASPSPRRLLQPQAAFHLISIYKRRSWSSAERPTTLSAATVGTDVTVEDQNPETSDENSEAAPDAVEASEQAEASTGQASSPRKLGRNIRKSEMPPLNEEDLVPGASFTGKVMSIKPFGVFVDIGAYTEGLVHISRVSDGFVKDISSLFTVGQEVSVRLLEANKETKRISLTMREGDDYVKPKKETPKAANGGRSATATPRQTRERQEAKETVESKYVPGQSLNGTVKSTTRAGTFVTLPDGSEGFLPREEEALALFTLIGQSAMEVGKQIRVKVLNVAQGQATLTMKGVEDDEDDLKTLNMELKRDWSRGTNAFELAFRRNKEISAFLDQRQKTKVPEVQAAAEESSEELSSLSEVATDVPAPVSDASSQVVIEDSTSVATAAEGQTVESESSPVISVELSSNGIPDSTSVSPVSETAEKPAEPEESSAVEEVLVTASSEVEKEPAAAAGVAQTSTTTATISPALVKQLREATGAGMMDCKKALAETAGDIDKAQEFLRKKGLAAADKRAGRATAEGRVGSYIHDSRIGVLIEVNCETDFVSRGDIFKELVDDLAMQVAACPQVQYISIDDVPEEVVKKETELEMQREDLLSKPEQIRAKIVEGRVKKRLGEFALFEQPFIKNDKVTISEWLKQTIATTGENMKVKRFARYNLGEGLEKKSQDFAAEVAAQTAAKPPPSAPPKDDKPAETTESAEKKPAVAVSASLVKQLRDETGAGMMDCKKALAESDGDLQKAQEFLRKKGLSSADKKSSRLAAEGLIGSYIHDNRIGCMIEVNSETDFVARNEKFKELVNDLAMQVVACPQVDYVSVDDIPESIISKEKEIEMQRDDLQSKPENIREKIVEGRISKRLGVMALLEQPYIKDDSKTVKDLVKEMIASLGENIKVRRFVRYTLGEN

SEQ ID NO: 20630 - DNA, 1854 bp, Sorghum bicolor
  misc_feature: Ceres ANNOT ID no. 8657190
  misc_feature: Down-regulated in shoot tissues in response to aminocyclopropane carboxylic treatment
  misc_feature: Up-regulated in root tissues in response to salicylic acid treatment
  misc_feature: Encodes the peptide sequence at SEQ ID NO 20631
atgagccgaggccgccggggcatcttcgatggcctccccatcccggccgacaaatccgtaagtaccctctcgcttccccaccgtcgttcctcgcgtctcggaactgtgatcgtcggaaatgctaattctcgtcgtctcgggccgggggctcagtacctcaaggaaggcctgttgcggatcgacgagagctgggcggccgcgcggttcgactcgctgccgcacgtcgtgcacatcctcacatccaaggaccgcgagggcgagatccagttcctcaaggagcagagcgatctcatcgaggatgtcgtcgacgaggtcgtccacgcctaccaccatggtttcaacaaggccatccagaattactcccagatcctgcggttgttcagtgagtctgcagacagcattaccggactcaagggggagatggaggaggccaaaaagctgcttggcaggaagaataagcaccttggccagctgtggtaccgctccctcacactgcgtcatgtgctctcccttttggatcaggtcgaggatgttgccaaggttcctgctcgaattgagaacttaatggcagagaagcagctgtatgctgcagtgcaattgcacgtccaatcagtgctgatactggaacgagaaggccttcaagcggtaggtgctcttcaagatgttcgttctgatctaacaaagctgcgaggagtactattttacaaaattttggaagagttgcatggccatttgtacaacaatggtgaatatagctcttcatttgatggcccagatgataatagcttagacatgagtgaaagtgatggacacactcggaaggattcgaaaagtttttctcgtgaaatcccaatttttctttcctgtgctacaccagatgagtttcttgaatcaatgataaaggcagatgccccccttaatgtgaagtacctgagaacattggtacaatgcttatccatgcttggaaaggttgcagctgcaggagctgtgatatgccaacgagtacgccctacaatccatgatgttatcacttcaaagattaaagcatattctgaagaggcttcaaaatccagtatagacaaagctgcaaaaatgtatgatgtgttgcattcaaatggacccattccccagttccaaatgctcaaacagaaaacaaagagtggcgcatctgtaatggcagcacaactagttgtcagtcccatttcgccagctatggcacccacaggagatgctcagcgtgcagctactcaacttcttaaatcaatatttgaatgtcttgtggagatacttgagaaccatattattgttggagagcttcttgaacaaaaatcgacagaggttgataacgtaaacacacctcatattgcaaatggggatgcaagctggaatccagactccgaatcttcccaagctactgggggtttcagtgttgcattctctctatcagtcgtgcagagtgaatgccagcaacttctgtgtgaaattttgcgggcaactccagaagctgctactgctgatgcagctgtccagacagctaggcttgcaaataaggatccagtgaaggaaaagaggcaagactatttgtatccacaatgcttgactctagcatgtggcacaggccatcttgttgcagcaaccccagtgccaaatgaaggtcaaggatggcgaagaaattccaatgtgcctcaagaagggtatggaacagcaagtgtcatacctgaccaaggaattttcctagctgcgtctgtttaccgtcctgtctttgagtttatgaataaaatagggttgatgttgcctcagaagtactcgcaacttgggtattgtgtcagatctcctaactttaatttacattga

SEQ ID NO: 20631 - protein, 617 aa, Sorghum bicolor
  misc_feature: Ceres ANNOT ID no. 8657190
  misc_feature: Down-regulated in shoot tissues in response to aminocyclopropane carboxylic treatment
  misc_feature: Up-regulated in root tissues in response to salicylic acid treatment
  misc_feature (46)..(188): Pfam ID: Sec8_exocyst Pfam Description: Sec8 exocyst complex component specific domain
MSRGRRGIFDGLPIPADKSVSTLSLPHRRSSRLGTVIVGNANSRRLGPGAQYLKEGLLRIDESWAAARFDSLPHVVHILTSKDREGEIQFLKEQSDLIEDVVDEVVHAYHHGFNKAIQNYSQILRLFSESADSITGLKGEMEEAKKLLGRKNKHLGQLWYRSLTLRHVLSLLDQVEDVAKVPARIENLMAEKQLYAAVQLHVQSVLILEREGLQAVGALQDVRSDLTKLRGVLFYKILEELHGHLYNNGEYSSSFDGPDDNSLDMSESDGHTRKDSKSFSREIPIFLSCATPDEFLESMIKADAPLNVKYLRTLVQCLSMLGKVAAAGAVICQRVRPTIHDVITSKIKAYSEEASKSSIDKAAKMYDVLHSNGPIPQFQMLKQKTKSGASVMAAQLVVSPISPAMAPTGDAQRAATQLLKSIFECLVEILENHIIVGELLEQKSTEVDNVNTPHIANGDASWNPDSESSQATGGFSVAFSLSVVQSECQQLLCEILRATPEAATADAAVQTARLANKDPVKEKRQDYLYPQCLTLACGTGHLVAATPVPNEGQGWRRNSNVPQEGYGTASVIPDQGIFLAASVYRPVFEFMNKIGLMLPQKYSQLGYCVRSPNFNLH

SEQ ID NO: 20632 - DNA, 1350 bp, Sorghum bicolor
  misc_feature: Ceres ANNOT ID no. 8657317
  misc_feature: Up-regulated in shoot tissues in response to salicylic acid treatment
  misc_feature: Encodes the peptide sequence at SEQ ID NO 20633
atggtggaacataaaggaaatgttctcatgcacaagtatgagatggggaaattgcttggtcaagggacctttgccaaggtttaccatgctcgcaacactaagacttctgaaagtgtcgcgatcaaggtgattgacaaggacaaggttatgaaagttgggctcattgatcaaatcaagagagaaatttctgttatgaagcttgtaagacatcccaatattgtgcaactctatgaggtcatggctaccaaaaccaaaatatactttgtgttggagcatgttaaaggtggagagctctttaataaagtgcagcgaggaaggctcaaggaagatgcagcgaggaagtactttcaacagctgatttgcgcagtggacttctgtcacagcaggggtgtttatcatcgagatttgaaaccagaaaatcttttgctcgatgagaatagcaacctaaaggtgtcggattttggtctaagtgcacttgctgaatgccaaagacaagatggcctgctccatacaacctgtggcacgcctgcttatgttgctccagaggtgattaacagaaaggggtatgatggtgcaaaggccgacatatggtcctgtggggtcatcctttttgtgctattggccggttatcttccattccatgacaagaacttaatggacatgtataagaagattgggaaagcagagttcaaatgcccgtgttggttttctaccgatgcccggaggcttttgctaaggattcttgatcctaaccccagcacaaggatctcaatggaaaaaatcatggaaaatccatggtttaggaagggcttagatgcaaagctgcttaggtataatttacagtctaagaatgcccctcaggtagacaagaatgcagattctgattcactaagcatcaacataacagcagagagcaagcaacaagaagaaaagaagcctaccaacatgaatgcatttgatataatatctctatcaactggtttggacctctcaggtttatttgaagaatctgacaacaagagagaatacaaattcacatccaccaacacaagctcaacaatcgtatcaaagatcgaagatgttgcgaagaatttgcgattgaagttgacaaaaaaggatggtggtttgttaaagatggaagcttcaaagcctggaaggaaaggggtgatgggtatcgatgctgagatatttgaggttagcccaaactttcatcttgtggagataaagaagacgaatggcgacactctagagtatcaaaaggtcttgaaccgagaaatgaggcctgcactaaaggacatagtatgggcttggcaaggtgagcaatcaaagcagcaacaaactatgatctag

SEQ ID NO: 20633 - protein, 449 aa, Sorghum bicolor
  misc_feature: Ceres ANNOT ID no. 8657317
  misc_feature: Up-regulated in shoot tissues in response to salicylic acid treatment
  misc_feature (2)..(437): SWISSPROT Homolog: EC 2.7.11.1 Non-specific serine/threonine protein kinase
  misc_feature (13)..(267): Pfam ID: Pkinase Pfam Description: Protein kinase domain
  misc_feature (312)..(371): Pfam ID: NAF Pfam Description: NAF domain
MVEHKGNVLMHKYEMGKLLGQGTFAKVYHARNTKTSESVAIKVIDKDKVMKVGLIDQIKREISVMKLVRHPNIVQLYEVMATKTKIYFVLEHVKGGELFNKVQRGRLKEDAARKYFQQLICAVDFCHSRGVYHRDLKPENLLLDENSNLKVSDFGLSALAECQRQDGLLHTTCGTPAYVAPEVINRKGYDGAKADIWSCGVILFVLLAGYLPFHDKNLMDMYKKIGKAEFKCPCWFSTDARRLLLRILDPNPSTRISMEKIMENPWFRKGLDAKLLRYNLQSKNAPQVDKNADSDSLSINITAESKQQEEKKPTNMNAFDIISLSTGLDLSGLFEESDNKREYKFTSTNTSSTIVSKIEDVAKNLRLKLTKKDGGLLKMEASKPGRKGVMGIDAEIFEVSPNFHLVEIKKTNGDTLEYQKVLNREMRPALKDIVWAWQGEQSKQQQTMI

SEQ ID NO: 20634 - DNA, 1296 bp, Sorghum bicolor
  misc_feature: Ceres ANNOT ID no. 8657323
  misc_feature: Down-regulated in shoot tissues in response to methyl jasmonate treatment
  misc_feature: Down-regulated in root tissues in response to methyl jasmonate treatment
  misc_feature: Down-regulated in shoot tissues in response to salicylic acid treatment
  misc_feature: Encodes the peptide sequence at SEQ ID NO 20635
atggaggcgccggctcgcctccccatctccctcctcgtcgtctccgccctcctcctcctcctctcggctcagggaccggcgggagcggcggcggcggccgtgccgccgcgaatccagccgctcgctaccgccgcgctgcgccgcctctacgacacctccaactacggcaggctgcagctcaacaacggcctcgcgctcactccgcagatggggtggaacagctggaatttcttcgcttgcaacatcaatgagacggtcatccgcgagacagctgacgcgctggtgtccacgggactggctgctctgggctacaacttcgtaaatattgatgattgctggtcatacgtgaaacgaggaaagcaggaccaattgctgcctgatccgaagactttcccttcaggcatcaaagcccttgcagattatgtgcatggaaaaggtctgaaacttggtatatactctgatgctgggaaatttacttgccaagttcgacctggatcactcgatcatgaaagtgacgatgctgcgatctttgcttcatggggtgttgattacctgaagtatgacaactgctacaatttgggaataaagccacagaaaagatatcctcctatgcgagatgctcttaactcaactgggcgccaaatcttctactctttgtgtgaatggggccaggatgatccagccttatgggctggcaaagtgggcaatagttggcgtacaactgatgacataacggatacatggcaaagcatgacagacattgctgataagaacaacaagtgggcgtcatatgctggacctggtggttggaatgacccagatatgttggaagtaggcaatggtggcatgacctcagcagagtatcgctcacattttagcatctgggctctcatgaaggcccctttattaattggctgtgatgtcagaaacatgacttctgaaacaatggaaatattgagcaacaaagaagtaattcaagtaaaccaagatcctcttggagttcaaggaagaaaaattttaggagaaggaaaatatggatgccgtgaggtgtgggctggtcccctgtctggaaatcggcttgttattgctctatggaaccgttgttctgagactgctaatattacaatgaaactgccagcggtaggccttgatggatcagctgcctattctgttagggatctgtggaagcatgaaacgctatcagaaaatgtggtaggaacttttggcgctcaagttgacgtgcatgacaccaagatgtacatcttttctcctgcaaccagtgtcgcttcaatttga

SEQ ID NO: 20635 - protein, 431 aa, Sorghum bicolor
  misc_feature: Ceres ANNOT ID no. 8657323
  misc_feature: Down-regulated in shoot tissues in response to methyl jasmonate treatment
  misc_feature: Down-regulated in root tissues in response to methyl jasmonate treatment
  misc_feature: Down-regulated in shoot tissues in response to salicylic acid treatment
  misc_feature (52)..(424): SWISSPROT Homolog: EC 3.2.1.22 Alpha-galactosidase
  misc_feature (40)..(368): Pfam ID: Melibiase Pfam Description: Melibiase
MEAPARLPISLLVVSALLLLLSAQGPAGAAAAAVPPRIQPLATAALRRLYDTSNYGRLQLNNGLALTPQMGWNSWNFFACNINETVIRETADALVSTGLAALGYNFVNIDDCWSYVKRGKQDQLLPDPKTFPSGIKALADYVHGKGLKLGIYSDAGKFTCQVRPGSLDHESDDAAIFASWGVDYLKYDNCYNLGIKPQKRYPPMRDALNSTGRQIFYSLCEWGQDDPALWAGKVGNSWRTTDDITDTWQSMTDIADKNNKWASYAGPGGWNDPDMLEVGNGGMTSAEYRSHFSIWALMKAPLLIGCDVRNMTSETMEILSNKEVIQVNQDPLGVQGRKILGEGKYGCREVWAGPLSGNRLVIALWNRCSETANITMKLPAVGLDGSAAYSVRDLWKHETLSENVVGTFGAQVDVHDTKMYIFSPATSVASI

SEQ ID NO: 20636 - DNA, 1104 bp, Sorghum bicolor
  misc_feature: Ceres ANNOT ID no. 8657377
  misc_feature: Up-regulated in root tissues in response to methyl jasmonate treatment
  misc_feature: Up-regulated in shoot tissues in response to methyl jasmonate treatment
  misc_feature: Encodes the peptide sequence at SEQ ID NO 20637
atgacgctaccagatgatttgctcatcagcatctttctcttcctccctccacacccctcctacctccttcgttcttcccttgtatgcaagcattggcactccctcatcgtcgacaatcggttcctccatcgctttcaggcactccatggattacctttacttggtgtcttcaccaactccactcgcatccctcgatttctccctgctggggatcctcctaaccgtgttgctgcagcatctttctctctacctgatctttactggaatgtccttggctgccgccatggccatgtcctccttgttgattcaacatggcatcaggtctttgtgtggaaccctataaatggccgcaagcgcttaatacaagccccatctgatttggatcctcgttttaattatgggaatgtgcctgaaagcaatgctgctgtggtttgcgcagcaaaccatgctgaccatggttactgccactcttgtccgttttttgtagtatgggttttcaccagcacccgctatgcttatgccactagatactcatcagagagtggcaggtgggacatgatgaaatcttcaccaataccatctgatgttgatttcaggcctagcatccttgtcaggaatatcttgtattggccgttgaagtcaaagcatatccttgcatttgagttggtcacacataggttatatcatattgagtgtccaccagagacacatgatatatacaggaggaatgtccacatcatgaaaacagaggatggtggtctaggtcttgctgctctggcaaaatttaacctgcgcctgtgggcatgggaaactgatgctgagggtgttacaggatgggtactgcgccggatcattgagttggatagattcctgccattggatgtatcgtctctgccctcaccagaaaatggttcatgtggaaggcctcctgtcaggatgttgggtcttgttgaggatgatgatttggttttcttatggacaataactggggtctttgcggttcatctcaagtcaatgaagttcaaaaaagtgtttgaggctgatgtctccaaaactgtttatccctacaaaggttttcacattgcaggtgcttacatcatatga

SEQ ID NO: 20637 - protein, 367 aa, Sorghum bicolor
  misc_feature: Ceres ANNOT ID no. 8657377
  misc_feature: Up-regulated in root tissues in response to methyl jasmonate treatment
  misc_feature: Up-regulated in shoot tissues in response to methyl jasmonate treatment
  misc_feature (1)..(47): Pfam ID: F-box Pfam Description: F-box domain
MTLPDDLLISIFLFLPPHPSYLLRSSLVCKHWHSLIVDNRFLHRFQALHGLPLLGVFTNSTRIPRFLPAGDPPNRVAAASFSLPDLYWNVLGCRHGHVLLVDSTWHQVFVWNPINGRKRLIQAPSDLDPRFNYGNVPESNAAVVCAANHADHGYCHSCPFFVVWVFTSTRYAYATRYSSESGRWDMMKSSPIPSDVDFRPSILVRNILYWPLKSKHILAFELVTHRLYHIECPPETHDIYRRNVHIMKTEDGGLGLAALAKFNLRLWAWETDAEGVTGWVLRRIIELDRFLPLDVSSLPSPENGSCGRPPVRMLGLVEDDDLVFLWTITGVFAVHLKSMKFKKVFEADVSKTVYPYKGFHIAGAYII

SEQ ID NO: 20638 - DNA, 1059 bp, Sorghum bicolor
  misc_feature: Ceres ANNOT ID no. 8657436
  misc_feature: Up-regulated in shoot tissues in response to salicylic acid treatment
  misc_feature: Up-regulated in root tissues in response to salicylic acid treatment
  misc_feature: Encodes the peptide sequence at SEQ ID NO 20639
atgggcaagcagcagcagcagcagggagaggcggaggggaagatcgtcctccaggaggagacggcgccggtgccgccgccggaggaggacaaggaggccgaggcggcgctggtgcacaagatctccagccttgccgccgccatcgggaagcttccgtccctgagcccgtcgccggaggtgaacgctctcttcaccgagctggtgacggcgtgcatcccgcgcagcaccgtcgacgtggagcgcctgggcccggagctgcaggagatgcgcggccgcctgatccgcctctgcgccgacgccgagggcctcatggaggcgcactactccgacctgctcgccgcgttcgacaacccgctggaccacctgtcgctcttcccctacttcaacaactacatcctgctcagccagctggagcacggcctgctggcgcgccacgtcccggcgccgccgccgtcccgcgtcgccttcgtcggctccggcccgctcccgctcagctccctcgtcctggcggcgcgccacctcccggccgcctccttcgacaactacgacatcagcggggacgccaacgaccgggcgcgtcgcctggtgcgcggcgacgccgcgctccaggcgcgcatggcgttccgcacctccgacgtggccaacgtcaaccgggagctcgcctcgtacgacgtcgtcttcctcgcggcgctcgtgggcatggccgccgaggacaaggcccgcgtcgttgagcacctcgggaggcacatggcccccggcgctgcgctcgtggtgcggagcgcgcacggggcgcgcggcttcctctaccctgtggtcgaccccgaggagatccggcgcggcggctttgacgtgctcgccgtgcaccacccggagggggaggtcatcaactccgtcatcatcgcgcgcaagcctgtcgccgtcgacggggtgggagtcgccgaactgggacacgcgcacgcgcacggcgccgtgctcagccgcccctgcctctgctgcgagatggaagcccgggcgcaccagaagatggaggaggtggccatggagcagctgccgtcctag

SEQ ID NO: 20639 - protein, 352 aa, Sorghum bicolor
  misc_feature: Ceres ANNOT ID no. 8657436
  misc_feature: Up-regulated in shoot tissues in response to salicylic acid treatment
  misc_feature: Up-regulated in root tissues in response to salicylic acid treatment
  misc_feature (37)..(352): SWISSPROT Homolog: EC 2.5.1.43 Nicotianamine synthase
  misc_feature (29)..(308): Pfam ID: NAS Pfam Description: Nicotianamine synthase protein
MGKQQQQQGEAEGKIVLQEETAPVPPPEEDKEAEAALVHKISSLAAAIGKLPSLSPSPEVNALFTELVTACIPRSTVDVERLGPELQEMRGRLIRLCADAEGLMEAHYSDLLAAFDNPLDHLSLFPYFNNYILLSQLEHGLLARHVPAPPPSRVAFVGSGPLPLSSLVLAARHLPAASFDNYDISGDANDRARRLVRGDAALQARMAFRTSDVANVNRELASYDVVFLAALVGMAAEDKARVVEHLGRHMAPGAALVVRSAHGARGFLYPVVDPEEIRRGGFDVLAVHHPEGEVINSVIIARKPVAVDGVGVAELGHAHAHGAVLSRPCLCCEMEARAHQKMEEVAMEQLPS

SEQ ID NO: 20640 - DNA, 1059 bp, Sorghum bicolor; identical to SEQ ID NO: 20638
  misc_feature: Ceres ANNOT ID no. 8657437
  misc_feature: Up-regulated in shoot tissues in response to salicylic acid treatment
  misc_feature: Up-regulated in root tissues in response to salicylic acid treatment
  misc_feature: Encodes the peptide sequence at SEQ ID NO 20641

SEQ ID NO: 20641 - protein, 352 aa, Sorghum bicolor; identical to SEQ ID NO: 20639
  misc_feature: Ceres ANNOT ID no. 8657437
  misc_feature: Up-regulated in shoot tissues in response to salicylic acid treatment
  misc_feature: Up-regulated in root tissues in response to salicylic acid treatment
  misc_feature (37)..(352): SWISSPROT Homolog: EC 2.5.1.43 Nicotianamine synthase
  misc_feature (29)..(308): Pfam ID: NAS Pfam Description: Nicotianamine synthase protein

SEQ ID NO: 20642 - DNA, 696 bp, Sorghum bicolor
  misc_feature: Ceres ANNOT ID no. 8657510
  misc_feature: Down-regulated in shoot tissues in response to aminocyclopropane carboxylic treatment
  misc_feature: Down-regulated in shoot tissues in response to salicylic acid treatment
  misc_feature: Encodes the peptide sequence at SEQ ID NO 20643
atggggggctcggcgtccggacacgctgctggtgctggacgtctgggcgctagcggtaacaatctatctatctacactaccttttggttgttctcggttgtatataatccgccgccagcttccacgcctccgccctcccaaacccttcgcgccgccgccgctccccagcacaccgctcccaacgcgccacacctgcacttgctccccgtcaaggagcaccagatcgtggagcagctcgtcccggggctcaaggatgaggtgatgaagatcacgcccgtgcagcgcacccggttcaaggcgttcgtcgtcgtcggcgaggcgatggacacgtcgggctcggcgtcaagtgcgccaaggaggtcgctacggccatccgtggcgccatcatcctcgccaagctctcggtcgtgcctctcagggtgcccgtcaggagggggtactgggggaacaaatcggacagccccacaccgtgccctgcaaggtcaccgtcaagtgcggctccgtcaccgtgcgcatggtgccggtgcccagggggggtctgggatcgtcgccgcctatgtcccgaagaaggtcctccagttcgctggaattgaggacgtcttcacctcgtcccgtcgcttcaccaagacactgggtaacttcgtcaaggtataccagcttagatctttgcctaatcctgtattgcttgctcattga

SEQ ID NO: 20643 - protein, 231 aa, Sorghum bicolor
  misc_feature: Ceres ANNOT ID no. 8657510
  misc_feature: Down-regulated in shoot tissues in response to aminocyclopropane carboxylic treatment
  misc_feature: Down-regulated in shoot tissues in response to salicylic acid treatment
  misc_feature (167)..(230): Pfam ID: Ribosomal_S5_C Pfam Description: Ribosomal protein S5, C-terminal domain
MGGSASGHAAGAGRLGASGNNLSIYTTFWLFSVVYNPPPASTPPPSQTLRAAAAPQHTAPNAPHLHLLPVKEHQIVEQLVPGLKDEVMKITPVQRTRFKAFVVVGEAMDTSGSASSAPRRSLRPSVAPSSSPSSRSCLSGCPSGGGTGGTNRTAPHRALQGHRQVRLRHRAHGAGAQGGSGIVAAYVPKKVLQFAGIEDVFTSSRRFTKTLGNFVKVYQLRSLPNPVLLAH

SEQ ID NO: 20644 - DNA, 1857 bp, Sorghum bicolor
  misc_feature: Ceres ANNOT ID no. 8657598
  misc_feature: Down-regulated in root tissues in response to aminocyclopropane carboxylic treatment
  misc_feature: Encodes the peptide sequence at SEQ ID NO 20645
atggagcttgaggacgatggtgccatgggagggagaggaactggtggtatgtggacagaggaggaccgagctcttggcgctgcggtgcttggagcagatgcctttgcatatttaacgaaaggaggtggtgccatatccgagggccttgtcgctgcgtctttgccggatgacttgcagaacaaactccaggagcttgtcgaatccgagagccctggcactggttggaactatgccatcttctggcagctctcgcgcacaaagtctggtgatctcgtccttggatggggggatggcagctgccgtgagccccgagatggagaggtgggagctgctgcttctgcaggcagcgatgataccaagcagaggatgcgcaaacgtgtgctgcagcggttgcacattgcatttggggttgctgatgaggaggattatgcccctggtattgatcaggtcacagatacagagatgttctttctggcatctatgtactttgcttttccccgtcgcactggtggccctggccaagcatttgcagcaggcatccccctctgggttcccaatagtgagcgcaaggtattcccggccaactactgttaccgggggttccttgcaaatgcggcaggatttaggactatcgttttggtgccatttgagagcggtgtgcttgaactgggctcaatgcagcacatagctgagagttctgatactatccagtccatacgctctgtatttgcagggacaagtggtaataagactgcagtacagagacacgagggaaatggtcctgctcctcctgaaaggtcgcccagtttggcgaagatttttgggaaggatttgaaccttggccggccttcagttgggccggcggttggtgtatctaaggtagatgaaaggacatgggagcagaggagtgctgctggtgggacctcattgctaccgaatgtacagaaaggattgcagaatttcacctggagtcaggctcgtgggttgaattctcatcagcagaagtttggcaatggcgtgttgattgtgagcaacgaggctgcacaccgcaacaacggagcagtggacagccctagcgcagcacagtttcagcttcaaaaggcgcctcagcttcagaaactgcagcttcagaaattgccggttgttcagaaaacaccgcagctagtgaaccagcagccgatgcagccacaggtacctaggcaaattgactttagcgcggggagcagttccaagcctggtgtgttggttacaagggcagcagcagtcctggatggggagagtgcagaggtggatggcttgtgcaaagaggaagggccaccacctgttatagaggaccgacggccaaggaagaggggaagaaaacctgcaaacgggagggaagaaccacttaatcatgtcgaggctgagcgccagaggagggagaagctcaaccagcggttctatgcacttagagctgttgtgccgaacatatcgaaaatggacaaggcgtccctactgggcgatgcgataacgtacatcactgacctccagaagaagctcaaagagatggagtcagagagagaaaggctcttggagtccggtatggtggacccaagggagcgggcgcctaggccggaggtggacatccaggtggtgcaggacgaggttcttgttcgagtgatgtctccaatggataaccatccagtcaggaaggtattccaagcctttgaagaggcagaagtccgcgtaggcgagtcaaaggtgacgggcaacaacaacgggacagtggtgcattctttcatcatcaagtgtcctggcgctgagcagcaaacgagggagaaggtgatagcggcaatgtctcgcgcgatgagcagttga

SEQ ID NO: 20645 - protein, 618 aa, Sorghum bicolor
  misc_feature: Ceres ANNOT ID no. 8657598
  misc_feature: Down-regulated in root tissues in response to aminocyclopropane carboxylic treatment
  misc_feature (461)..(510): Pfam ID: HLH Pfam Description: Helix-loop-helix DNA-binding domain
MELEDDGAMGGRGTGGMWTEEDRALGAAVLGADAFAYLTKGGGAISEGLVAASLPDDLQNKLQELVESESPGTGWNYAIFWQLSRTKSGDLVLGWGDGSCREPRDGEVGAAASAGSDDTKQRMRKRVLQRLHIAFGVADEEDYAPGIDQVTDTEMFFLASMYFAFPRRTGGPGQAFAAGIPLWVPNSERKVFPANYCYRGFLANAAGFRTIVLVPFESGVLELGSMQHIAESSDTIQSIRSVFAGTSGNKTAVQRHEGNGPAPPERSPSLAKIFGKDLNLGRPSVGPAVGVSKVDERTWEQRSAAGGTSLLPNVQKGLQNFTWSQARGLNSHQQKFGNGVLIVSNEAAHRNNGAVDSPSAAQFQLQKAPQLQKLQLQKLPVVQKTPQLVNQQPMQPQVPRQIDFSAGSSSKPGVLVTRAAAVLDGESAEVDGLCKEEGPPPVIEDRRPRKRGRKPANGREEPLNHVEAERQRREKLNQRFYALRAVVPNISKMDKASLLGDAITYITDLQKKLKEMESERERLLESGMVDPRERAPRPEVDIQVVQDEVLVRVMSPMDNHPVRKVFQAFEEAEVRVGESKVTGNNNGTVVHSFIIKCPGAEQQTREKVIAAMSRAMSS

SEQ ID NO: 20646 - DNA, 2289 bp, Sorghum bicolor
  misc_feature: Ceres ANNOT ID no. 8657618
  misc_feature: Up-regulated in shoot tissues in response to salicylic acid treatment
  misc_feature: Encodes the peptide sequence at SEQ ID NO 20647
atggatcagagccggcgggcggtggagtcgtactggcgctcgcggatggtggacggcgtcaccgcggacgacgacaaggtcgcgcccgtctacaagctcgaggagatctgcgagctcctgcgcgcctccgacgccagcatcgtcaaggaggtcgccgacttcgtcctcaagcgcctcgacaacaagagccccctcgtcaagcagaaggctttacggttgatcaaatacgcagttggaaaatccggtactgatttcaagagggagatgcaaaggcactcagtggctatgcgccagctagttcattacaaaggccaccctgatcccttaagaggggatgcccttaacaaggctgttcgcgaaactgcaaatgaggctatagctgcaattttctccacagaggaccctaaacctgctgtcgcaaccgaaagtcttggcaagcgcatacagggctttggaaatactaattacgagccatctagagatgacaagaagtctttccttagtgaactaaccgaggtagtgggtattggaagtgcatccatcaagcagggtttgagcaactttgctgcagcgcatgcaatgatgacaaatgacaatggtagcacgtacaagagccctaatctccgtagatctttgaccacagaatctgaaagatatggtcggtatgatccaagtgaaattcaaagtgagagccgtgcctcatctggtgcttcaaagaatgcagcctctggttcttggggtccaacttccagttctgtaccaactgatgatactagctcaagtcaaccagggattaaaactcgtgaagaaagacttctggagacaatagttactgcaagtggcgtgagactgcaaccaacgcgagatgctttgcaaatttttttaacagaagcttccaaattggatgcagttgccttgagccgtgcacttgagaacaagctgaattctccattatggcaggttcgcatgaaggctatttgtgtgttggaagccattgtaaggaaacaggattctgatccttattctatcatcacttcatatttcattgagaacacagcttctgttattaaatgctccgagctgccacaggtttctctcagagagaaggcctcaaaggtcttgaatatgctgattggggaacagcctactggaaccacaacaacaaaagctgctgtgtccatacctgttcagatgcctgatttgattgatacaggtgatcaagatgatctagcaacaagttccggacaggaaagcaatgaacagaatactgggaacagtgcatatgtttcttcagttgatgatttgcttggtggtgaacctattgctgatacaagtgttgctgctgatagtaatggaagcgatccatttgcagatgtatcattccatgaggcagagactaaggagactaatgatctgttctcagggttgacagtagaagagaaatcatcagctactgtgcatgatagttcttcatcaaacaaaaatgaattaccagacatctttggcagcgcccctgattctttcatccatggtagtgttactgaccaaggaactgtcaatgatttgatggctggtttgaaccttaatggaacaggccaggctcagtctgcagttaaagcagagcccagtagcaacttcagtggttcacagttctttgatacaaacaacgagaccagccatgtggcaagtgctgcagcattgaatggcattcttggtcaaaattcattttaccaacagcagcagactcccttgcagtacaacttccctcaacatatgatgatcaatcaatcatttcctgggcaacaattaaactatggtgccatggggattcttcttgctcagcagcagcagttactgcaaaatcttggaaatttcaatgctggacttgggaatttttctttcaattcgatgcacagtggaaatgcatctgtgcttccagatattttcaattcaagtaatcaacctcaaaatcatgttgcagtgatgagcagttcgaagaaagatgacactaaagcttttgattttgtttcggatctccgatccctagataagaagttcgatatcttgaatccacccatccctagacaagaaattcaatgtcttcaatcctcaaacagcgcactaaaaatgcatgctttgttaatactgctctgccatcacatttgcatacaaccaattggtttctgtgaatccttgcttccctgggcagtcaataaatcactgaactacaaaacagaacatacaaacccaacccacacctctgttcataacttacatgtgggtgggtag

SEQ ID NO: 20647 - protein, 762 aa, Sorghum bicolor
  misc_feature: Ceres ANNOT ID no. 8657618
  misc_feature: Up-regulated in shoot tissues in response to salicylic acid treatment
MDQSRRAVESYWRSRMVDGVTADDDKVAPVYKLEEICELLRASDASIVKEVADFVLKRLDNKSPLVKQKALRLIKYAVGKSGTDFKREMQRHSVAMRQLVHYKGHPDPLRGDALNKAVRETANEAIAAIFSTEDPKPAVATESLGKRIQGFGNTNYEPSRDDKKSFLSELTEVVGIGSASIKQGLSNFAAAHAMMTNDNGSTYKSPNLRRSLTTESERYGRYDPSEIQSESRASSGASKNAASGSWGPTSSSVPTDDTSSSQPGIKTREERLLETIVTASGVRLQPTRDALQIFLTEASKLDAVALSRALENKLNSPLWQVRMKAICVLEAIVRKQDSDPYSIITSYFIENTASVIKCSELPQVSLREKASKVLNMLIGEQPTGTTTTKAAVSIPVQMPDLIDTGDQDDLATSSGQESNEQNTGNSAYVSSVDDLLGGEPIADTSVAADSNGSDPFADVSFHEAETKETNDLFSGLTVEEKSSATVHDSSSSNKNELPDIFGSAPDSFIHGSVTDQGTVNDLMAGLNLNGTGQAQSAVKAEPSSNFSGSQFFDTNNETSHVASAAALNGILGQNSFYQQQQTPLQYNFPQHMMINQSFPGQQLNYGAMGILLAQQQQLLQNLGNFNAGLGNFSFNSMHSGNASVLPDIFNSSNQPQNHVAVMSSSKKDDTKAFDFVSDLRSLDKKFDILNPPIPRQEIQCLQSSNSALKMHALLILLCHHICIQPIGFCESLLPWAVNKSLNYKTEHTNPTHTSVHNLHVGG

SEQ ID NO: 20648 - DNA, 1596 bp, Sorghum bicolor
  misc_feature: Ceres ANNOT ID no. 8657685
  misc_feature: Down-regulated in shoot tissues in response to aminocyclopropane carboxylic treatment
  misc_feature: Down-regulated in shoot tissues in response to methyl jasmonate treatment
  misc_feature: Encodes the peptide sequence at SEQ ID NO 20649
atggacgtctcaccgtttcttgcactgctgcccattgcccttctctccctcgcattcttctccactcgcagaaaaacctctcggtgccacggcgatggccacaaaaggagcttgcctccatcgccgccgggcttccctctcctcggccacctgccgcttctcgggtcgctaccccaccggaagctccgggcgatggccagaacgcacggtccggtcatgctcctgcgcctcggccgcgtgcccatcgtggtggcctcctcggcggctgcggcgcaggaggccatgaagacccgagacgtggccttcgccagccgataccgcggaccgatggcggagcgccttctctacggcggccgtgacatggccttcgctccctacggcgagcactggcgccaggcgcgccgcgtctgcgtgctccaccttcttagccaccgctgcgtgctctccttccgacgcgttcgggagcaggagaccgccgccctgctccgccgcgtccgcggtcgtctcgacgacgacgacgctgccgtgaacctgagccatctcctcgtcgcctactccagcgtcgtcctcctgcgggccgcgttcggcaacgactccggcggctatgggctcgtcggagaagggaagattcttaggaagctgttggtcgactacgtggagctgctgggctggggggcgctcggcgaggtcgtgccgtggctggcgtgggtagactcgctgagaggggtgcatgccaaggcaacacggacgtttgatgcgctggacggcttgctcgagcggggcatcgcagaacaccgtaagcgccgccgtggaggccggcgggagggagacggcagcgacgacgacgacgacagtcgccgcagcttcgtgagcgtgctgctggatgtgaaggaggaggaagagacgggagaaatcctgtttgacacggtaaccgtcaaggccatcattctggatatgttcgtaggcggctcggatacgacaacctccgttgtagaatgggcaatggcggagctcatcaaccatcccgacgcgatgcacaagctccaagacgagatacgacgcacggtcatccatggcggcggcgacaacaaccaagttaccgaggatcacctccgtaagctgcgccacctgaggccggtgctcaaggagacgctccgtctgcacacgccggcgcagctcgtgtcgcgggagacggtcgaggacaccgagctgctcggctaccatgtcccagcgcgcacccgcgtcctcatcaacgtcggggccatcgcactggaccccgccacgtgggagcgcgccgaggagttcctgccggagcggtggttcggcggcgacgacgacgatcattacgcgacggcgccggcgccggcggggcacaacttcacgttcttgccattcggtggtgggcggagagggtgccctggggccggctttgcaatggcgaccgtcgagctagtgctggcgagcctgctgtaccacttcgactgggggatgccggccggtgggccgtcgacggtcgacatggacgagctgagtggattattcgccgtgcggttgaagaagcctctgcgtctggtcgcgaagccatggtctccttaa

SEQ ID NO: 20649 - protein, 531 aa, Sorghum bicolor
  misc_feature: Ceres ANNOT ID no. 8657685
  misc_feature: Down-regulated in shoot tissues in response to aminocyclopropane carboxylic treatment
  misc_feature: Down-regulated in shoot tissues in response to methyl jasmonate treatment
  misc_feature (59)..(457): SWISSPROT Homolog: EC 1.14.13.68 4-hydroxyphenylacetaldehyde oxime monooxygenase
  misc_feature (39)..(525): Pfam ID: p450 Pfam Description: Cytochrome P450
MDVSPFLALLPIALLSLAFFSTRRKTSRCHGDGHKRSLPPSPPGFPLLGHLPLLGSLPHRKLRAMARTHGPVMLLRLGRVPIVVASSAAAAQEAMKTRDVAFASRYRGPMAERLLYGGRDMAFAPYGEHWRQARRVCVLHLLSHRCVLSFRRVREQETAALLRRVRGRLDDDDAAVNLSHLLVAYSSVVLLRAAFGNDSGGYGLVGEGKILRKLLVDYVELLGWGALGEVVPWLAWVDSLRGVHAKATRTFDALDGLLERGIAEHRKRRRGGRREGDGSDDDDDSRRSFVSVLLDVKEEEETGEILFDTVTVKAIILDMFVGGSDTTTSVVEWAMAELINHPDAMHKLQDEIRRTVIHGGGDNNQVTEDHLRKLRHLRPVLKETLRLHTPAQLVSRETVEDTELLGYHVPARTRVLINVGAIALDPATWERAEEFLPERWFGGDDDDHYATAPAPAGHNFTFLPFGGGRRGCPGAGFAMATVELVLASLLYHFDWGMPAGGPSTVDMDELSGLFAVRLKKPLRLVAKPWSP

SEQ ID NO: 20650 - DNA, 2358 bp, Sorghum bicolor
  misc_feature: Ceres ANNOT ID no. 8657700
  misc_feature: Down-regulated in shoot tissues in response to salicylic acid treatment
  misc_feature: Encodes the peptide sequence at SEQ ID NO 20651
atggaggggaagagcgtggtgatgtcggcgctcgggatcgggatcggggtcggcgtcggcctgggcctcgcgtccgcgccctgggccggcgcctccgcctcctccagggccgcgggggtcaccgtcgaacgggtggagcaggacctccgccgcctcctcgtcgacggcagcaacagcaaggtcaccttcgacgagttcccctactacctcagtgagcaaacacgtgttgtgctgacaagcgctgcgtacgttcacttgaagcaagcagagatttcaaagtacaccaggaatcttgctccagccagtcgcgcaatcctgctgtcaggtcctgcagagctctaccagcagatgcttgccagagcgcttgcccactattttcaagcgaagttgctgttgctagatcctactgattttcttataaagatccatagcaaatatggcactggtggcagtacagagaagacgtttaaaagatcaatctccgagacgacgcttgaacgtgtgtcgggattgcttggatctctttcaattatttcacaaaaggaacagcccaaaggaactatacgtagacaaagcagcatgacggatgtcaaattaaggagctctgaaagtatgaccaacttaccaaagctcagaagaaatgcatctacttcctctgatatgagtagcatggcttcgcaaggaccttcaactaatacagctcctcttagacgcacaagcagttggaattttgatgagaaaattttagtgcaagcgttgtacaaggttctgcattcagtgtcaaagaagtacccagttgtactctatataagagatgttgagaagtttcttcacaagtccccaaaaatgtatctcctgtttgaaaaactactagacaagcttgaagggccagtgttagtcctcggatcaaggattgtagatatggacagtgatgaggagttagatgacagattgactgttctgttcccatataatatagaaatcaagccacctgaaaacgaaaaccaccttgtaagttggaactcccaattagaagaagacatgaagatgattcagtttcaagataaccgaaatcatattatggaagtccttgcagaaaatgatcttgaatgtgatgatttaggctcgatttgcctatctgatactatgtgccttagtaagtatatagaagagattgtggtgtctgcggtttcatatcacttgatgaataacagagatccagagtaccgaaatgggaaattagttctatccacaaagagcttgtcccacgcattggaaatttttcaaggcaacaagatgggcgataaggacagcatgaaattggaagtgacggatggtgctttaaaggaagtgccaccagataatgagtttgaaaagcgcattagaccagaagtgatacctgctaatgaaattggagtttcatttgatgatattggtgccttggatgatatcaaagaatcccttcatgagcttgtcatgctgcctcttagacgacctgacctcttcaaaggcggtcttcttaagccctgcagaggtatattactttttggtcctccaggaaccggcaagactatgcttgccaaggccatagcaaatgaagctcaagcaagttttataaatgtctctatgtcgactatcacatcaaagtggtttggtgaagacgaaaagaatgttcgagcattgttcacattagctgctaaagtatcaccaaccatcatctttgtcgatgaagttgatagcatgcttgggcagcggaacagagctggagagcacgaggcaatgagaaagatcaagaatgaatttatgacacactgggatggactcttgtcaagaccagatcagagaattcttgttcttgctgcgactaaccggccttttgatcttgatgaggctatcatccgtaggttcgagcgaagaatcatggtaggtctgccatccatggaaagtcgggaactcataatgcggcgacttttgtcaaaggagaaagttgatgaagggctggactataaggagctagcaaccatgacagaaggatatagtggaagtgatctcaagaacctgtgcacgacggcagcatatcgccctgtgagggagctaatccagagggaaagaaagaaggagctggagaagatgaagcgtgaaaaaggaaaaactccatcggatcttccagagaagaaagaaaaggaggagaccatcattctaaggccgctgaacatgacagatctgaaggaagcgaagaaccaggtggctgcaagtttcgctgcggaaggcgccataatgagcgagctgaggcaatggaacgagttgtatggtgaaggaggctccagaaagaagcagcaattgacatacttcctctga

SEQ ID NO: 20651 - protein, 785 aa, Sorghum bicolor
  misc_feature: Ceres ANNOT ID no. 8657700
  misc_feature: Down-regulated in shoot tissues in response to salicylic acid treatment
  misc_feature (461)..(697): SWISSPROT Homolog: EC 3.6.4.3 Microtubule-severing ATPase
  misc_feature (512)..(697): Pfam ID: AAA Pfam Description: ATPase family associated with various cellular activities (AAA)
MEGKSVVMSALGIGIGVGVGLGLASAPWAGASASSRAAGVTVERVEQDLRRLLVDGSNSKVTFDEFPYYLSEQTRVVLTSAAYVHLKQAEISKYTRNLAPASRAILLSGPAELYQQMLARALAHYFQAKLLLLDPTDFLIKIHSKYGTGGSTEKTFKRSISETTLERVSGLLGSLSIISQKEQPKGTIRRQSSMTDVKLRSSESMTNLPKLRRNASTSSDMSSMASQGPSTNTAPLRRTSSWNFDEKILVQALYKVLHSVSKKYPVVLYIRDVEKFLHKSPKMYLLFEKLLDKLEGPVLVLGSRIVDMDSDEELDDRLTVLFPYNIEIKPPENENHLVSWNSQLEEDMKMIQFQDNRNHIMEVLAENDLECDDLGSICLSDTMCLSKYIEEIVVSAVSYHLMNNRDPEYRNGKLVLSTKSLSHALEIFQGNKMGDKDSMKLEVTDGALKEVPPDNEFEKRIRPEVIPANEIGVSFDDIGALDDIKESLHELVMLPLRRPDLFKGGLLKPCRGILLFGPPGTGKTMLAKAIANEAQASFINVSMSTITSKWFGEDEKNVRALFTLAAKVSPTIIFVDEVDSMLGQRNRAGEHEAMRKIKNEFMTHWDGLLSRPDQRILVLAATNRPFDLDEAIIRRFERRIMVGLPSMESRELIMRRLLSKEKVDEGLDYKELATMTEGYSGSDLKNLCTTAAYRPVRELIQRERKKELEKMKREKGKTPSDLPEKKEKEETIILRPLNMTDLKEAKNQVAASFAAEGAIMSELRQWNELYGEGGSRKKQQLTYFL

SEQ ID NO: 20652 - DNA, 2466 bp, Sorghum bicolor
  misc_feature: Ceres ANNOT ID no. 8657704
  misc_feature: Down-regulated in shoot tissues in response to methyl jasmonate treatment
  misc_feature: Encodes the peptide sequence at SEQ ID NO 20653
atgtttgttcttggaccttggtttctgttatctgctgtttttaggcttgtacctaaacaccttatgttagttgacataattttgaaatcttcctatgcaggtgacactagatttgatgcatcacagtatgctttttttggcaacaatgtgctggaggacattgaactaggtggattcgaagatgataacgacagtaatgctgctttcgctggactcgatgatttagagcgcccactttcttctcaagagattgcactagaggctgaagatagttcattctcagatcttgatgatcttgcaaatacattctcaaagctaagaagagatgttaacctaccaaagcatattggggtaaataaccttgggacttctttttcaagagaaagttctgctgctgctgactgggctccagaatttgattccccactctggcctgatcagtacgtgcaagttgctaagcaaggaccaaatggcaatggctggtggcctccaccgcatcattcttctctccttgctgattccagattgcacagaacatcctcatcccctcagcaacaggaacaaaacaatcataatgaacctgttcttggacccaggccatctcctttgcaccggacatcctcatacccacaaaaggagcctcagtacaatcctgctgaagtcattcctgcaccaaatgcaccatacatgtcaaaccatccacctagtggtccacccaattcagtgcctcgacagccacatcagatgaacatgccatctttcaatgaatttcagatgcatatgtctgcacaaagtgatgtcccattctcccagtttcctcgtggagggacacctccagagccattgtttggtggaaaccggggccatatgatttcaacaagcttctcaactaacaacagtgcgcaacaaggtcatctgctgaataatgggcagtttcatggggaaactgccagcaacatgccaaatttgctgccaaaccatctacaacgtccgaatacattcatgccccctcaaatgccgacaatacgccaacaccatggcttgctcccaattcagcaatcttcacagcagtcatcaagaacacaggcacacatgtttggtccccagcatccaccacatatgatgaataggtttgataattttgggatgcctgagttcagtgatccaagagcaagatcatcaatgcaccatggaaggcaaggtcaccattttccattccaaggctctgagtttggtattatgaagatgggtaatgggaggtcaagatttagatccaagtatatgtccactgaagaacttgaaaacattttaagaatacagcatgccgccactcacataaatgatccatacatcgatgattattaccatcaagcttgtctggccagcagatatgtggatggaaggtcgaagcaccgcttctacccaaccttgattcgggatccatcatcatgtgcgcggagtaaagatgagccacatgcataccttaaggtcgatgcccttgggagactgccattttcttccatccggaggccacgcccacttcttgatgttgaaccagcttctgcaactgacgataacactcttatttcaaagcctcttgatcaggagcctctgctagctgctaggatcacaattgaggatggactctccctactacttgatatagatgatattgatcgcttgcttcaatttagccagcagcaagatggtggtttacaacttaaaaacagaaggcaatctctccttggtcagctggcagaatcactgcagttggttgatccactaggtccaaataaaaaaacacatttgtctgcaaatgatgatttggtatttcttcgcattgtttctctacccaagggccggaaactacttgcacgctatatcaacatcatggtacctggtagcgatcttgcaaggatagtttgcatggcagtatttcggcatctgaggtttgtgtttggaaatttgccctccgatgatggttcagctgagacagtaactaaactagctagtgctgtagctgcatgcattcgtgggatggacttaagtggcctcagtgcttgtcttgcagcaattgtttgctcgtctgagcatccacctcttcgaccccttggatatgctgctggtgatggtgccactgtcatcataaagtctgtcctggatagagcaacagaccttctcactgagcatcctgctgcaccagactatagcgctccaaaccgagccctgtggcaagcatcgtttaatgctttctttgggctgcttacaaagtattgcgtgagtaaatttgacagcatggttcatactatgcacaagcaccctgctgctgcaacagttatacacaaggaacttccagttgagcttctgcgtgccagtcttcctcacacagatgagcaacagcgcagactattgcttgagttcgcccagcggactttgcctgtcgctggccatagttctgacgggtga

SEQ ID NO: 20653 - protein, 821 aa, Sorghum bicolor
  misc_feature: Ceres ANNOT ID no. 8657704
  misc_feature: Down-regulated in shoot tissues in response to methyl jasmonate treatment
MFVLGPWFLLSAVFRLVPKHLMLVDIILKSSYAGDTRFDASQYAFFGNNVLEDIELGGFEDDNDSNAAFAGLDDLERPLSSQEIALEAEDSSFSDLDDLANTFSKLRRDVNLPKHIGVNNLGTSFSRESSAAADWAPEFDSPLWPDQYVQVAKQGPNGNGWWPPPHHSSLLADSRLHRTSSSPQQQEQNNHNEPVLGPRPSPLHRTSSYPQKEPQYNPAEVIPAPNAPYMSNHPPSGPPNSVPRQPHQMNMPSFNEFQMHMSAQSDVPFSQFPRGGTPPEPLFGGNRGHMISTSFSTNNSAQQGHLLNNGQFHGETASNMPNLLPNHLQRPNTFMPPQMPTIRQHHGLLPIQQSSQQSSRTQAHMFGPQHPPHMMNRFDNFGMPEFSDPRARSSMHHGRQGHHFPFQGSEFGIMKMGNGRSRFRSKYMSTEELENILRIQHAATHINDPYIDDYYHQACLASRYVDGRSKHRFYPTLIRDPSSCARSKDEPHAYLKVDALGRLPFSSIRRPRPLLDVEPASATDDNTLISKPLDQEPLLAARITIEDGLSLLLDIDDIDRLLQFSQQQDGGLQLKNRRQSLLGQLAESLQLVDPLGPNKKTHLSANDDLVFLRIVSLPKGRKLLARYINIMVPGSDLARIVCMAVFRHLRFVFGNLPSDDGSAETVTKLASAVAACIRGMDLSGLSACLAAIVCSSEHPPLRPLGYAAGDGATVIIKSVLDRATDLLTEHPAAPDYSAPNRALWQASFNAFFGLLTKYCVSKFDSMVHTMHKHPAAATVIHKELPVELLRASLPHTDEQQRRLLLEFAQRTLPVAGHSSDG

SEQ ID NO: 20654 - DNA, 2346 bp, Sorghum bicolor
  misc_feature: Ceres ANNOT ID no. 8657738
  misc_feature: Up-regulated in root tissues in response to salicylic acid treatment
  misc_feature: Encodes the peptide sequence at SEQ ID NO 20655
atggtggacacaagcagtttgaggttcttctactcaacttcatttgctttactacttccctccctgacctgccttgtatttccttgctgcaaattaacatgtgcattagacaccctccttcctggtcaattcctgaacgagaatcagagcctcatctcaaaaaatggtgccttcaagttgggttacgactgctatattcctcaaggttattgtggtttgggtatctggtttgctaaaccatcatcttgtaatcgtgagtattttcctctttggcaacctgatgcatactcttatgatcgagcatcatttatcctctcagtctcagataatggtgtgctaaattataccatatatggaggtgatatttggtccacgcccgtcaccaggaccacttctatctctgctgctgcagtgcttcttggcaatggaaatcttgtaataagagatcgagtaaacagttccatggttatttggcagagttttgataacccgactaatgtactgctccctggacaacatctgggattcaataaaatcaatggcaagaaaatcaccctttgtagttctttagacccctatggcatggggttgacgtttactttgtcactagatgcaactagaaggcgaagttttattatccggcagcatcctaatggtcagatgtttgctggtaccttcccaggatggatgggcattcatgaagatggagaccatatgctaacattcaatgacgtatatgcatacatacgtttaaatgaatctggttttgttacattcgctaaacaaagggaatgtgattctattttgtggtctgccccagaaagtttatgtgaatttcattcatattgtggaccttacagcctttgcacattgtcaggctcttgtatatgccctgttggtttcaactcactatcgagcaatgctgcatggatttcgactggttgtttgagagattatcctctgaattgtgaaaatggggaagtgacatgttatccaatagatggcatccatagatatccccagaaagctttcacgttggaagttacaaacatgagtgagtgtgaatccgcttgcttaagagactgtacctgtactgcctttgcttacaatgcaagttgcttactatggtttcgggagctgcggagtacaatagtacttgattctgatctaaatggcaaccgtttgtacatatgtagatcaaccaaacaacagtcaggttctagaattgttccttggaatggttcttcgaaagaaagaattgttccttggaaaagattggttcttgaatcgatgatcggagtgatagccgtcattgttatgagtctgattcttttgttgagatgcagacaaaagcttttgaaggctagaacagtgggtggcagtggaagtcttatggtattctcttttgtacaaataaagaactcaagcaaacaattctctgaaaaacttggagaaggaggtttcggctgcgttttcaaagggatgttgccaagctgcactatggtggctatcaagaagctaaaaggcctcagacaggaagacaagcaatttcgagcagaggtgcagaccataggtatgattcagcacatcaatattgtccatctgcttgggttttgcgctgaaggtagtggaaggttcctagtgtatgaatatatggcgaatggttctttgagcaaccatctattttccgagaattcctttaagttaagctgggagctgcggtactcgatagcacttggaattgcacgaggtttggcttatctgcatgagggatgcaaggattgtattgtacactgcgatataaagccagataatgtgcttcttgatgcagagttctgtcctaagattgcagattttggcatggcaaagcttcttggtcgagattacagtagggtactgacaacaatgcgagggactatcggatatcttgcaccggagtggatcacaggggtaccaataacacataaggctgatgtctatagctatggaatggttctcctagaaatcatatcagggcgaaggaattctgagaaaattaaggaggggaggtttacttactttccgatctatgccgcagttaaggtgaatgaaggaggtatcatgtgcctgctggatagtggtttgaagggcaatgctgatgccgagaagctagagagagcctgtagagttgcaagctggtgtattcaggatgctgaagatcacaggccgatgatggggcaggttgttcgcatgctggaaggtgtcatggatgttcaagtccctcctgttcccaggtcactccaaaactatgtcggcatggaggattctacctctgcagatttttacatttctgaagtctcgtgttag

SEQ ID NO: 20655 - protein, 781 aa, Sorghum bicolor
  misc_feature: Ceres ANNOT ID no. 8657738
  misc_feature: Up-regulated in root tissues in response to salicylic acid treatment
  misc_feature (462)..(747): SWISSPROT Homolog: EC 2.7.11.1 Non-specific serine/threonine protein kinase
  misc_feature (477)..(745): Pfam ID: Pkinase Pfam Description: Protein kinase domain
  misc_feature (86)..(193): Pfam ID: B_lectin Pfam Description: D-mannose binding lectin
  misc_feature (330)..(383): Pfam ID: PAN_2 Pfam Description: PAN-like domain
  misc_feature (197)..(310): Pfam ID: S_locus_glycop Pfam Description: S-locus glycoprotein family
MVDTSSLRFFYSTSFALLLPSLTCLVFPCCKLTCALDTLLPGQFLNENQSLISKNGAFKLGYDCYIPQGYCGLGIWFAKPSSCNREYFPLWQPDAYSYDRASFILSVSDNGVLNYTIYGGDIWSTPVTRTTSISAAAVLLGNGNLVIRDRVNSSMVIWQSFDNPTNVLLPGQHLGFNKINGKKITLCSSLDPYGMGLTFTLSLDATRRRSFIIRQHPNGQMFAGTFPGWMGIHEDGDHMLTFNDVYAYIRLNESGFVTFAKQRECDSILWSAPESLCEFHSYCGPYSLCTLSGSCICPVGFNSLSSNAAWISTGCLRDYPLNCENGEVTCYPIDGIHRYPQKAFTLEVTNMSECESACLRDCTCTAFAYNASCLLWFRELRSTIVLDSDLNGNRLYICRSTKQQSGSRIVPWNGSSKERIVPWKRLVLESMIGVIAVIVMSLILLLRCRQKLLKARTVGGSGSLMVFSFVQIKNSSKQFSEKLGEGGFGCVFKGMLPSCTMVAIKKLKGLRQEDKQFRAEVQTIGMIQHINIVHLLGFCAEGSGRFLVYEYMANGSLSNHLFSENSFKLSWELRYSIALGIARGLAYLHEGCKDCIVHCDIKPDNVLLDAEFCPKIADFGMAKLLGRDYSRVLTTMRGTIGYLAPEWITGVPITHKADVYSYGMVLLEIISGRRNSEKIKEGRFTYFPIYAAVKVNEGGIMCLLDSGLKGNADAEKLERACRVASWCIQDAEDHRPMMGQVVRMLEGVMDVQVPPVPRSLQNYVGMEDSTSADFYISEVSC

SEQ ID NO: 20656 - DNA, 3864 bp, Sorghum bicolor
  misc_feature: Ceres ANNOT ID no. 8657808
  misc_feature: Up-regulated in root tissues in response to methyl jasmonate treatment
  misc_feature: Down-regulated in shoot tissues in response to methyl jasmonate treatment
  misc_feature: Down-regulated in shoot tissues in response to salicylic acid treatment
  misc_feature: Up-regulated in root tissues in response to salicylic acid treatment
  misc_feature: Encodes the peptide sequence at SEQ ID NO 20657
atggacgcggtcgacgcggagctcgcgcgcgcgcaggaggagcggcgcaaggtggaggcggcgctggcggcaggcgcgcccatggccgtgtcctccgtcaccttcgacaccgacctctacggcggcgggggcgccgacccgcaccgcttcgctggctacgacacctccatcgcggcctccgaggacgacgacgcagcagcggaggaggacgcggaggccgccgccaaacccgcgccgcgccggctcgcgacctacacgggccacgccatcgccgccgccgacctcccgcgctcgaccgacggcggcgacggcgacgggctggggttgcccaagcggtcccagcgcatcatcgaccgcgaggacgactaccgccgccgccgcctcaaccagatcatctcgccggagcgccatgacgcgttcgccgttggggaggccaccccggaccctgcggtgcggacctacgctgacgtcatgcgcgatgcggcgctgcagaagaagaaggagtacctgctgagggagatttctaagaagaaggaagaggaggagaaggtgaaggaggagaggaaggcctttgccgcgcctgagcagctggccgccacgacgacaaagcgccgcaacaggtgggatcagtcgcaggaaggcgatgctgctgccggtgccaagaaggcaaagacatcgtcggattgggatgctcctgacgcgactcctgggattgggcgttgggatgccacccctggacgtgttggagacgcgacgccttccgtgagaaggaacagatgggatgagacaccgactccagggaggatggctgatgttgatgcgacgcctgcagctggcggtgcgactccttccggggcttgggatgcgaccccaaagctgccgggtggtgtcacgccaacccctggtaagaagcagagatcaaggtgggatgagacgccagccagtatggggattgcaaccccgggtggtcttggtggtgctgcaactgcaacacctgctggttatactcctgggccgacgccatttggtgctgataaccttgccacgccaactcctagccagatcgctcgtggacctatgactctggacctgtacaaccaatcccggtggcagcaagacattcaggagaggaacaggcctctcaccgatgaggagcttgatgccatgttcccgcaggagggctacaagattcttgagcccccggcttcgtaccagcccataaggaccccggcaaggaagctgcttgccacaccaacacctctggggacaccactttatgctattccagaggagaatcgtgggcagcattttgatctgcccaaggagatgactggtggattaccgctcatgaagccagaggattaccaatactttggaacattgctgaatgaggaagaggaacagctatctccagaggagcagaaggagaggaaaatcatgaaactgttgctcaaagtgaagaatggcacacccccacagcgtaaaacagcacttcggcagctgacagacaaagcccgggaattcggtgccggaccacttttcaacaaaatccttcccttactcatgcagccaacactggaggaccaggagaggcaccttctggtgaaggttattgacagggtactgtataagctggatgagcttgtccgtcccttcgtgcacaagattcttgtggttattgaaccgttgttgattgatgaggactactacgctcgtgttgagggcagggagattatctcaaatcttagcaaagcagctggtcttgctactatgattgctgccatgagaccggatattgataacgttgatgagtatgtgaggaacaccactgctagggcgttcagtgtggtggcttctgctttgggcatccctgctcttttaccattcttgaaggctgtctgtcaaagtaagaagtcttggcaggctcggcacactggtatcaaaatcgttcagcagatttctattctcatgggctgtgctgttctgccgcatctcaagtcactggttgagatcattgagcatggtctaagcgatgagaaccagaaagtcaggacaattactgcactttctcttgccgcacttgctgaggctgctgcaccatatggtatagaaagttttgatactgtattgaagcctttgtggaagggtgtcagatctcaccgcgggaaggtccttgctgccttcctgaaggctattggtttcatcatccctcttatggatgctgcgtatgctagtctctacacaaagggggtgatgcaggtcctcattagggagttccagtctccagatgaagagatgaagaagattgtcctcaaggttgtgaaacagtgtgtcagtacagagggtgtggaggctgattatatccggaatgacatccttccaaaattcttcgagcacttctgggtgaggagaatggctctagatcgcaggaactataaacagcttgtggaaactacagtggagatggcaaacaaggttggagttcctgatattgttgggaggattgttgaggatctgaaagacgaaggcgagcactacagaagaatggtgatggaaacaattgagaaggtggtggccaacttgggtgcttcagatattgatgctcgtctggaggagctgcttattgacggtatcttatatgctttccaagagcagactagtgatgatgcaaatgtcatgcttaatggttttggagctgtggttaatgcaattggacagagagttaagccttaccttcctcagatttgtggtaccatcaagtggcgattgaacaacaagagtgcaaaagttaggcagcaagctgctgatctgatctccaggatagccattgtcatgaagcagtgccaggaggagcagcttatgggtcacttgggtgttgtgctgtatgagtacttaggagaggagtatcctgaggtgttgggttcaattcttggagccttgaaggctatcgtcaatgtcattggtatgactaaaatgactcctccaatcaaagatcttcttcctcgtctgacccccatcttgaagaacaggcatgagaaggtgcaagagaactgcattgatcttgttggtaggattgctgatcgtggagcagaatttgtgccagcaagggaatggatgaggatttgttttgagctgcttgaaatgttgaaggctcataagatgggtattaggagagccactgtgaacacatttggttatattgcaaaggctatagggccacaggacgtgttggccaccctgttgaataacttgaaggtgcaggagcgacagaaccgtgtctgcacaactgtagcaattgccattgttgctgaaacttgctcacctttcacagttttgcctgcccttatgaatgagtaccgggtcccagagctcaatgtgcaaaatggtgttctgaagtcactctctttcctctttgagtatattggtgagatgggcaaagattacatatatgctgtctctcccttacttgaagatgctttaatggatagagatctggttcaccgccagactgctgcctctgctgttaagcacatggctctaggtgttgctggcttgggttgtgaggatgctcttgttcatctgcttaactatgtttggcccaacatatttgagacatctccccatgttataaatgctgtcatggaggcgattgaggggatgagggttgcgctaggtccagctatgattttgaattattgcctgcaaggtctcttccatccagcaaggaaagtacgtgaagtgtattggaagatatacaactctttgtacattggtgcacaggatgcgcttgttgcttcttaccctgccatggaagacaatggggataacatctttagccgtccagagctggtagtgtttgtctga

SEQ ID NO: 20657 - protein, 1287 aa, Sorghum bicolor
  misc_feature: Ceres ANNOT ID no. 8657808
  misc_feature: Up-regulated in root tissues in response to methyl jasmonate treatment
  misc_feature: Down-regulated in shoot tissues in response to methyl jasmonate treatment
  misc_feature: Down-regulated in shoot tissues in response to salicylic acid treatment
  misc_feature: Up-regulated in root tissues in response to salicylic acid treatment
  misc_feature (299)..(439): Pfam ID: SF3b1 Pfam Description: Splicing factor 3B subunit 1
  misc_feature (662)..(698): Pfam ID: HEAT Pfam Description: HEAT repeat
MDAVDAELARAQEERRKVEAALAAGAPMAVSSVTFDTDLYGGGGADPHRFAGYDTSIAASEDDDAAAEEDAEAAAKPAPRRLATYTGHAIAAADLPRSTDGGDGDGLGLPKRSQRIIDREDDYRRRRLNQIISPERHDAFAVGEATPDPAVRTYADVMRDAALQKKKEYLLREISKKKEEEEKVKEERKAFAAPEQLAATTTKRRNRWDQSQEGDAAAGAKKAKTSSDWDAPDATPGIGRWDATPGRVGDATPSVRRNRWDETPTPGRMADVDATPAAGGATPSGAWDATPKLPGGVTPTPGKKQRSRWDETPASMGIATPGGLGGAATATPAGYTPGPTPFGADNLATPTPSQIARGPMTLDLYNQSRWQQDIQERNRPLTDEELDAMFPQEGYKILEPPASYQPIRTPARKLLATPTPLGTPLYAIPEENRGQHFDLPKEMTGGLPLMKPEDYQYFGTLLNEEEEQLSPEEQKERKIMKLLLKVKNGTPPQRKTALRQLTDKAREFGAGPLFNKILPLLMQPTLEDQERHLLVKVIDRVLYKLDELVRPFVHKILVVIEPLLIDEDYYARVEGREIISNLSKAAGLATMIAAMRPDIDNVDEYVRNTTARAFSVVASALGIPALLPFLKAVCQSKKSWQARHTGIKIVQQISILMGCAVLPHLKSLVEIIEHGLSDENQKVRTITALSLAALAEAAAPYGIESFDTVLKPLWKGVRSHRGKVLAAFLKAIGFIIPLMDAAYASLYTKGVMQVLIREFQSPDEEMKKIVLKVVKQCVSTEGVEADYIRNDILPKFFEHFWVRRMALDRRNYKQLVETTVEMANKVGVPDIVGRIVEDLKDEGEHYRRMVMETIEKVVANLGASDIDARLEELLIDGILYAFQEQTSDDANVMLNGFGAVVNAIGQRVKPYLPQICGTIKWRLNNKSAKVRQQAADLISRIAIVMKQCQEEQLMGHLGVVLYEYLGEEYPEVLGSILGALKAIVNVIGMTKMTPPIKDLLPRLTPILKNRHEKVQENCIDLVGRIADRGAEFVPAREWMRICFELLEMLKAHKMGIRRATVNTFGYIAKAIGPQDVLATLLNNLKVQERQNRVCTTVAIAIVAETCSPFTVLPALMNEYRVPELNVQNGVLKSLSFLFEYIGEMGKDYIYAVSPLLEDALMDRDLVHRQTAASAVKHMALGVAGLGCEDALVHLLNYVWPNIFETSPHVINAVMEAIEGMRVALGPAMILNYCLQGLFHPARKVREVYWKIYNSLYIGAQDALVASYPAMEDNGDNIFSRPELVVFV

SEQ ID NO: 20658 - DNA, 1119 bp, Sorghum bicolor
  misc_feature: Ceres ANNOT ID no. 8657841
  misc_feature: Down-regulated in shoot tissues in response to salicylic acid treatment
  misc_feature: Encodes the peptide sequence at SEQ ID NO 20659
atggcggacaacgccagactgctgcccctgttcgccgccgtcttgctctgctgctgctccctcgcgcaatgccgaggcggcggcggcggcgggcagaactacacctccatgttcagcttcggcgactcgctcaccgacaccggcaacctgctcgtatccagcccgctctccaaccacatcgtcggccgctacccctacggcatgacctacttccaccgccccaccggccgctgctccgacggccgcctcgtcgtcgacttcctagcgcaagcgttcggcctgccgctgctgcagccgtacctgcagtcccgcggcaaggacctccgccggggcgtcaacttcgccgtcggcggcgccaccgccatggatccgcctttcttccaggagatcggcgcgtccgacaagctctggaccaacctctccctcagcgtccagctcggctggttcgagcagctcaagccgtcactctgcagctccccaaaaaagtgcaaggagtacttcagcaagtccctgttcctcgtcggagagattgggggaaacgactacaactacgccttcttcaagggcaagaccctggacgacgccaaaacctacgtccccacggtcgccgccgcggtcaccgatgccaccgagaggctgatcaaggccggcgccacgcacctggtggtgccggggaacctgcccattgggtgctcgtcggcgtacctgaccctgcacccgggccggaacagcagcgactacgacgccgccggctgcctcaagacgtacaatgacttcgcgcagcaccacaacgcggtgctccagcagaacctgcgggcgctccgggtcaagtacccgcaggccaggatcatgtacgccgactactacggcgccgccatgtccttcgccaagaaccccaagcagttcgggtttacagaggggccactgcggacgtgctgcggcggcggtgggccatacaacttcaacccgaaggcgagctgcggcgtgcggggctccagcgtgtgcacggacccgtcggcgtacgccaactgggacggcgtgcacctgacggaggccgcctaccacgccatcgccgacagcatcctcaacggcccctacaccagccccaggctcctctga

SEQ ID NO: 20659 - protein, 372 aa, Sorghum bicolor
  misc_feature: Ceres ANNOT ID no. 8657841
  misc_feature: Down-regulated in shoot tissues in response to salicylic acid treatment
  misc_feature (4)..(364): SWISSPROT Homolog: EC 3.2.1.51 Alpha-L-fucosidase
  misc_feature (37)..(361): Pfam ID: Lipase_GDSL Pfam Description: GDSL-like Lipase/Acylhydrolase
MADNARLLPLFAAVLLCCCSLAQCRGGGGGGQNYTSMFSFGDSLTDTGNLLVSSPLSNHIVGRYPYGMTYFHRPTGRCSDGRLVVDFLAQAFGLPLLQPYLQSRGKDLRRGVNFAVGGATAMDPPFFQEIGASDKLWTNLSLSVQLGWFEQLKPSLCSSPKKCKEYFSKSLFLVGEIGGNDYNYAFFKGKTLDDAKTYVPTVAAAVTDATERLIKAGATHLVVPGNLPIGCSSAYLTLHPGRNSSDYDAAGCLKTYNDFAQHHNAVLQQNLRALRVKYPQARIMYADYYGAAMSFAKNPKQFGFTEGPLRTCCGGGGPYNFNPKASCGVRGSSVCTDPSAYANWDGVHLTEAAYHAIADSILNGPYTSPRLL

SEQ ID NO: 20660 - DNA, 2139 bp, Sorghum bicolor
  misc_feature: Ceres ANNOT ID no. 8657857
  misc_feature: Up-regulated in root tissues in response to methyl jasmonate treatment
  misc_feature: Encodes the peptide sequence at SEQ ID NO 20661
atggaagccctagcctcgacgcctataaagaaccagccgccgccactctcttcttccagtccccatctgccgccgcaactcctctgctcccaagcagcgccgcagccgccattgcctggccaccccaatgccggtgcccctacgacgtcgcccgcaaccacggcgcagagacgctgccctcaccgcgacgagcacccaccgcgccaccgagagcccgagacgacggcgcccttgcctcgacggctgacacgacgccccggagccgccttcgccgagccgtggccaccgcggccgcgacgccacggaccaaacccgtgtgtccatccatccccatgccgcggccgccgccagcgccgccgccttcttctccactctattgactgtgtttctttttgtgtttcttgtcatcctagttatgggctccggcgaggtggatggacccgcattgtcggacgcagagcagcagtagcggcgcccaagcagaagcaggcgggggatctggatccgaggcacgaccaccgggctcctcgcggcggcgacggaggaggaggaggaggaggaggaggagcgcagcaagaagcagatgagcagcagcggcaccaccaccaccgcctgctgcagctccaccagcaagtgcagcaggaccaagacccgccgccggtcccactcttccagctccagcacctgcaggccgcggcggccgtgaggcagcgaggtggcttgcccgccgagtatgcccttctcacgcccatgggcgatgccggccagtcccactcccaccaccacgccttccagccgcagctcctgtccttcgggggagtcggccagcaccacgtgcaccagttcacggcgcaggcgcaggcggcgccgcccgcagcgtcccactcgcgttcgcggggaggaggggcgggcggcgaggtcgccgtggcccccatgtccgcgtcgcactcgcgcgtgaggggcggcgccggtggcggtggggagatcgtggccgtgcagggagggcacattgtgcgctccacggggcgcaaggaccgccacagcaaggtgtgcacggcacgcgggccgcgggaccgacgcgtgcgcctgtcggcgcacaccgccatccagttctacgacgtgcaagaccgtctgggctacgaccgccccagcaaggccgtggattggctcatcaagaacgccaaggacgccatcgacaagcttgagacgctgcccgcgtggcagcccacggccaccggagccaatgccgtcgcgccgccgtcctcctccacgcacccagactccgccgagaactccgacgacgaggcgcaggccatcaccgtcgcccacacggccttcgacttcccaggcgctgcaggagccggcgggggcggaagcggtgcgggcttcctcccgtcgtcgctcgactcagactccatcgcggacacgatcaagtctttctttcccatggctggcacgggaggtggcgaggcgtcttcgtccacggcagcgacgcagtcgtcggccatgggcttccaaagctacacgcctgacctcctgtcacgcaccggcaaccacagccaggagctccggttgtcgttgcagtctctcccagaccccatgttccaccaccagcaccaggaccggtcgcaacaaggccacggcggcaatggctccgcgcagcaggcgctcttccccggcgctgccagctactcgttcgtcggcggtggcggcggcaccatgtggggcgagcaggcgcagagccagcgcatgctgccatggaacgtgcccgacccaggcggcgggagcactggtagctacctgttcaacgtgtctcagcaggcggtgtctcagcaggcggcgcacatgcaggcggcgcttggcggccagagccagttcttcttccagaggggaccccttcagtccagtaaccagccctccgagcgaggatggccggagatcgtcgaagccgacaacccgatgcaacagcagcatggtggcgggctcagccccaccgtgtcggccatcgggttcacgcccggcatcggcttctccgggatgcgcatccccactaggatacagggcgacgaggagcacaacggcggcagcggcaatggcgacaagccgccgccgtctgtgtcctcggcatctcaccactga

SEQ ID NO: 20661 - protein, 712 aa, Sorghum bicolor
  misc_feature: Ceres ANNOT ID no. 8657857
  misc_feature: Up-regulated in root tissues in response to methyl jasmonate treatment
  misc_feature (327)..(598): Pfam ID: TCP Pfam Description: TCP family transcription factor
MEALASTPIKNQPPPLSSSSPHLPPQLLCSQAAPQPPLPGHPNAGAPTTSPATTAQRRCPHRDEHPPRHREPETTAPLPRRLTRRPGAAFAEPWPPRPRRHGPNPCVHPSPCRGRRQRRRLLLHSIDCVSFCVSCHPSYGLRRGGWTRIVGRRAAVAAPKQKQAGDLDPRHDHRAPRGGDGGGGGGGGGAQQEADEQQRHHHHRLLQLHQQVQQDQDPPPVPLFQLQHLQAAAAVRQRGGLPAEYALLTPMGDAGQSHSHHHAFQPQLLSFGGVGQHHVHQFTAQAQAAPPAASHSRSRGGGAGGEVAVAPMSASHSRVRGGAGGGGEIVAVQGGHIVRSTGRKDRHSKVCTARGPRDRRVRLSAHTAIQFYDVQDRLGYDRPSKAVDWLIKNAKDAIDKLETLPAWQPTATGANAVAPPSSSTHPDSAENSDDEAQAITVAHTAFDFPGAAGAGGGGSGAGFLPSSLDSDSIADTIKSFFPMAGTGGGEASSSTAATQSSAMGFQSYTPDLLSRTGNHSQELRLSLQSLPDPMFHHQHQDRSQQGHGGNGSAQQALFPGAASYSFVGGGGGTMWGEQAQSQRMLPWNVPDPGGGSTGSYLFNVSQQAVSQQAAHMQAALGGQSQFFFQRGPLQSSNQPSERGWPEIVEADNPMQQQHGGGLSPTVSAIGFTPGIGFSGMRIPTRIQGDEEHNGGSGNGDKPPPSVSSASHH

SEQ ID NO: 20662 - DNA, 1755 bp, Sorghum bicolor
  misc_feature: Ceres ANNOT ID no. 8657924
  misc_feature: Up-regulated in shoot tissues in response to methyl jasmonate treatment
  misc_feature: Encodes the peptide sequence at SEQ ID NO 20663
atgccgactgcctcctctgcccaccgctcactcctcctctgcctctgcgtcgctctgctctccaactcggccgccgccttgccgtcgccccgggacctccgcttctccgtcgaggacatcgcggcggtggaggccgcgctgccgcgccacagcaggcggacgtcctccaagaccaccttcttcgaggtggaccgccctctccgccctcccaggggcagctccggcccctgctccacgctgctgctgtcgcactccttcgccttcacgctcaccaagccgcccgtcacggcgacgtactcgccgccgccgtgcctagcatccggcgcgtcgtcggtgtcgctcgcggtgctcgagtggcgcgccgagtgccgcggcgcgcagtacgaccgcaccttcggcgtgtggctcggcggcgccgagctcctgcgtggcagcaccgcggagccccgccccggcggggtggtctggtcggtctccaaggacgtcacccgctacgcggccctcctcgccgccggcgacgccacgctcgccgtgtacctcggcaacctcatcgacgacacctacaacggcgtctaccacgccaacctcacgctccacctctacttccgctccggcgcgcggtcctctccgccgtcggccgccgccgacgccgtcgtccccgtctccaggagcctgccgctcaacgacgggctgtggttcgtcgtccagaacgccaccgacgtgcagtccgcgcgggtcaccgtgccgcgcaacgcgtaccgcgccgtcctcgaggtctacgtctcgtcccacgacgccgacgagttctggtacatgaacacgcccgagcagaacgggccgttccgcgaggtcaccgtgctgctcgacggcgacgtcgtcggcgccgtgtggccgttcccggtgatctacaccggcggcattaacccgctcatctggcggcccatcaccagcattggctccttcaacatgcccacctacgacatcgagctcacgccattcctgggcaagctcctcgacggcgaggaccacgagctcgggttcgcggtgaccaacgcgcagaggtcgtggtacgtggacgccaacctccacctgtggctggaccccaagagcaccaggaccaccggcgggctcgtcgcgtacgacgcgccgaagctggccggcagcatcgtctcgcactccgcggacggcatcgacggcgagtacgaggcggcggcgagccgcaacatcacggccacggggtgggtgagctcgtcgcgcggcaacgtcaccaccacgttcgcgcagcggctgagcttcgccaacacgaacgtggtcagcggtcagggcagcgcgcaggcgatcaaccagacgacggacgcgctcacgaccgtcaccggcggtgcggcgtccgcgtcggcgcagcagcaggtgcaccagagcttcccgctctacatcttcctgggcggcgacggcagcggcacgtcgtcgcagcggctgatgcggcgcgtggagatcgggttcgacgagacgcggtccaagggaggaggaggaggaggaggaggggcggcgacgagcacgctgcggaacgcgcaggcggcggcggcggaggtgacgctccgggacgacgccgtggtgggcgcgtcgtggcggatgcatcagacgtacgcgtacggcgccagcgacggcggctgctacctcaggaacgtaagcagcgtcggttacgacgtgcttttcgaccatcatgacgcgtcctgcgccggtacgctcggccgctga

SEQ ID NO: 20663 - protein, 584 aa, Sorghum bicolor
  misc_feature: Ceres ANNOT ID no. 8657924
  misc_feature: Up-regulated in shoot tissues in response to methyl jasmonate treatment
  misc_feature (225)..(578): SWISSPROT Homolog: EC 3.5.1.52 Peptide-N(4)-(N-acetyl-beta-glucosaminyl)asparagine amidase
MPTASSAHRSLLLCLCVALLSNSAAALPSPRDLRFSVEDIAAVEAALPRHSRRTSSKTTFFEVDRPLRPPRGSSGPCSTLLLSHSFAFTLTKPPVTATYSPPPCLASGASSVSLAVLEWRAECRGAQYDRTFGVWLGGAELLRGSTAEPRPGGVVWSVSKDVTRYAALLAAGDATLAVYLGNLIDDTYNGVYHANLTLHLYFRSGARSSPPSAAADAVVPVSRSLPLNDGLWFVVQNATDVQSARVTVPRNAYRAVLEVYVSSHDADEFWYMNTPEQNGPFREVTVLLDGDVVGAVWPFPVIYTGGINPLIWRPITSIGSFNMPTYDIELTPFLGKLLDGEDHELGFAVTNAQRSWYVDANLHLWLDPKSTRTTGGLVAYDAPKLAGSIVSHSADGIDGEYEAAASRNITATGWVSSSRGNVTTTFAQRLSFANTNVVSGQGSAQAINQTTDALTTVTGGAASASAQQQVHQSFPLYIFLGGDGSGTSSQRLMRRVEIGFDETRSKGGGGGGGGAATSTLRNAQAAAAEVTLRDDAVVGASWRMHQTYAYGASDGGCYLRNVSSVGYDVLFDHHDASCAGTLGR

SEQ ID NO: 20664 - DNA, 1617 bp, Sorghum bicolor
  misc_feature: Ceres ANNOT ID no. 8658001
  misc_feature: Down-regulated in shoot tissues in response to salicylic acid treatment
  misc_feature: Encodes the peptide sequence at SEQ ID NO 20665
atggccaggccggcgggtggtccgccggtgcacggcgtctgcaacaccgtcgtcggagtcctcgggggaggccagctcgggaagatgctatgccaggcggcgagccagatggggattagaatcgtcatcctcgacccccttccgggctgccccgcgagctcggtttgtgatgagcacgtcgtcgggagcttcactgatggggacacggtccgggagttcgccaagaagtgtggggtcctaacagtagagattgagcatgttgatgccgccacacttgagaggctggaaaaacagggtgttgactgcgagcctaaagcctccacaatcatgattattcaggacaagtacaggcagaaaaggcatttctcaaaatgtgggatcccattgcctgacttcatggaagtagatactttacacagtatagaggaagctggggaaaagtttggttatcccctaatggtaaaaagcaagagattagcatatgatggtcgaggcaatgctgtagccaagaccaaagaggagctatcttctgttgttgcttcactgggtgggtttgagcatggcttgtatgttgagaggtggactcctttcgtaaaggagctttctgtaattgtggcaaggagcagagacagctctactgtctgctatcctgttgttgaaacaattcacaaggaaaacatatgtcatgttgttgaagcacctgctgaggtatctgacaaaataaagaagttggctactagcgtggctgaaaaagctatcaagtcattagaaggagctggtgtttttgctgtagagttatttttaacagaagaagatcagattttagtgaatgaagtagcccctaggcctcacaacagtgggcatcacacaatagagtcatgctacacctcacaatatgagcagcatttacgtgctattcttggccttcctcttggtgacccctcaatgaaagcacctgcagcaataatgtacaacatcctgggtgaggatgagggtgagacaggattctatctggctcatcagcttatcaggcgggcactaaacattccaggcgcatcaatccattggtatgcaaagccagagatgcggaagcaaaggaagatgggtcatattacaattgtggggtcttctaagacaagtgtaaaatcacgcttggataatttgctgcaaagcaactcgtctgatcccaagcaagttagccctcgtgtcgctattataatgggatctcagtctgatcttcctgtgatgaaagatgctgagagggttttgaaagagttcaacatatcttatgagcaaactattgtttctgcacatcgtacaccagagcggatgtatgattatgcgaaatcggctaaagacagaggttttgaggtcataattgcaggtgcaggtggagcagctcatttaccagggatggtagcttcattgacctctcttccagtaattggtgttcccatcaagacttcaacactatcaggatttgattccctcctatctattgtgcaaatgccaaaaggtattcctgttgcgactgttgctatcgggaatgcagaaaatgcaggtttgctggcagttaggattctggccgcaagagatccggagctttgggacagatag

SEQ ID NO: 20665 - protein, 538 aa, Sorghum bicolor
  misc_feature: Ceres ANNOT ID no. 8658001
  misc_feature: Down-regulated in shoot tissues in response to salicylic acid treatment
  misc_feature (28)..(532): SWISSPROT Homolog: EC 4.1.1.21 Phosphoribosylaminoimidazole carboxylase
  misc_feature (114)..(294): Pfam ID: ATP-grasp Pfam Description: ATP-grasp domain
  misc_feature (401)..(538): Pfam ID: AIRC Pfam Description: AIR carboxylase
MARPAGGPPVHGVCNTVVGVLGGGQLGKMLCQAASQMGIRIVILDPLPGCPASSVCDEHVVGSFTDGDTVREFAKKCGVLTVEIEHVDAATLERLEKQGVDCEPKASTIMIIQDKYRQKRHFSKCGIPLPDFMEVDTLHSIEEAGEKFGYPLMVKSKRLAYDGRGNAVAKTKEELSSVVASLGGFEHGLYVERWTPFVKELSVIVARSRDSSTVCYPVVETIHKENICHVVEAPAEVSDKIKKLATSVAEKAIKSLEGAGVFAVELFLTEEDQILVNEVAPRPHNSGHHTIESCYTSQYEQHLRAILGLPLGDPSMKAPAAIMYNILGEDEGETGFYLAHQLIRRALNIPGASIHWYAKPEMRKQRKMGHITIVGSSKTSVKSRLDNLLQSNSSDPKQVSPRVAIIMGSQSDLPVMKDAERVLKEFNISYEQTIVSAHRTPERMYDYAKSAKDRGFEVIIAGAGGAAHLPGMVASLTSLPVIGVPIKTSTLSGFDSLLSIVQMPKGIPVATVAIGNAENAGLLAVRILAARDPELWDR

SEQ ID NO: 20666 - DNA, 1767 bp, Sorghum bicolor
  misc_feature: Ceres ANNOT ID no. 8658075
  misc_feature: Up-regulated in shoot tissues in response to methyl jasmonate treatment
  misc_feature: Up-regulated in root tissues in response to methyl jasmonate treatment
  misc_feature: Encodes the peptide sequence at SEQ ID NO 20667
atggtggtggcgaggaagcagcagcagcatccgccgccgctgcacgccggcggcgcgcgtcggcggggaggctgtggcgtgagggtcgggcccgcgaggctggagggcctccccgccgcgtggccgggcgccgccgccgtcaaggtcaagtggcccgcgcccgggggcgcgctctcgcagatgctcacggggaagtgggcgcgcggggtcaccgccgtcgaggccgtcggcgccggcgggaccgtccgctgggagccgcgcgacggcaatcgattcaggctcgacgtcgtcgaccccgccggctcccgtggacgcccggagcgcggggtcttcttctccgtcctctatggattccaagaacaaggccggggcaaggagctggtgaggctggaggagatcgggacagccatgataagcctggaggagtgctgctgggagatgcaactgcagcagcaacgccagcagctggtggttgtccccatcagggtcaggaaggacggatgggcaagtgatgccatgctttatgtgaacgtggagctcgtggatgcgaacacgcgctctgacatcgaaagggcagtctcgtttagggagaagccgagaacgaacatggcgccacggccaacaatgcgagatagccggaagagcttggaagcagcggcctacgatgttcttgacctgaagcagctgcttgatctggctgagaaggaaggccgggtggccgtgtatgggaacaaaaggaactctgacaccagcagcgtgagcagcatcagtagtagtagtagcagcagcagcagcagcagcacgatcagtatcagcagtgctagcaccagcggcggcgcgagcccagagccggcatcgacgtcgaaacgccggttcctgccatggatgaggaggagcagggacttcgacaagaggagcaccgagtcgctctcccaagaactgtctatgaagtgcatggatgacgatccgatcggcagctgggagatgcgcgagttcacgagcagggacgccgagacgaagctcaagacgccggtgttcttcgcgtccatcgaccagcgcgacgacagcgccggcggggagagcgcgtgcacggcgctcgtcgccgtcctcgcggcggcgctccacgccaaccacccgacgatgcccacccggccggagctggacgcgctcatccgggacggctcgtcggagtggaggaagctctgcgacgacgaggcgcacatggcgcagttcccgaaccggcacttcgacctggacaccgtcctcgcgtcccggacgcggcccatcgcggtgcagcacgacagggccttcgtcggcttcttccagcctgagagcttcgcgtcgctgtccggcgccatgtcgttcgacgacatctggcgcgagatcagcggcggcgaacgcgagccgggccgcgccgacgtgtacatcgtcagctggaacgaccacttcttcgtgctcaaggtggagagcgactgctactacatcatcgacacgctcggcgagaggctgcacgagggctgcgacaaggcctacatgctgaggttcgacggctcgtcggagatgcaggccgagggcacacaggaggtgatcgtcaccgggaaggaatgctgcagggagttcatcaagagattcttggccgccatcccgctcagggaggagctggagatggagaaaaggggcgccggcagcatcgacggtggtggcgcgccgcaccggcggctgcagatcgagttccacttcacagtcctacgagacgacgataggtga

SEQ ID NO: 20667 - protein, 588 aa, Sorghum bicolor
  misc_feature: Ceres ANNOT ID no. 8658075
  misc_feature: Up-regulated in shoot tissues in response to methyl jasmonate treatment
  misc_feature: Up-regulated in root tissues in response to methyl jasmonate treatment
MVVARKQQQHPPPLHAGGARRRGGCGVRVGPARLEGLPAAWPGAAAVKVKWPAPGGALSQMLTGKWARGVTAVEAVGAGGTVRWEPRDGNRFRLDVVDPAGSRGRPERGVFFSVLYGFQEQGRGKELVRLEEIGTAMISLEECCWEMQLQQQRQQLVVVPIRVRKDGWASDAMLYVNVELVDANTRSDIERAVSFREKPRTNMAPRPTMRDSRKSLEAAAYDVLDLKQLLDLAEKEGRVAVYGNKRNSDTSSVSSISSSSSSSSSSSTISISSASTSGGASPEPASTSKRRFLPWMRRSRDFDKRSTESLSQELSMKCMDDDPIGSWEMREFTSRDAETKLKTPVFFASIDQRDDSAGGESACTALVAVLAAALHANHPTMPTRPELDALIRDGSSEWRKLCDDEAHMAQFPNRHFDLDTVLASRTRPIAVQHDRAFVGFFQPESFASLSGAMSFDDIWREISGGEREPGRADVYIVSWNDHFFVLKVESDCYYIIDTLGERLHEGCDKAYMLRFDGSSEMQAEGTQEVIVTGKECCREFIKRFLAAIPLREELEMEKRGAGSIDGGGAPHRRLQIEFHFTVLRDDDR

SEQ ID NO: 20668 - DNA, 1911 bp, Sorghum bicolor
  misc_feature: Ceres ANNOT ID no. 8658113
  misc_feature: Down-regulated in shoot tissues in response to aminocyclopropane carboxylic treatment
  misc_feature: Up-regulated in root tissues in response to methyl jasmonate treatment
  misc_feature: Down-regulated in shoot tissues in response to methyl jasmonate treatment
  misc_feature: Encodes the peptide sequence at SEQ ID NO 20669
atgatctccgctcgcgccgccaccgtcgccgccgcgtcccccgcctccccgtggaagcggggaggaggacggagcgagggtgccggcagctgcgacggatgcagcacctacaggaagaccgtgcggaggagggccgccgccgccaaggtgcgcgccttgccgccgaagcgggtggaggcggtcgcgataggctccgccgcggagacggagacggaggaggtggtggtggaggtggcggcggccaacgaggagctgcccgtcatgccctgggccacctctgtcgcaagcggttacacccttttgagggatccacgtcacaacaagggtcttgctttcacggagaaggagagggatgcacactacttgcgtggactgcttcctccggcagttgtctctcaggaactccaaattaagaagttcatgaacaacctgcggcagtaccagctccctattcagtgctatatggccatgatgaaccttcaggagacggacgagaggcttttctacaagcttttgattgaaaatgtggtggagctgcttccttatgtttacacaccaactgtaggtgaggcctgccagaagtatgggtccatctttggacgaccacagggtctgtatgtcagcctgaaggacaaggggagggtcctagaagttctaaggaactggccacataggaacgttcaagttatctgtgtcactgatggtgagcgaatcttgggacttggagatttgggttgtcagggaatgggaattcctgtaggcaaacttgctctatacactgctcttggaggagttgatccatcagcttgtttgcctatcacaattgatgttggcacaaataatgagaaactgcttaatgatgagttctacattggactccgacaaaaacgtgcaaggggcgaggagtatgatgagcttatggaagagttcatggctgctgttaagacattctacggtgagaaagtcctcattcagtttgaggactttgccaatcataatgcctttgatttgcttgaaaaatacagcaagacccatcttgttttcaatgatgatatccagggcacagcatcagtggtccttgcaggtttgttagcagcactcaagatggttggtgggaccctggcagagcagacttatttgttccttggtgctggggaggctggaactggtattgcagaactcattgctcttgagatgtcgaaacagacgaaggctccaattgaagagtgccgcaagaaggtttggctggtggactcaaaggggttgattgttgactctcgtaaaagctcccttgcgccattcaaaaaaccatgggcacatgagcacgagcccttgacaaccttgtatgatgctgttcagtccatcaaacctacagttctgattgggacatctggagttggaagaacattcacaaaagaaattgttgaggccatggcttccatcaatgagaggcctatcatcttttcactgtcaaacccaacctcacattctgaatgtactgctgaacaagcatatacctggactcagggtcgtgcagtatttgccagtggcagtccatttgcccccgtggagtatgatgggaagacttttgtacctgggcagtcgaacaatgcctacatcttccctggactcggcctcggtcttgttatttctggagccgtccgtgtccacgaggacatgcttcttgccgcctcggctgcactagctgatcaggccacagaggagaactttgtcacgggatcgatcttcccacccttcaccaacatcagaaagatctctgcgtacattgctgcagccgttgctgcaaaagcttatgaactcggtttggcgacccgtctgcctccccccaaagacctggtggcatatgcagagagctgcatgtactctcctgtctaccgtaactaccagtag

SEQ ID NO: 20669 - protein, 636 aa, Sorghum bicolor
  misc_feature: Ceres ANNOT ID no. 8658113
  misc_feature: Down-regulated in shoot tissues in response to aminocyclopropane carboxylic treatment
  misc_feature: Up-regulated in root tissues in response to methyl jasmonate treatment
  misc_feature: Down-regulated in shoot tissues in response to methyl jasmonate treatment
  misc_feature (17)..(636): SWISSPROT Homolog: EC 1.1.1.40 Malate dehydrogenase (oxaloacetate-decarboxylating) (NADP(+))
  misc_feature (352)..(605): Pfam ID: Malic_M Pfam Description: Malic enzyme, NAD binding domain
  misc_feature (161)..(350): Pfam ID: malic Pfam Description: Malic enzyme, N-terminal domain
MISARAATVAAASPASPWKRGGGRSEGAGSCDGCSTYRKTVRRRAAAAKVRALPPKRVEAVAIGSAAETETEEVVVEVAAANEELPVMPWATSVASGYTLLRDPRHNKGLAFTEKERDAHYLRGLLPPAVVSQELQIKKFMNNLRQYQLPIQCYMAMMNLQETDERLFYKLLIENVVELLPYVYTPTVGEACQKYGSIFGRPQGLYVSLKDKGRVLEVLRNWPHRNVQVICVTDGERILGLGDLGCQGMGIPVGKLALYTALGGVDPSACLPITIDVGTNNEKLLNDEFYIGLRQKRARGEEYDELMEEFMAAVKTFYGEKVLIQFEDFANHNAFDLLEKYSKTHLVFNDDIQGTASVVLAGLLAALKMVGGTLAEQTYLFLGAGEAGTGIAELIALEMSKQTKAPIEECRKKVWLVDSKGLIVDSRKSSLAPFKKPWAHEHEPLTTLYDAVQSIKPTVLIGTSGVGRTFTKEIVEAMASINERPIIFSLSNPTSHSECTAEQAYTWTQGRAVFASGSPFAPVEYDGKTFVPGQSNNAYIFPGLGLGLVISGAVRVHEDMLLAASAALADQATEENFVTGSIFPPFTNIRKISAYIAAAVAAKAYELGLATRLPPPKDLVAYAESCMYSPVYRNYQ

SEQ ID NO: 20670 - DNA, 1140 bp, Sorghum bicolor
  misc_feature: Ceres ANNOT ID no. 8658178
  misc_feature: Up-regulated in shoot tissues in response to methyl jasmonate treatment
  misc_feature: Up-regulated in shoot tissues in response to salicylic acid treatment
  misc_feature: Encodes the peptide sequence at SEQ ID NO 20671
atggcgtcctcctccctcccggcgcccgcgcccggccgcgccgagctcctcaaggccttcgacgacaaccgcacgggcgtgcgaggcctcgtggagtcgggcgtctcctccgtcccggagctcttccgccacccggacccatacggctccatcccgctcgccccgcctggcgcctccatccccgtcgtggacctctccctcccgccccacctcgccgccgccgccgccgcgtcggccgcccgcacctggggcttcttccacctcgtcaactaccaccacgcgctccccgcggccgcggccgcggccgctgccgccgccgccgacgactaccccgcgcgcgccttcgcggcggtgcgcgccttcaacgagctccccgccgccgagcgcgcgccgcactacagccgcactacaggcggggtcaactactcctccaacgtcgacctgtacaactcccccgcggccagctggcgcgacaccatccagatcctgttgggccccaaccgcagccccgacctcgccgaccggatcccggccgtctgccgcgccgaggtgctcgagtgggaggcccgcgccaccgccgtcgcgcgcaccttgctgggcctcctttcccaggggctcgggctcagggccgaggcgctggaggacgcgtcctgcgccgacgggaagctcatggtgtgccactactacccgcactgccctgagccggagcgcaccatgggcctcgtcccgcacacggaccccggcgtgctcaccgtgctcgcgcaggacgccgtcgggggcttgcaggtgaagcaccaggacgaggacggcaaaatctcctgggtggatgtgaagcccgtgcccggagcccttgtcatcaacgtcggcgacctcttgcagataatgtctaatgacaagtacacgagtgtagagcatcgggtggtcatgaacacacgtgaagaacccagggtttccatcggcatttttttcagtcctgggaagagaggggactcggtgttctatggaccattgccagagctggtttcttcagagaacccgcccaagtacagcaactttaccatgtccgagttttatgggaaattcttctcacgagaccttgcgagcaaagctctactcgataacttcaaactgtcatcttaa

SEQ ID NO: 20671 - protein, 379 aa, Sorghum bicolor
  misc_feature: Ceres ANNOT ID no. 8658178
  misc_feature: Up-regulated in shoot tissues in response to methyl jasmonate treatment
  misc_feature: Up-regulated in shoot tissues in response to salicylic acid treatment
  misc_feature (118)..(379): SWISSPROT Homolog: EC 1.14.11.20 Desacetoxyvindoline 4-hydroxylase
  misc_feature (220)..(325): Pfam ID: 2OG-FeII_Oxy Pfam Description: 2OG-Fe(II) oxygenase superfamily
MASSSLPAPAPGRAELLKAFDDNRTGVRGLVESGVSSVPELFRHPDPYGSIPLAPPGASIPVVDLSLPPHLAAAAAASAARTWGFFHLVNYHHALPAAAAAAAAAAADDYPARAFAAVRAFNELPAAERAPHYSRTTGGVNYSSNVDLYNSPAASWRDTIQILLGPNRSPDLADRIPAVCRAEVLEWEARATAVARTLLGLLSQGLGLRAEALEDASCADGKLMVCHYYPHCPEPERTMGLVPHTDPGVLTVLAQDAVGGLQVKHQDEDGKISWVDVKPVPGALVINVGDLLQIMSNDKYTSVEHRVVMNTREEPRVSIGIFFSPGKRGDSVFYGPLPELVSSENPPKYSNFTMSEFYGKFFSRDLASKALLDNFKLSS

SEQ ID NO: 20672 - DNA, 2490 bp, Sorghum bicolor
  misc_feature: Ceres ANNOT ID no. 8658274
  misc_feature: Down-regulated in shoot tissues in response to salicylic acid treatment
  misc_feature: Encodes the peptide sequence at SEQ ID NO 20673
atggcggcggcattcactgaagaggagaaggcggtggacgacgcgctgggctaccccaaggcctacgccaagctctgccgaggcggcggaggggcggtcggcctgccctacagccacggcccgccgcacgccttcctcccctacatcctccagccgcacgaggcgctgcgggccaaggacctgaacgagatgttcccggtgaccgacgcggaggcgccgcccaccgccaacccccgcggcttcgccaacctcctctggaagcagctcgaccacctcgggaacgccgggttcgatccggcgctcttccgggtggacgcgtacgggaacgtgctctacctgcacgccgactccgcctcgcccctcgcctgggacatcgaccactggttcccctgcgccaggggagggaagacagtgccgagcaacctgcggatagtgcagtggcaggtgtgcaggaagaagcagaacaagttagagttcctcatgccgtggtgggatctgcagctcggcgtctctgtcaaccagttcctgtccatcttcgcctccaagaactccgacttcagaaacagagcattcgcgttcttgttcacccatggtgccagcgaggagctgaactcgctgcaggtggtggaggcgcacgcgttcccgcagcacttctctgagatgaaaacgaaagtaggactcgcccctgctgcaattgtttcctctaggggttctgacaactcggtgctcaaatctcttgatgcgaaccgaccactcaggcctagttaccctttgattggtataaatttctttcatgcctttgattttgctgctaagaaatttacaggcgacagggatgagaatgtcaacctcgcaggacaggggcctaattccactaaggagaacaataacccagatgctgacggctacattagcaatccttacttgtccatagcaatggccagggactcactgaggcaacgagaagaggccaagaagaagcaggccgaacttacagaattggagaacgaggccaatgagctgaagcagatgaacgaagaggaacgggtggccatccagggcttggaggccctactaatcaagaggaggcggcgagttgagaagtgtcgtcgcttggcagaggctcagtccaactacaaggcagtgctggagaagatgatcagagatgccatgcaccagtccgttgtgtacaaggaacaacttaggctgaaccaagctgcaaccagcactctcatggccagattggaggcccaaagagcaatgtgtgactcatctgaaaccgagctccgtaagaagtaccaacatagagatgatttggagaggcagataaagccagaaaggaagaggtatcgtgttgatgatgggttgctcgaggaaaggctcagtgagagtgtaaagtatctttcagcaagaagattgaggagtagccctctcaagcaggaactgagggttttccttgaggaagatcagaggtattcagatgcatacatttccctaggtgaagaagaaattggagaaggaacttcaactcgtactcaagcattcagcaatgccagaaatgaaccatcgaaggtgataaacttcccgaggaggtctctttccattgaacagaacactgttgatactgaaagaggaagaaccctggtgcgggagaagctagaagagttggcgatcaaagaacgtcaacatagcaggagacgggagacaaaagagaccatgagatcgaggggaactggtacacctttaagatcaagaaatgacaaggctaaagcgaccctgcagaagtgctacgagtctgaaactgaaaaatatcatgtcagtgagacagtttcaataccgaggacctcatcacttccaagtccaccctatagagcaatcggcatgtatggaacttccagatacggtacagatcagtcaatgctactgcaaaagagtgaagcacttcatcacctaggttttagcagaccggaagatgatgaaaacatgaaccatgttggcaaaggaaatgtggataagtggctccatatgctcatggataaccaacaagaagatcatgctgtataccattcttcagatgaacatgataatgacgaggagaatgcttcagatgagcagcaaatgcagagcagaattgacgaagagagctgcaggaatggggtaactgaatgttctgatgagatcgttgaggtcgaggacgagattgtttctgaccaaggagcggaaagaggcaggaacagctttggaattaaagagagagaggaaaagaagatttggttccctaggtctgacagcaccaggggtttccggtcactgccatcatcaccctctaagatcctgggaatgagaagaggcgtggaatgcatgggcaggaagcctaaggtggctggcgacgatgactgcagatatggctatgaggattcagtgtccacaagcagcagcaagttcctcagcagatgcaagcaggcaatcaagaaagcagtacacaaatag

SEQ ID NO: 20673 - protein, 829 aa, Sorghum bicolor
  misc_feature: Ceres ANNOT ID no. 8658274
  misc_feature: Down-regulated in shoot tissues in response to salicylic acid treatment
  misc_feature (378)..(706): SWISSPROT Homolog: EC 5.2.1.8 Peptidylprolyl isomerase
MAAAFTEEEKAVDDALGYPKAYAKLCRGGGGAVGLPYSHGPPHAFLPYILQPHEALRAKDLNEMFPVTDAEAPPTANPRGFANLLWKQLDHLGNAGFDPALFRVDAYGNVLYLHADSASPLAWDIDHWFPCARGGKTVPSNLRIVQWQVCRKKQNKLEFLMPWWDLQLGVSVNQFLSIFASKNSDFRNRAFAFLFTHGASEELNSLQVVEAHAFPQHFSEMKTKVGLAPAAIVSSRGSDNSVLKSLDANRPLRPSYPLIGINFFHAFDFAAKKFTGDRDENVNLAGQGPNSTKENNNPDADGYISNPYLSIAMARDSLRQREEAKKKQAELTELENEANELKQMNEEERVAIQGLEALLIKRRRRVEKCRRLAEAQSNYKAVLEKMIRDAMHQSVVYKEQLRLNQAATSTLMARLEAQRAMCDSSETELRKKYQHRDDLERQIKPERKRYRVDDGLLEERLSESVKYLSARRLRSSPLKQELRVFLEEDQRYSDAYISLGEEEIGEGTSTRTQAFSNARNEPSKVINFPRRSLSIEQNTVDTERGRTLVREKLEELAIKERQHSRRRETKETMRSRGTGTPLRSRNDKAKATLQKCYESETEKYHVSETVSIPRTSSLPSPPYRAIGMYGTSRYGTDQSMLLQKSEALHHLGFSRPEDDENMNHVGKGNVDKWLHMLMDNQQEDHAVYHSSDEHDNDEENASDEQQMQSRIDEESCRNGVTECSDEIVEVEDEIVSDQGAERGRNSFGIKEREEKKIWFPRSDSTRGFRSLPSSPSKILGMRRGVECMGRKPKVAGDDDCRYGYEDSVSTSSSKFLSRCKQAIKKAVHK

SEQ ID NO: 20674 - DNA, 1641 bp, Sorghum bicolor
  misc_feature: Ceres ANNOT ID no. 8658618
  misc_feature: Up-regulated in root tissues in response to salicylic acid treatment
  misc_feature: Encodes the peptide sequence at SEQ ID NO 20675
atgggggagcccctcctcacctccctctccatggagaacagcaacagccacccctgcacgctgctctccatggaccctgctggctcgcacccggcctccgccgagtcctcaggtggtggcggtgttgccaccaatggggttggggttggggttggtagcggtggtgacagggaactcttcatcattccgcggcgtgagtcggcgcacccaggcccgccggacatcaacctcccgctctctgcagatcccttaccgccgcctccgtcatggagcctcgatacatttgacatacttgatgttactcttggaacacacaactatgagtctgaggttgcacttgcacttccaaagtcgacgggtaacagcaacggcaatggcagtgccactattggtgtcggcgcgaggaagtgtgctaagagaggagacagcatctggggtgcatggttcttctttaatcactacttcaagcctgcgcttgtggagaagcctaaggggaagatgacacgggatgcttccgggagcatctcgggcttcgacaagtctgatctccgccttgatgtcttcctggtgcagcatgacatggagaacatgtacatgtgggttttcaaggagcggcccgacaatgcccttgggaagatgcagctccggagcttcatgaatgggcattccaagcatggggagccatctttcccgttcagtgccgataagggctttgccaggtcacaccgtatgcagcggaagcactaccgtgggctatcgaacccgcagtgccttcatgggattgagatcgtgggctcaccaaatttgtcagcagttcctgaggcagacttgaagaggtgggctgaactgacaggcagggaacttaatttctcaataccatctgaagccagtgacttcgagtcatggaggaatcttcccagcactgattttgaacttgacaggccacatccaccggcagcaaagagtgccacacatggatctcatagccataagaagggattgaacggttcaggtctcaacctttcaactccgccatcatcagatgatgggatggacctttcaccaaaatgtgccaaacgccgcaaggatttctttggccatagtgtagaggaggactgtgtgatggcaaacaattcttgttctgacagagagcaagaggtagaagctcacactggtgagccatcatggatgcacgagttcactggtgtggccaagcatgcaagtgggcctgtcactgctgccaagacgatatacgaggatgaggaagggtacttaatcgtggtgagcatgcttttctctgatccacatagcgtcaaggtgtcctggaggaacacgctgacgcatggcatcgtgaagataacatgcgtgagcactgcccggatgccctacatcaagagacatgacaggatgttcaagctgacggaccctttccccgagcactgccctcctggtgagtttgtgagagagatacctctggccacacggattccagaagatgcaaagattgaggcgtattatgatgagacaggaactgggctggaaatcatggtcccaaagcaccgggttggaccagaggagcatgaagttcaggtgtgcatgaggcccccacatcttggtgacaacgatcttgtgctatcctag

SEQ ID NO: 20675 - protein, 546 aa, Sorghum bicolor
  misc_feature: Ceres ANNOT ID no. 8658618
  misc_feature: Up-regulated in root tissues in response to salicylic acid treatment
MGEPLLTSLSMENSNSHPCTLLSMDPAGSHPASAESSGGGGVATNGVGVGVGSGGDRELFIIPRRESAHPGPPDINLPLSADPLPPPPSWSLDTFDILDVTLGTHNYESEVALALPKSTGNSNGNGSATIGVGARKCAKRGDSIWGAWFFFNHYFKPALVEKPKGKMTRDASGSISGFDKSDLRLDVFLVQHDMENMYMWVFKERPDNALGKMQLRSFMNGHSKHGEPSFPFSADKGFARSHRMQRKHYRGLSNPQCLHGIEIVGSPNLSAVPEADLKRWAELTGRELNFSIPSEASDFESWRNLPSTDFELDRPHPPAAKSATHGSHSHKKGLNGSGLNLSTPPSSDDGMDLSPKCAKRRKDFFGHSVEEDCVMANNSCSDREQEVEAHTGEPSWMHEFTGVAKHASGPVTAAKTIYEDEEGYLIVVSMLFSDPHSVKVSWRNTLTHGIVKITCVSTARMPYIKRHDRMFKLTDPFPEHCPPGEFVREIPLATRIPEDAKIEAYYDETGTGLEIMVPKHRVGPEEHEVQVCMRPPHLGDNDLVLS

SEQ ID NO: 20676 - DNA, 2067 bp, Sorghum bicolor
  misc_feature: Ceres ANNOT ID no. 8658671
  misc_feature: Up-regulated in shoot tissues in response to salicylic acid treatment
  misc_feature: Encodes the peptide sequence at SEQ ID NO 20677
atgtcatcggtgacccgccctcggcgggaggccgactttgcgcgcttcccgtcgtccacccccatcgtcatcgacaacggcgcttctaccttccgcatcgggtgggcgggcgaggcggagccgcgcctttcattccgcaatgtcgtgcagaggccgcgccaccgcagcactggtgaaactgtttcaattgttggggacactgatccatctctaatgaagttctttgactgcacaagatcggcagttcgctctccatttgacgatgatgttgtctatcagttcgagtacatggaatatattcttgactatggctttgatcgattaggtgccaattcagaggttgggcatccaattcttatgacagaatgtgaatgtaatccgtccttttctcgagcccgaatgtcagaactacttttcgagacatatggtgtaccatccattgcatttggcatcgacaatgcgtttagttataagtacaatcagaaacttggaaactgtaatgaagacgggctgtttttgaaagggcagcctgtgttgggggcatgctgcagaaccaatgttggtggatttcacattactgattttttgagggcaagtattacatgggaaaaggctgaagagctgaagaaggagcattgttatatagctcttgattatatggcagagttgcagatatttaaaaacaataaggaagaagctgatgagaaaatgaggtattggcagctaccatgggttcccccaccaaaggaagaaccaccatctgaggaagaacttgcaaggaaagcagctttgaaggaaaaggctagtcaacgtttgcgagacatggctgctcaaaagagatctcagaagatagcggaactagaaaagcaactttcctatttggaggaagtaatggagcaacttgacgaagctgaggaacaagaagcaacagttattctaggtagatctggatatctttcccagcaggaaatcaaatctgccattttgaaagcaacacaatccctaaggaaagcaaaaggggagtccaatggcaacgatgagaagacagatgcctcagcagctgataagtatccgcttgtatctgtccctgatgagacgctgacgccagagcagttaaaggaaaagaagaaacagatattacttaaaaccacaacagagggcaaattgcgtgctaagcagaaacgtgctgaagaggaggctttacgggagaaacaagaagaaaagaggcgtgcggagaacccagagttataccttgaagagcttcgggcccgatattcagaactttctgagaagtttgagcagaggaagcgacagaaagttaatggtggtcagacaaatgggaaccatagttcatctggtggtgtaggacgtggagaacggttaaatgcagctcagaaagaaaggatgaggctgcttgcctcagctgcatttgatcggggcaaaggtgaggatacttttggtatgagagacgaggattggttagtctacaacaagatgagcaaagacaatgacgatgatagcaatgatgacgatgaatcggaacttgttcgaatcacatcaaagctccaggagatcgatcctacatttgtgtccaaatccgaagctgttcaactgactccggagcctcccaaagtccggccactcaccgcagaggattacagaattgccattgggattgagcggttccgctgccctgaagtcctcttccagccaggcatgataggaatcgaccaggccggcattgatgagatggtcagcatctcactcaggagattaatggaggatgagtctgtgaaggagcgcctctgccagtcaatccttgtcactggcggaagctccctgttccctggcatgatccctcggctggagtctgggatacggcaatatcggccctacctcgctcccctgaagcttgtcagagcagctgatcccattttagacgcgtggaggggtgctgctgcctttgcggcatcaagcaagtttggtaaacaaactttcagcctagcagattacagagagcatggagagaacttgtttcatcggcacaacattgtttactcactataa

SEQ ID NO: 20677 - protein, 688 aa, Sorghum bicolor
  misc_feature: Ceres ANNOT ID no. 8658671
  misc_feature: Up-regulated in shoot tissues in response to salicylic acid treatment
  misc_feature (22)..(146): SWISSPROT Homolog: EC 2.7.10.2 Non-specific protein-tyrosine kinase
  misc_feature (16)..(684): Pfam ID: Actin Pfam Description: Actin
MSSVTRPRREADFARFPSSTPIVIDNGASTFRIGWAGEAEPRLSFRNVVQRPRHRSTGETVSIVGDTDPSLMKFFDCTRSAVRSPFDDDVVYQFEYMEYILDYGFDRLGANSEVGHPILMTECECNPSFSRARMSELLFETYGVPSIAFGIDNAFSYKYNQKLGNCNEDGLFLKGQPVLGACCRTNVGGFHITDFLRASITWEKAEELKKEHCYIALDYMAELQIFKNNKEEADEKMRYWQLPWVPPPKEEPPSEEELARKAALKEKASQRLRDMAAQKRSQKIAELEKQLSYLEEVMEQLDEAEEQEATVILGRSGYLSQQEIKSAILKATQSLRKAKGESNGNDEKTDASAADKYPLVSVPDETLTPEQLKEKKKQILLKTTTEGKLRAKQKRAEEEALREKQEEKRRAENPELYLEELRARYSELSEKFEQRKRQKVNGGQTNGNHSSSGGVGRGERLNAAQKERMRLLASAAFDRGKGEDTFGMRDEDWLVYNKMSKDNDDDSNDDDESELVRITSKLQEIDPTFVSKSEAVQLTPEPPKVRPLTAEDYRIAIGIERFRCPEVLFQPGMIGIDQAGIDEMVSISLRRLMEDESVKERLCQSILVTGGSSLFPGMIPRLESGIRQYRPYLAPLKLVRAADPILDAWRGAAAFAASSKFGKQTFSLADYREHGENLFHRHNIVYSL

SEQ ID NO: 20678 - DNA, 801 bp, Sorghum bicolor
  misc_feature: Ceres ANNOT ID no. 8658682
  misc_feature: Down-regulated in shoot tissues in response to salicylic acid treatment
  misc_feature: Encodes the peptide sequence at SEQ ID NO 20679
atggccctcttcgccgccgcccgccgcgccgcggcctcatccgtccccatcctcctccgcgcctccgcctcctcggggtcccaccgcagcgccgccctgctccggcccctcgctgccgccgtggcgcggccaaagccccgcgcgatgccgttctcctcggcccccgcgacgaggcccagctccgacgccgagctactcagcgtcatcgactccgagatcaagtacgccgaggattgcgacgaccacgacagggttgaggagattccagataacttccctttcaaaatcagcgacgagaaggggacgaatgtagttacccttaaaagaacatatcagggtgagcagattgaggttgtggctcacatgcccagccttgtcactggagatgagcctgatcatgaccgtgatggtgaggacgagggtgaggacaaggagggagatgacgatgcggaagacgaaggccagaagcccgagcagtccagcgttcctctcacagtcactatcactaagggtgatggcccggtccttgaattcgcctgcaccgcctatcctgatgaggtcctcatcgacgccctgtccgtgacgcagccctcaggggatgatgaacatgacatgattgtgtatgagggtcctgatttcaatgaccttgatgagaacctgcagagggcattccacaagtacctggagctgcgtggcatttcacccatgaccacaaacttcttgcacgagtacatgatcaacaaggacagccgtgagtacctgctctggctgaggaagctgaaggattatttcaagcagtag

SEQ ID NO: 20679 - protein, 266 aa, Sorghum bicolor
  misc_feature: Ceres ANNOT ID no. 8658682
  misc_feature: Down-regulated in shoot tissues in response to salicylic acid treatment
  misc_feature (69)..(264): Pfam ID: MAM33 Pfam Description: Mitochondrial glycoprotein
MALFAAARRAAASSVPILLRASASSGSHRSAALLRPLAAAVARPKPRAMPFSSAPATRPSSDAELLSVIDSEIKYAEDCDDHDRVEEIPDNFPFKISDEKGTNVVTLKRTYQGEQIEVVAHMPSLVTGDEPDHDRDGEDEGEDKEGDDDAEDEGQKPEQSSVPLTVTITKGDGPVLEFACTAYPDEVLIDALSVTQPSGDDEHDMIVYEGPDFNDLDENLQRAFHKYLELRGISPMTTNFLHEYMINKDSREYLLWLRKLKDYFKQ

SEQ ID NO: 20680 - DNA, 1284 bp, Sorghum bicolor
  misc_feature: Ceres ANNOT ID no. 8658759
  misc_feature: Up-regulated in root tissues in response to methyl jasmonate treatment
  misc_feature: Up-regulated in shoot tissues in response to methyl jasmonate treatment
  misc_feature: Down-regulated in shoot tissues in response to salicylic acid treatment
  misc_feature: Encodes the peptide sequence at SEQ ID NO 20681
atggacccgtctctctcctcgtcgcctctccgcctctccgcaacccccgccggcccgggcgcgacccttaccaccccgaagcccaccctcgtggcggccgccggccccggccgccagcccaccaccaccaccacctgcctccgcgccatctcgccgtccccgtccccgcccacccccgtggagtcgttcggcttcgacgcgctcaaggagaccttctccgtggacgtggcggccgccgacgcgcgcccgctcgacgtcccgctcgccgcgcccttcaccatcgcgtcctcccgcctcgtcgcggtgagcaacgtcgccgtgcgcgtcgagctccgcagcggcgccgtcgggtggggggaggcgcccgtgctgccttccgtcaccgccgaggaccagcccgcggcgctcgacgccgccggacgggcgtgcgccgcgctcgaggacgcctccgcggcgccactcggcgcgctgctccaggacgtcgccagtgtgctccccggacacgccttcgcctcggccagagcaggagtggagatggcgctgattgacgcggttgctaatagcattcgcataccgctatggagattattcggaggagcatcagatagtgtgacaactgacatcacaattccaattgtgaccccaaatgaagctgctcagttggctgcaaaatatcgtggacaagggtttcaaactctgaagctcaaggttgggaagaacttgaattcagatatagaagttctgaaagctattcgacttgtccatccagattgctcatttattttggatgcaaatgagggatacacagcaaatcaagcaattgaagttcttgatagactaaatgaaatgggagtgacccctgtgctctttgagcaaccagttcacagggatgattgggacggtctccgagatgttagctctgtggccatggagaaatacaaagttgctgttgctgctgatgaaagctgtcggagtttacttgatgctcagaaaataatacaagggaatcttgcccatgttattaacatcaagctggcaaagttggggattcttggagccctagaaataattgatgctgcaagaaaagccaatatttctctgatgatcggtggcatggtcgagactaggattgctatgggctttgctggtcatttagctgctgggcttggatgctttagtttcgttgacctggacacacctcttttactctctgaagatcctgtgtatggtggctatgaaggactggatttgttcccccccccccccccccccccaaatgaataa

SEQ ID NO: 20681 - protein, 427 aa, Sorghum bicolor
  misc_feature: Ceres ANNOT ID no. 8658759
  misc_feature: Up-regulated in root tissues in response to methyl jasmonate treatment
  misc_feature: Up-regulated in shoot tissues in response to methyl jasmonate treatment
  misc_feature: Down-regulated in shoot tissues in response to salicylic acid treatment
  misc_feature (74)..(406): SWISSPROT Homolog: EC 5.5.1.1 Muconate cycloisomerase
  misc_feature (215)..(310): Pfam ID: MR_MLE Pfam Description: Mandelate racemase / muconate lactonizing enzyme, C-terminal domain
  misc_feature (78)..(198): Pfam ID: MR_MLE_N Pfam Description: Mandelate racemase / muconate lactonizing enzyme, N-terminal domain
MDPSLSSSPLRLSATPAGPGATLTTPKPTLVAAAGPGRQPTTTTTCLRAISPSPSPPTPVESFGFDALKETFSVDVAAADARPLDVPLAAPFTIASSRLVAVSNVAVRVELRSGAVGWGEAPVLPSVTAEDQPAALDAAGRACAALEDASAAPLGALLQDVASVLPGHAFASARAGVEMALIDAVANSIRIPLWRLFGGASDSVTTDITIPIVTPNEAAQLAAKYRGQGFQTLKLKVGKNLNSDIEVLKAIRLVHPDCSFILDANEGYTANQAIEVLDRLNEMGVTPVLFEQPVHRDDWDGLRDVSSVAMEKYKVAVAADESCRSLLDAQKIIQGNLAHVINIKLAKLGILGALEIIDAARKANISLMIGGMVETRIAMGFAGHLAAGLGCFSFVDLDTPLLLSEDPVYGGYEGLDLFPPPPPPPNE

SEQ ID NO: 20682 - DNA, 1323 bp, Sorghum bicolor
  misc_feature: Ceres ANNOT ID no. 8658839
  misc_feature: Up-regulated in shoot tissues in response to salicylic acid treatment
  misc_feature: Encodes the peptide sequence at SEQ ID NO 20683
atggcggcgccgaagcgtctccacaacgggtacgaccacgacggcgaccagcccgacgacaagcgcatgcgccgcctgccgtccttctcgacgtacaagcacatgcagagcctgttcaggtgcctggagcctctcctccgccgagtggtgcaggaggagctgcaggcagggctgatgcagagcccgcgctacatcgagaggcttcccgagacgccgccggtggcggagcgtgcggcgtggaaactggcgttccggacgccgccgcagctgccgatcttcacgggcagcaagatcgaggacgaggccgggaacccactggaggtgatcctggtggacgcggacaccggttcgccggccttgctcccgcagcaggcggcgctgcgcgtcgaggtggttcccgtgttcggcgacttcccgcccgacggtcgcgaggactggtccgccgacgagttccagcggaacgtcgtcaaggagcgcgagggcaagcgcccgctcctgacgggcgatgtgagcctgaccatgcgcgacgggcgcgccaccgtgggcgagctccagttcacggacaactcgtcctgggtccgctgccgcaagttccgcatcgcggtacgcgcggtccccggcaccacctgcggcgacggcgcccggatccaggaggccatgacggaggccttcatggtcagggaccaccgcggcgagctctaccgcaagcactacccgcccgtcctcgccgacgacgtctggaggctggagaagatcggcaaggaaggcgcgttccacaggaagctcaagcgcagcaacgtcggcaacgtgcaggagttcgtccggatgctcatggtgaagcccgacgagctgcgcgcgattctgggcgacggcatgaccgaccgtatgtgggaggcgacgaccaaccacgccaagacctgcctccccggcgacaaggtgtacgcgcacgtcacacagcacggcaccatctacctgaactccatcttcaacatcctgagggtcgacaccagcggcgtcgagtggccgctgcagcagctcaacaggggacagacgcagatgctgctggacgcgtacgagcaccgccacagcctgcaggaggccgaagccttcatgctccatggccacgccgccaacaacaacgttccactgctgcagaatgcagcagcacatgtcgcgctgccggcgccggcggacaccccgctctggttcccgaacgccgcggagatggacttccccgtcgacgacgtggttgtccccattccccaagccaacaacagcttcgcctaccagtggcctggccaagcgttccacatggcaggttaa

SEQ ID NO: 20683 - protein, 440 aa, Sorghum bicolor
  misc_feature: Ceres ANNOT ID no. 8658839
  misc_feature: Up-regulated in shoot tissues in response to salicylic acid treatment
  misc_feature (77)..(376): Pfam ID: Calmodulin_bind Pfam Description: Calmodulin binding protein-like
MAAPKRLHNGYDHDGDQPDDKRMRRLPSFSTYKHMQSLFRCLEPLLRRVVQEELQAGLMQSPRYIERLPETPPVAERAAWKLAFRTPPQLPIFTGSKIEDEAGNPLEVILVDADTGSPALLPQQAALRVEVVPVFGDFPPDGREDWSADEFQRNVVKEREGKRPLLTGDVSLTMRDGRATVGELQFTDNSSWVRCRKFRIAVRAVPGTTCGDGARIQEAMTEAFMVRDHRGELYRKHYPPVLADDVWRLEKIGKEGAFHRKLKRSNVGNVQEFVRMLMVKPDELRAILGDGMTDRMWEATTNHAKTCLPGDKVYAHVTQHGTIYLNSIFNILRVDTSGVEWPLQQLNRGQTQMLLDAYEHRHSLQEAEAFMLHGHAANNNVPLLQNAAAHVALPAPADTPLWFPNAAEMDFPVDDVVVPIPQANNSFAYQWPGQAFHMAG

SEQ ID NO: 20684 - DNA, 708 bp, Sorghum bicolor
  misc_feature: Ceres ANNOT ID no. 8658911
  misc_feature: Down-regulated in shoot tissues in response to salicylic acid treatment
  misc_feature: Encodes the peptide sequence at SEQ ID NO 20685
atggcgccctgcgcgtccccgtccgccctcgcgctcaccgccagcacgcgggtcagcagcagcctccaactgacgctggcctcgccgcggccgcggccggaggcgcgtgtgccgcgcgcgcccggcgcccagctccgcccgttgaccgcgtgctcttggccgcgccgccccttgctgcccgagctcgcggcggccggcggcggcgcccgtggtaccggcagggcgcagccgctgttccggcctcgcgcattgatgacgacgtctcagattgccagctgtgccttcaccctgggcaccgtcgccgtcctccccttctacaccctcatggtcgtcgcccccaacgccgacatcaccaagcgcaccgtggagagcagcgctccctacgtcgccttaggcctcctctacgcctacctgctctacctgtcctggacccccgacaccctgcgcgccatgttcgccagcaagtactggctccctgagttgccgggcatcgttaggatgtttgcgagcgagatgaccgtcgcctctgcctggatccacctcctagcagtcgacctctttgcggcaaggcaggtgtaccacgacggcctcaagaacaacatcgagacgaggcattcggtctcgctgtgcctgctcttctgcccggttgggatcctggctcatgtggtgaccaaggtattgacaggggcagttggccgctcacattga

SEQ ID NO: 20685 - protein, 235 aa, Sorghum bicolor
  misc_feature: Ceres ANNOT ID no. 8658911
  misc_feature: Down-regulated in shoot tissues in response to salicylic acid treatment
MAPCASPSALALTASTRVSSSLQLTLASPRPRPEARVPRAPGAQLRPLTACSWPRRPLLPELAAAGGGARGTGRAQPLFRPRALMTTSQIASCAFTLGTVAVLPFYTLMVVAPNADITKRTVESSAPYVALGLLYAYLLYLSWTPDTLRAMFASKYWLPELPGIVRMFASEMTVASAWIHLLAVDLFAARQVYHDGLKNNIETRHSVSLCLLFCPVGILAHVVTKVLTGAVGRSH

SEQ ID NO: 20686 - DNA, 2958 bp, Sorghum bicolor
  misc_feature: Ceres ANNOT ID no. 8658949
  misc_feature: Down-regulated in root tissues in response to methyl jasmonate treatment
  misc_feature: Up-regulated in shoot tissues in response to methyl jasmonate treatment
  misc_feature: Encodes the peptide sequence at SEQ ID NO 20687
atggaaaatcgaccaaatggttcagtaaataatgctgagcataataatcaggaaaatgagaagtccatggatgctagtgagcctgaagaagcacgagatgtttttgtttacagagaagatgttgtgagtttgaagtccaaggaggatgtccgtggattagttttggaggtagctggggagtatgattctgaaggtagcatcactgatgatgatattgatactgatgaacataaagataataaatctgctcatggagctgaaaatggtggtgctgatggtgataatgctagtaatggagctgaagttgaaagccagagttctttgcctgatgacaaagttcgagtgttatggatagatggtagtgagaagacagaagacattgatgaggtagttgttgttgatagaagtttccttcatggagatttagttgcctctgcctcagacccaactggtcagatggggcttgttttggatgtcaatcttgtggttgatttgcaaggtgccaatggcgatacgataaagggtgtatcttccaaggatttgagacgaatcagggaattcaatgtgggtgattatgtcgtctctgggctatggcttggtcgagttgatgaagtgctagataatgttaatgtgttgtttgatgatggctctgtatgtaaagttaatagggcagatcctatgcgcttaaagccagcatttggcccaattcatccagatacagcttgtcctttttatccaggacagcgtgtgaaggcagtgtcatcatctgttttcaaaacatccaggtggcttaatggattgtggagagcatgtcgtcttgaaggtactgtcacaaaagtggaaagtgctgctgttatagtctattggatggcatcagcacactttgctacagatcagcaacctgttcctccagaggagcagaacccaaaggaccttactcttttgtcttgtttctcatatgcaaactggcaattaactgactggtgtcttcctcaccgatacacttcatgtactaatgataccatggttaattctgataaacatacaaggcagatatgtacatgctcacaaagctcagctccactgtctgatattccagaatctcaagttgatgttcaggctgaacaagatcaaatgactgatacagatgcaggtcacaagcagacagatgttgattctactgcagatggattgagtatgtcggatggagataattcatgcatagccaaagaatcagaaacaggaactagtgtatcaagcatcccaaagttgggtccacaggacaatgcaacatccagaaaaaagtttaggaaagtgtttctaaaaaaggacaaaagaacaaaaaaaagagacgacagctttgagcgagctctactcatcgcaaatacctgtaccaaagttgatgtagtctggcaggacgggacaaaggaatgtggagtagctgcaacatcgttgatccctatccacagtccaaatgaccatgatttcttcccggagcagtatgttgtggacaaggtcacaaatgatgatgattcttctgaaccaaggcgtgtgggtcttgttagaagcgttaatgctaaggaccgaacagtaactgtatcatggtttaagccttcactacgtctagaggagccaatggagatcgggtgtaatgaagttgtgagtgcatatgaactggatggccatccggattatgattattgctatggagatattgtcgtccgcttgccgcctgtttcacctgtaattgaatcaaccaataacaaggaccaaatggaactggataagacggtagattcctcggaaggatttgctacttcgaatgatgcaccccctgatactagtgcagacgaacagctttcacagaaggaatactgctcgcagtttacaagcctctcatgggctggaaatatagttggctttcaagatggtgagattgaaatcatttggggtgatggctcgatttcaaaggttgggcctcatgaaatatatgttgttggtcgtgaagatgatggagcctcactagatgatggaacagcctctgatggtgctagctgggagactcttgatgacaacgaaatggatgtacttgatgattctgcaaagtgtcctccagatcaccactaccttgaaaacacagcccaggtaaacaaaatgttctggcagggtacaggtggaagaaagtgggtcaaaaaggtacagcaggaatggagcatacttgagaagaacctaccagactatatttatgtcagggtatttgaggatcgcatggatctcttgagagctgtgattgttggagcaagcggaacaccctaccaagatggcctgttcttctttgatttccaccttccacctgagtacccagaagtccctccgtcagcatactatcattctggtggtttgcgtgtaaatccaaacctgtatgtggacgggaaggtttgtttaagtctcttaaatacttggactggcagagggaatgaagtgtgggataaatcatcatcaagtattctccaagtgctagtttcacttcagggattggttctcaatgaaaaaccctattttaatgaggctgggtatgagaagcaagttggtactgttgaaggggagaagaatgcagtgccgtataatgagaatacatacctgctgagcgtgaaatctatgctgtatatattgagacggcctcctttgcattttgaggattttgtgaagagccatttccgcaagcgtggccactacatccttaaagcttgtgaggcctatttgcaaggaaatgttgtgggcactctcactgacgacgcatgccccaccgagagaagcaaggagcactcgagctctgttggcttcaagcttgcactagcaaagattctacctcggctgattacagccctgaaggacactggagccgactgcgaccaatacgagcaccttgggaaaacagaaacagttagagaaagctga

SEQ ID NO: 20687 - protein, 985 aa, Sorghum bicolor
  misc_feature: Ceres ANNOT ID no. 8658949
  misc_feature: Down-regulated in root tissues in response to methyl jasmonate treatment
  misc_feature: Up-regulated in shoot tissues in response to methyl jasmonate treatment
  misc_feature (718)..(944): SWISSPROT Homolog: EC 6.3.2.19 Ubiquitin--protein ligase
  misc_feature (732)..(881): Pfam ID: UQ_con Pfam Description: Ubiquitin-conjugating enzyme
MENRPNGSVNNAEHNNQENEKSMDASEPEEARDVFVYREDVVSLKSKEDVRGLVLEVAGEYDSEGSITDDDIDTDEHKDNKSAHGAENGGADGDNASNGAEVESQSSLPDDKVRVLWIDGSEKTEDIDEVVVVDRSFLHGDLVASASDPTGQMGLVLDVNLVVDLQGANGDTIKGVSSKDLRRIREFNVGDYVVSGLWLGRVDEVLDNVNVLFDDGSVCKVNRADPMRLKPAFGPIHPDTACPFYPGQRVKAVSSSVFKTSRWLNGLWRACRLEGTVTKVESAAVIVYWMASAHFATDQQPVPPEEQNPKDLTLLSCFSYANWQLTDWCLPHRYTSCTNDTMVNSDKHTRQICTCSQSSAPLSDIPESQVDVQAEQDQMTDTDAGHKQTDVDSTADGLSMSDGDNSCIAKESETGTSVSSIPKLGPQDNATSRKKFRKVFLKKDKRTKKRDDSFERALLIANTCTKVDVVWQDGTKECGVAATSLIPIHSPNDHDFFPEQYVVDKVTNDDDSSEPRRVGLVRSVNAKDRTVTVSWFKPSLRLEEPMEIGCNEVVSAYELDGHPDYDYCYGDIVVRLPPVSPVIESTNNKDQMELDKTVDSSEGFATSNDAPPDTSADEQLSQKEYCSQFTSLSWAGNIVGFQDGEIEIIWGDGSISKVGPHEIYVVGREDDGASLDDGTASDGASWETLDDNEMDVLDDSAKCPPDHHYLENTAQVNKMFWQGTGGRKWVKKVQQEWSILEKNLPDYIYVRVFEDRMDLLRAVIVGASGTPYQDGLFFFDFHLPPEYPEVPPSAYYHSGGLRVNPNLYVDGKVCLSLLNTWTGRGNEVWDKSSSSILQVLVSLQGLVLNEKPYFNEAGYEKQVGTVEGEKNAVPYNENTYLLSVKSMLYILRRPPLHFEDFVKSHFRKRGHYILKACEAYLQGNVVGTLTDDACPTERSKEHSSSVGFKLALAKILPRLITALKDTGADCDQYEHLGKTETVRES

SEQ ID NO: 20688 - DNA, 1620 bp, Sorghum bicolor
  misc_feature: Ceres ANNOT ID no. 8659077
  misc_feature: Down-regulated in shoot tissues in response to aminocyclopropane carboxylic treatment
  misc_feature: Up-regulated in shoot tissues in response to methyl jasmonate treatment
  misc_feature: Down-regulated in shoot tissues in response to salicylic acid treatment
  misc_feature: Up-regulated in shoot tissues in response to salicylic acid treatment
  misc_feature: Encodes the peptide sequence at SEQ ID NO 20689
atgggcggcgatccggggaaagtcatcaagaacatgaagggcgcggcgcagaagtacctcggcgttggcttcctcctcggcttcttcctcgtgctcctcacctacttcaccgtctccgagcagttcgccatcacggcgcccaacgctgttcggagggcatcaccggggcacgcgcacacctcggcgtcaccgatcaccccggccgttgaagagaagaggcagcaggaggcccctgtcatagaggagaagccacccaaggcagagcttgcaccagaggagaagcctccaaatgcagagcaggaggaggcccaagagaatcccccacgcgttgaggttgaagagccccacgctgaaacagagatggaccagcagaagcctgtctcagatgacgatgatggtaggaggagcagtagtatcgtcggcggcgatgacagtgctccggcgaagaagccggcgtgcgacatccagggtccatgggcgtccgacgtgtgcgacatcgacggcgacgtgcggatccacggctccgcgggcaccgtcctgatcgctccgtccatcgagagcggcggccgcaacccgaacacgcaggagtggcgcatccgcccttactcccggaagcaccagcccgggatcaaggaggtgacggtgcgcgagctggcgtcggccggcgacgcgccgccgtgcgacgtccgttcccccgtgccggcgctggtgctggccatgggcgggctgtcgggcaactactggcacgacttcagcgacatcctgatcccgctctacctccaggcggcgcggttcgacggcgaggtgcagctcgtcgtggagaacatccagccgtggtacgtcggcaagtaccggaccatcctgcgtcgcctgtcgcggcacgacgtcgtggacatggacaaggacgaccgcgtgcggtgcttcccgggcgccgtggtgggcatccggatgcacaaggagttcagcatcgacccggagcgggagccccggggccactccatgccggagttcaccgcgttcctccgggagaccttctcgctcccgcgcgccgcgccgacgaggctgacggccgccggcggcgaggacgaggaggacgagcgggtgaagccgcggatgatgatcatctcgcggcggcacccgcggaagctggtgaacgtggacgacgtggtggccctggcgcggcgcgtcgggttcgaggtggtgatcggtgacccgcccttcaacgtcgacgtcggggagttcgccagggaggtgaacgccgtggacgtgctggtgggcgtgcacggcgccgggctgaccaactcgctgttcctcccgacgggcgccgtgttcatccagatcaacccgtacggaaagatggagcacatcggggaggtggacttcggcatccccgccgtggacatggggctcaagtacatggcctactccgccggcgtggaggagagcacgctggtggacacgctgggccgggaccaccccgccgtcagggacccggagtccatccaccggagcgggtgggggaaggtggccgagttctacctcggcaagcaggacatccggctggacctccagcggttcgagcctgtgctccgcaaggccatgcagctcctcagggagtag

SEQ ID NO: 20689 - protein, 539 aa, Sorghum bicolor
  misc_feature: Ceres ANNOT ID no. 8659077
  misc_feature: Down-regulated in shoot tissues in response to aminocyclopropane carboxylic treatment
  misc_feature: Up-regulated in shoot tissues in response to methyl jasmonate treatment
  misc_feature: Down-regulated in shoot tissues in response to salicylic acid treatment
  misc_feature: Up-regulated in shoot tissues in response to salicylic acid treatment
MGGDPGKVIKNMKGAAQKYLGVGFLLGFFLVLLTYFTVSEQFAITAPNAVRRASPGHAHTSASPITPAVEEKRQQEAPVIEEKPPKAELAPEEKPPNAEQEEAQENPPRVEVEEPHAETEMDQQKPVSDDDDGRRSSSIVGGDDSAPAKKPACDIQGPWASDVCDIDGDVRIHGSAGTVLIAPSIESGGRNPNTQEWRIRPYSRKHQPGIKEVTVRELASAGDAPPCDVRSPVPALVLAMGGLSGNYWHDFSDILIPLYLQAARFDGEVQLVVENIQPWYVGKYRTILRRLSRHDVVDMDKDDRVRCFPGAVVGIRMHKEFSIDPEREPRGHSMPEFTAFLRETFSLPRAAPTRLTAAGGEDEEDERVKPRMMIISRRHPRKLVNVDDVVALARRVGFEVVIGDPPFNVDVGEFAREVNAVDVLVGVHGAGLTNSLFLPTGAVFIQINPYGKMEHIGEVDFGIPAVDMGLKYMAYSAGVEESTLVDTLGRDHPAVRDPESIHRSGWGKVAEFYLGKQDIRLDLQRFEPVLRKAMQLLRE

SEQ ID NO: 20690 - DNA, 2166 bp, Sorghum bicolor
  misc_feature: Ceres ANNOT ID no. 8659187
  misc_feature: Down-regulated in root tissues in response to salicylic acid treatment
  misc_feature: Encodes the peptide sequence at SEQ ID NO 20691
atggagtgcaacagagatgaggctgctagagtgaaagctcttgcagaaagaaaaatgctggacaaggattttgttggtgcaaaaaagatgattatcaaggtgcagcaactcgtcaaagaagtggatgaagttgacatttcaaaaatgttaactgtttgtgatgttcattgtgctgctggagctaaggtaaataacgaggttgattggtatggaatactgcaagtacctgtaaatgctgatgacacactgataaagaagcagtattgtaagctttcccttttgctacatccttacaagaacaagtttggaggtgcagaggcagcattcaagttagttggagaagcaaacataactcttacagaccggtcaaaacgttctgtgcatgacatgaaaagaaacaccttcagaagcattataacgagacccaatcatcagtcaccaaaaagacttcaacatcagcatcaaacctcaaatcctaaagggctgcaaacagcattttggactatttgtcctgcttgtggcatgagatatcagtactacctctcgatcttgaagaaggctttctgctgtcagaattgtttgaagccatttagtgcacatgatttgaaggaccaaggtattccttctgggacaaatcagcgatctgctggggtttggaaaaatgcaggtgcaccacagaattttacaggccctcaatcaaatggcactggtcagaaaggtgggctgaaaaacaaaatgaaatctgcccgggccaccaggaatccttcaaaagctccaactgctggattgaaaaggggcaggagggtggcatttgaatctagtgagtctagcatatcagaaaccagcagcgacagtgaggaagaagttctaaaacatggtctttctgaaaatagtacagggccagctcaacaaactcgcagatctagcaggcagaagcaagaagttaggtgtaatgaggatagtgatgatggcgatgttgaagatgatgataacacggttgaggatgattttgttggctctcctgctttgaagaggttaagaagtggcctggttcacggtgattactgtactaaaacagcaaagctgaatgaaggcaccgctggccgtaatggtctgagtaactgcagtaacataaaagatacaaagaacagtggtacaccatgtgaagagaaaacttctgatggagttgagcacatgaagagagaaacaatgcatgctcgagaaaatagtgatggcaaagaagaggcttttccttctgctaatccagaatgcagttctgttagaagtcaggaccgtgactccaaacatgctggtttgtccagtggagatcgcaaaggatccatgaatgtggggcaggggcaacatacaaaatccgtgaatgcagggatccctgcaaagacaccagaggaagagaaaatcaagcataacactcatctgcctgaagttacagatgtcgatgccgatgatgataacatttgccaaacagtgtatgtatgtgctgagtcagaattctttgatttttcagaaataagattgctccaaaggttttcacatgggcagatctgggctctctacagtgatatagataaatttcccaaatattatgcattcatacagaaagtagatctcaagaatgatgaagtacaagttagatggctggatgtctgtcctcatggagaagtggtgaaaagattgtcccaagaagaacggaccattggcattggagcctttaggctttccaatgtccatgagatgatgacttacactggtacagatgccttttctcatcgtgttgaggccagatatgctggcagaaaaggcgaatatgaaatacttcctcgtcttggtgagatatgggcggtttacaaaaactggggagctggatggactgcacaggattttgaaaattgtgaatatgaactggtggagatactttgccgtactgattcctccatacaagttcagcttctgaggaaggtggatggttataagatggtatttatgtcatacagagcagagggttctgtgatgacaataaggaaggatgagtaccccaagttctctcaccagattccctgctttcgtttcacacatgaaaaaggtggcaagcttcgaggctatttggagcttgatccattatcactaccagagaaatttctctactga

SEQ ID NO: 20691 - protein, 721 aa, Sorghum bicolor
  misc_feature: Ceres ANNOT ID no. 8659187
  misc_feature: Down-regulated in root tissues in response to salicylic acid treatment
  misc_feature (68)..(129): Pfam ID: DnaJ Pfam Description: DnaJ domain
MECNRDEAARVKALAERKMLDKDFVGAKKMIIKVQQLVKEVDEVDISKMLTVCDVHCAAGAKVNNEVDWYGILQVPVNADDTLIKKQYCKLSLLLHPYKNKFGGAEAAFKLVGEANITLTDRSKRSVHDMKRNTFRSIITRPNHQSPKRLQHQHQTSNPKGLQTAFWTICPACGMRYQYYLSILKKAFCCQNCLKPFSAHDLKDQGIPSGTNQRSAGVWKNAGAPQNFTGPQSNGTGQKGGLKNKMKSARATRNPSKAPTAGLKRGRRVAFESSESSISETSSDSEEEVLKHGLSENSTGPAQQTRRSSRQKQEVRCNEDSDDGDVEDDDNTVEDDFVGSPALKRLRSGLVHGDYCTKTAKLNEGTAGRNGLSNCSNIKDTKNSGTPCEEKTSDGVEHMKRETMHARENSDGKEEAFPSANPECSSVRSQDRDSKHAGLSSGDRKGSMNVGQGQHTKSVNAGIPAKTPEEEKIKHNTHLPEVTDVDADDDNICQTVYVCAESEFFDFSEIRLLQRFSHGQIWALYSDIDKFPKYYAFIQKVDLKNDEVQVRWLDVCPHGEVVKRLSQEERTIGIGAFRLSNVHEMMTYTGTDAFSHRVEARYAGRKGEYEILPRLGEIWAVYKNWGAGWTAQDFENCEYELVEILCRTDSSIQVQLLRKVDGYKMVFMSYRAEGSVMTIRKDEYPKFSHQIPCFRFTHEKGGKLRGYLELDPLSLPEKFLY

SEQ ID NO: 20692 - DNA, 2793 bp, Sorghum bicolor
  misc_feature: Ceres ANNOT ID no. 8659221
  misc_feature: Up-regulated in root tissues in response to salicylic acid treatment
  misc_feature: Encodes the peptide sequence at SEQ ID NO 20693
atggccctcatgagcttccagatgggcgatctggccacgcgtgtgtcggccctggacggtcgggatctgcctacagccgcgcagttcccacagctgccgatgtcaagcgcgggtcatcttccctcgctgcaggcaccgtccttaccgctgggcgtgcatccatctgccccggttcccatccagcagccatggatgccgccccctccatcgattacatcttatgctctagcatcgacgatggggctggtgcacacgatggcaagcaccccggcggccacgacaacggttgctccagcaccctccaccagcgctgttgtcctccccggtgtatcaaccatccagcatccattcaccgatgggatcttctataggggtgccagcttccagcagatccgagatgagggcgagatgctgcagcagaccgagcagccgatggtgacggagctgacagggaagatgcttcgctgccaggtgtcggcggcagtgcagctgcaagctgctgtgcgtggcctccttgcacgtcggcgggtgcagaagatgcgcgatctgccgctgattcagccctgcacctatttgcagctccaccatgtggaggactgcgatctcatccgctgcgtcggggattttcagaatgtggttccgcccacgggcagcgtgcatgctgtttttcccgcgggtggtggactcaaagtcttcggcgtcggtagttggaagccctatgctcttctatgtgcggtgcagaccagcagccgtccagtaaggagaaggcatggtgtcatcggtgggagcgcactacctagcgccgccagattccgccaccgaccaccgcgagggcgccttcgctggtccctgttgcgaccacttcctggaggccacacacaagcacatctttcatccagatggtctccatgggatctaggtggatggtgtccgccttatgtgcaggggttaaaattatttctagttgagaataataaaataagccgagatgtaaaaggcttgtttttaggtgttatgtttgtgtcttgcggagtcattcttagtctcgtcgttaagttgcagctcgaggacgagctgcatgtccaggtggggtgtagtgttagaagagtcaaggacctattgggcactgtagcgcgggtgcaagaaatgtttggttatgggtctgctgagccaaagaactttgttgaacattgtagttcatggcttctcccattcctcattctcaggggtgatggtgctgatatgaattggatatcaaagtgctgtctccatgctctaatctctcttttgtttttatatatatttgtttctcagattttatctcaacctttgtcaatcattatcaagaaatactttgttccaatctttggattgtgcattgctgtcagatgtggcacagggccagagaaggatttagctgaaactgtcttatgtgaatcagttttgcagcttggtgaaatttctgaggttgagcgtgatgatctcattaaaaaacatatggttgcgatcgttgcttttttgctctctgtttcatcatctgctcatgagccacaaattccatatttttccaaggagaatgttgcactttcagtcagaatggttgttgatggatttgtggacacaatggatgataatttggctgatacagttgttattgataaaattaatatattccgtgctgacagagtatttaagattccagcttgcaagaagaaaaaaaccgtgctgtgcttcaccgaaaaaatagtggcagcgtgtggacctttggtaaccttgctgctgttcctgggggtagtggcagtggtcgccacccagattgtggtgcggaccaataggttcctgttgtcaatacatcagcaagttgcagatgctagccaccccaggcacatgggtcatcgtctttgtgcaattgaggttttaatagatgtacttggacaccgggtggttcttgagagcacttgcttctatattatttctattgtggggaactatatccagcaaaaaccactgcaaggccagtgctgtaatattttgtctaaagtgttggctgcttttgatggaaacacctctgctgaaaccctggaagtgcttggcaggcagcttcaggagttagaaccacttcctgatcttgattgcttgaaagatgtacaggagtttcatgcttcactttctgcatcacattcttcaagagatcagttcttaaagtttgttaataaggctccttatttgccaccggagctatttttgttgagtcttcgtgcgtatcacaaaaagttattattgggagaaatcatccgtagaagtgacctatctgtggctgatgcagacatggttagctgctggcgtagcgacccagatgtcatttctgctgtatgggctcttgttgacctttgtagctcatcatctatagcaaatgaagcttcttcagtgcttgctgattttatctctagggctggtatatctgatgcacatcaagtgatattccgtctgccaactcctaccgaaaactatcctttacaactacataccagttctgcttccaaggaggataaaatatccccagactatggtatttctgatgatgttttggttgtgcttctgaaactcttgaagacttatttatctgatgaatctgttgaaataatagatgctgcttcacaaacactgaggcatttctggcctttataccaaaactcttttgagataaacctttttcctgcttgcgcacacaaaaaagtgatattgatgtgcatcaaaacccagtcattctgtcatccagaattagcttcctag

SEQ ID NO: 20693 - protein, 930 aa, Sorghum bicolor
  misc_feature: Ceres ANNOT ID no. 8659221
  misc_feature: Up-regulated in root tissues in response to salicylic acid treatment
  misc_feature (449)..(564): SWISSPROT Homolog: EC 2.7.11.1 Non-specific serine/threonine protein kinase
  misc_feature (158)..(178): Pfam ID: IQ Pfam Description: IQ calmodulin-binding motif
MALMSFQMGDLATRVSALDGRDLPTAAQFPQLPMSSAGHLPSLQAPSLPLGVHPSAPVPIQQPWMPPPPSITSYALASTMGLVHTMASTPAATTTVAPAPSTSAVVLPGVSTIQHPFTDGIFYRGASFQQIRDEGEMLQQTEQPMVTELTGKMLRCQVSAAVQLQAAVRGLLARRRVQKMRDLPLIQPCTYLQLHHVEDCDLIRCVGDFQNVVPPTGSVHAVFPAGGGLKVFGVGSWKPYALLCAVQTSSRPVRRRHGVIGGSALPSAARFRHRPPRGRLRWSLLRPLPGGHTQAHLSSRWSPWDLGGWCPPYVQGLKLFLVENNKISRDVKGLFLGVMFVSCGVILSLVVKLQLEDELHVQVGCSVRRVKDLLGTVARVQEMFGYGSAEPKNFVEHCSSWLLPFLILRGDGADMNWISKCCLHALISLLFLYIFVSQILSQPLSIIIKKYFVPIFGLCIAVRCGTGPEKDLAETVLCESVLQLGEISEVERDDLIKKHMVAIVAFLLSVSSSAHEPQIPYFSKENVALSVRMVVDGFVDTMDDNLADTVVIDKINIFRADRVFKIPACKKKKTVLCFTEKIVAACGPLVTLLLFLGVVAVVATQIVVRTNRFLLSIHQQVADASHPRHMGHRLCAIEVLIDVLGHRVVLESTCFYIISIVGNYIQQKPLQGQCCNILSKVLAAFDGNTSAETLEVLGRQLQELEPLPDLDCLKDVQEFHASLSASHSSRDQFLKFVNKAPYLPPELFLLSLRAYHKKLLLGEIIRRSDLSVADADMVSCWRSDPDVISAVWALVDLCSSSSIANEASSVLADFISRAGISDAHQVIFRLPTPTENYPLQLHTSSASKEDKISPDYGISDDVLVVLLKLLKTYLSDESVEIIDAASQTLRHFWPLYQNSFEINLFPACAHKKVILMCIKTQSFCHPELAS

SEQ ID NO: 20694 - DNA, 2022 bp, Sorghum bicolor
  misc_feature: Ceres ANNOT ID no. 8659349
  misc_feature: Up-regulated in shoot tissues in response to salicylic acid treatment
  misc_feature: Encodes the peptide sequence at SEQ ID NO 20695
atggcggcggtcgaggggacgacgaagaagaaggtaatcatcgacaccgaccccggaattgacgacgcgatggccatcttcgtggcactgcggtcgccggagctggaggtgctgggcctcaccactaccttcggcaacgtccacaccgccctcgccacccggaacgcgctccacctgttggaggctgttggaaggacagacatccccgtggcagagggatcccatgtaacaatcaagaaagccaccaagctgaggatcgcaagcttcgtccacggttcagacggcctgggaaaccaggacttccctccaccggctaccaagcctgtagatcagtcggctgctgccttcctggttgagcaggcaaatctgtaccctggacaagttaccgtcgtcgccctcggtccacttaccaaccttgctctggcagtcgagcttgacccttcattcccgaagaagatagggcagattattattcttggcggtgcgtattcagtcaatggaaatgtgaaccctgcagctgaggcaaacatctttggggatcccgacgcggcagatattgtgttcacctgcggtgctgatattttggctgtgggactaaatgtaacccatcaagtagttctaacagatgctgaccgggagaagcttgaacagtgtgagagcaaatatgcccgctacttatgcaagataatgggcatttattttgattaccacaaggatgcctacttcataaaaggagtgtatcttcatgatccaacaacgcttattgctgctgtgaatccatcgctattgacttacacagaaggtgtcgtgagggtacagacagttggaatcacaaagggccttactgtttttgataacaccaagaaaaggtacggagagatcacagcctggactggcatgcccaccgtgaaggtcgctgtcaccgtcgatgctcctgccgtggtagagctgatgatgcagaggaaccgcctcctccctctgctcagcgcagcctccccgcttccctcccccatccacatccacccccaagcgtgccgccgcctctgcacctccaattccgcggccactgcggcgttctcgctcgaggactaccttgtcgccgcctgcggcatcgcaccagcccaagcccgtgaggtgtccaagaaggcgttccaccagttatccaagatctcacactcccgcttcatctccgccgcctccaaccccgatgccatcgtcgccctgctctccggcgccggtctctcccgcgccgacatcgccgccgtcgtctcagcttacccgctgctcctccgcgcttcggtgaagagaatctcgccccgccttcttgctctccgagaccgcgccggcctttctactcagcaaatcgctcgcttcctcctggtcggcccacatgctatctgccgcagcgacgtcgttcccaagcttcagttcttcatctccttctacggctcgtttgagcaggtcctggtggtcctaaagaggaacaaccgcctcttcaattcgagccttgagaacttaatcaagcctaacatagctttgcttcgtcagtggggtgttccaaatattgttcagttgtgttcaaccagcgcgtgggtgcttaccttcaacgcagaacgcgtgaaagaatttttgctacgggcagaacaacttggggtgtctcccacttcgcgcatgtttaggcacgcggtggctgctagtgccaataatcccaaagagaaggttgctgccaagcttgagttctttaacaggactctcggttgttctgagtctgaggtttccactgcagtgtccaagatgccagctataataggattgtctgacgagattcttctccgcaagattgagttcctagtcaatgaggctgcgatggagccacagtacattgttgaaaggcctgtcctgttgacactgagcctggagaagaggctagtgccgcggcattatgtcatgtgtatgctaacattatttcatttgtcaaataaagtagcaaagtttcgcatgggcccgcacagattactatag

SEQ ID NO: 20695 - protein, 673 aa, Sorghum bicolor
  misc_feature: Ceres ANNOT ID no. 8659349
  misc_feature: Up-regulated in shoot tissues in response to salicylic acid treatment
  misc_feature (9)..(311): SWISSPROT Homolog: EC 3.2.2.8 Ribosylpyrimidine nucleosidase
  misc_feature (9)..(326): Pfam ID: IU_nuc_hydro Pfam Description: Inosine-uridine preferring nucleoside hydrolase
  misc_feature (363)..(671): Pfam ID: mTERF Pfam Description: mTERF
MAAVEGTTKKKVIIDTDPGIDDAMAIFVALRSPELEVLGLTTTFGNVHTALATRNALHLLEAVGRTDIPVAEGSHVTIKKATKLRIASFVHGSDGLGNQDFPPPATKPVDQSAAAFLVEQANLYPGQVTVVALGPLTNLALAVELDPSFPKKIGQIIILGGAYSVNGNVNPAAEANIFGDPDAADIVFTCGADILAVGLNVTHQVVLTDADREKLEQCESKYARYLCKIMGIYFDYHKDAYFIKGVYLHDPTTLIAAVNPSLLTYTEGVVRVQTVGITKGLTVFDNTKKRYGEITAWTGMPTVKVAVTVDAPAVVELMMQRNRLLPLLSAASPLPSPIHIHPQACRRLCTSNSAATAAFSLEDYLVAACGIAPAQAREVSKKAFHQLSKISHSRFISAASNPDAIVALLSGAGLSRADIAAVVSAYPLLLRASVKRISPRLLALRDRAGLSTQQIARFLLVGPHAICRSDVVPKLQFFISFYGSFEQVLVVLKRNNRLFNSSLENLIKPNIALLRQWGVPNIVQLCSTSAWVLTFNAERVKEFLLRAEQLGVSPTSRMFRHAVAASANNPKEKVAAKLEFFNRTLGCSESEVSTAVSKMPAIIGLSDEILLRKIEFLVNEAAMEPQYIVERPVLLTLSLEKRLVPRHYVMCMLTLFHLSNKVAKFRMGPHRLL

SEQ ID NO: 20696 - DNA, 1530 bp, Sorghum bicolor
  misc_feature: Ceres ANNOT ID no. 8659740
  misc_feature: Up-regulated in shoot tissues in response to salicylic acid treatment
  misc_feature: Encodes the peptide sequence at SEQ ID NO 20697
atggcggcgggcggcgacgcggcggcgtggggggaggagcccgtggcgcggcgccgtcccaagaccaagatcgtctgcacgctcggcccggcgtcgcggtccgtcgagatgatctcgcgcctgctgcgcgccggcatgtgcgtcgcgcgcttcaacttctcccacggctcccacgagtaccaccaggagacgctcgacaacctccgcgccgccatggagctcacgggcatcctctgcgccgttatgctcgacaccaagggtccagagattcgaactggatttttgaaagatgggaagcctattcagttgaaaaaaggtcaagaaatcacaatttccacagactacagcattaagggtgatgagaaaatgatatcgatgagctacaagaagcttgtggatctgaagccaggcagtgtgatattgtgtgctgatggtaccatcacccttactgtgcttcacagcgataaagaacaaggcttggttcgctgccgttgtgagaacacttggatgcttggtgagaggaagaatgttaatcttccaggagttattgttgatctccccacactcacagacaaggacaaggaggacatccttaagtggggtgttccaaacaagattgacatgattgccttgtcatttgttcggaagggttcggatcttgtggaggttaggaaggtacttggcgagcatgccaagtccataatgctgatgtcaaaggttgagaatcaagagggagtagctaactttgatgatatcctggcaaactctgatgcttttatggtggcaagaggtgatttagggatggaaattcctatagagaagattttctttgcacagaaggtgatgattttcaagtgcaatattcaaggcaagcctgttgtgactgcaacccagatgttggaatctatgatcaagtctcctcgccctactcgggcagaagcaaccgatgttgcaaacgcagttcttgatggcacggactgtgtcatgcttagtggtgagactgctgctggggcttatccagagctggcggtgcagactatggccaagatctgcctacaagcagagtcttgtgtagaccatgcttctgttttcaaatcaatcatggcttcagctccaattccaatgagcccattggagagccttgcatcatcagctgtccgcacagcaaactctgccaaggcagcacttatcttagtcctgaccaggggaggaacaactgctaggcttgtggccaagtataggccatccatgccgattctgtccgttgtggttcctgagctgaagacagactcgttcgactggacctgcagtgacgaggggccggcaaggcacagcctcattgtgaggggtgttatcccaatgctgagtgctggcactgccaaggcctttgacaatgaagccactgaagaagctcttggttttgccattgaaaatgcaaaggcgatggggctatgcaacaccggtgagtccgttgtggcccttcaccgcatcgggactgcatccgtcatcaagctcctgactgtgaactag

SEQ ID NO: 20697 - protein, 509 aa, Sorghum bicolor
  misc_feature: Ceres ANNOT ID no. 8659740
  misc_feature: Up-regulated in shoot tissues in response to salicylic acid treatment
  misc_feature (18)..(508): SWISSPROT Homolog: EC 2.7.1.40 Pyruvate kinase
  misc_feature (19)..(364): Pfam ID: PK Pfam Description: Pyruvate kinase, barrel domain
  misc_feature (378)..(507): Pfam ID: PK_C Pfam Description: Pyruvate kinase, alpha/beta domain
MAAGGDAAAWGEEPVARRRPKTKIVCTLGPASRSVEMISRLLRAGMCVARFNFSHGSHEYHQETLDNLRAAMELTGILCAVMLDTKGPEIRTGFLKDGKPIQLKKGQEITISTDYSIKGDEKMISMSYKKLVDLKPGSVILCADGTITLTVLHSDKEQGLVRCRCENTWMLGERKNVNLPGVIVDLPTLTDKDKEDILKWGVPNKIDMIALSFVRKGSDLVEVRKVLGEHAKSIMLMSKVENQEGVANFDDILANSDAFMVARGDLGMEIPIEKIFFAQKVMIFKCNIQGKPVVTATQMLESMIKSPRPTRAEATDVANAVLDGTDCVMLSGETAAGAYPELAVQTMAKICLQAESCVDHASVFKSIMASAPIPMSPLESLASSAVRTANSAKAALILVLTRGGTTARLVAKYRPSMPILSVVVPELKTDSFDWTCSDEGPARHSLIVRGVIPMLSAGTAKAFDNEATEEALGFAIENAKAMGLCNTGESVVALHRIGTASVIKLLTVN

SEQ ID NO: 20698 - DNA, 1209 bp, Sorghum bicolor
  misc_feature: Ceres ANNOT ID no. 8659767
  misc_feature: Down-regulated in shoot tissues in response to aminocyclopropane carboxylic treatment
  misc_feature: Down-regulated in shoot tissues in response to methyl jasmonate treatment
  misc_feature: Up-regulated in root tissues in response to methyl jasmonate treatment
  misc_feature: Down-regulated in shoot tissues in response to salicylic acid treatment
  misc_feature: Encodes the peptide sequence at SEQ ID NO 20699
atggagctctcgctcctcaaccccgccgcgacgcaccgccaccttgggggcctgcccctcgcgcggcgctccgtggtccggttccgccgcgtgtccgcctcggccgcggccgcggcgccgcccaagtcgtcgggccccaagaagcggggcaagacggagatccaggagacgctgctcacgccgcggttctacaccaccgacttcgacgagatggagcgcctcttcaacgccgagatcaacaagcagctcaaccaggcggagttcgacgcgctgctgcaggagttcaagacggactacaaccagacccacttcgtgcgcaaccccgagttcaaggccgccgccgacaagatggagggcccgctccgccagatcttcgtcgagttcctcgagcgctcctgcaccgccgagttctccggattcctcctctacaaggagctcggccgcaggctcaagaaaaccaacccggtcgtggcggagatcttctcgctcatgtccagggacgaggcgcgccatgctgggttcttgaacaagggactgtctgacttcaatttggcgctggacctggggttcctgaccaaggctaggaagtacaccttcttcaagcccaagttcatcttctatgccacctacctgtctgagaagatcgggtactggaggtacatcaccatcttcaggcacctcaaagcgaacccagagtatcaggtgtaccctatcttcaagtacttcgaaaactggtgccaggacgagaacaggcacggtgacttcttctctgccctgctcaaggctcagccgcagttcctcaatgactggaaggccaagctctggtcacggttcttctgcctctcggtgtatgtgaccatgtacctgaatgactgccaacgcactgcattctatgagggaattggtctggacactaaagaatttgacatgcatgtgatcattgagaccaaccgcacaacagcgaggatcttccctgctgttctggatgtagagaaccctgaattcaagaggaagcttgacaggatggttgtgatcaaccagaagatcattgccatcggagaatctgacgacattcccctagtgaagaacctgaagaggattcctctcattgccgctctggtgtctgagatcattgccgcatacctcatgccccccatcgagtctggctcagttgattttgctgaatttgagccccagcttgtttactga

SEQ ID NO: 20699 - protein, 402 aa, Sorghum bicolor
  misc_feature: Ceres ANNOT ID no. 8659767
  misc_feature: Down-regulated in shoot tissues in response to aminocyclopropane carboxylic treatment
  misc_feature: Down-regulated in shoot tissues in response to methyl jasmonate treatment
  misc_feature: Up-regulated in root tissues in response to methyl jasmonate treatment
  misc_feature: Down-regulated in shoot tissues in response to salicylic acid treatment
  misc_feature (1)..(402): SWISSPROT Homolog: EC 1.14.13.81 Magnesium-protoporphyrin IX monomethyl ester (oxidative) cyclase
  misc_feature (127)..(260): Pfam ID: Rubrerythrin Pfam Description: Rubrerythrin
MELSLLNPAATHRHLGGLPLARRSVVRFRRVSASAAAAAPPKSSGPKKRGKTEIQETLLTPRFYTTDFDEMERLFNAEINKQLNQAEFDALLQEFKTDYNQTHFVRNPEFKAAADKMEGPLRQIFVEFLERSCTAEFSGFLLYKELGRRLKKTNPVVAEIFSLMSRDEARHAGFLNKGLSDFNLALDLGFLTKARKYTFFKPKFIFYATYLSEKIGYWRYITIFRHLKANPEYQVYPIFKYFENWCQDENRHGDFFSALLKAQPQFLNDWKAKLWSRFFCLSVYVTMYLNDCQRTAFYEGIGLDTKEFDMHVIIETNRTTARIFPAVLDVENPEFKRKLDRMVVINQKIIAIGESDDIPLVKNLKRIPLIAALVSEIIAAYLMPPIESGSVDFAEFEPQLVY

SEQ ID NO: 20700 - DNA, 1842 bp, Sorghum bicolor
  misc_feature: Ceres ANNOT ID no. 8659798
  misc_feature: Down-regulated in shoot tissues in response to salicylic acid treatment
  misc_feature: Encodes the peptide sequence at SEQ ID NO 20701
atgtgggctctccgccgagctggcacccccctcaggttccacgctcaaaaagctgtgagtgcccgtggttgcgctagtcttgaggtgctgctaactgccgatgcaaagaatgtagaagagcatcatgatgcagactgtcagaaagcgtgctgctgtcataagccaaagccaccagccttccaattgtcattttcatctggccagtttgcttggagtaggggtttctcctctcagccaggtgaaaattctggtgacaaggatgatgagttagaggacggattttctgatctcgaggttccaccagaagctggtaaaacggatgctgggttgacatctgaagatagttctgatgaggacgccgctgatgaatttggcttggatgatgtggatgctgatgcaaagcctgagaaggagtacattaaaaggacctctggttccatcctcctcaagactgtgttggaagctccgaggcatcaactcacttcagtgcttgagaaatggagaaaggatggcaatgcattggataggagtgaactctattttgtcctcattcaacttcgaaagcggaagtggtacaacaaagccttggagcttgttgaatgggttcaaaaattacagctgttcgaacttgaagagcgtgatttcgctgcacgcgttgatttaacagccaaggtctatggtcttcataaagcagaacagtatattgagaaaattcctgcatctcataggggtgaggttgtgtatagaacacttttggccaattgtgttgctacagacaatgtaaaaaaatcagaggaagtttttaataggatgaaggatcttggatttccgcctacaacattttctttcaatcagcttctgctactctacaaaaggttggacaagaagaagattgccgatgttctcacaatgatggaaaaggaggatgtgaaaccatctctgtttacttacaagctccttgtagatgccaagggattggttggagatatagaagccatggagaaagtggttgaatcaatggagaaagatggcattgagccagatctcatgtttaatgctacaattgccaggcactacatatttaatggtcagcgtgagaaagcagagacacttttggagtcaatggagggtgatgatatccagaaaaatcgttttgcttgcaagattctattacctttacatgcttttctgggcaatagtgatgatgtggaaagaatttggaaggtgtgtgaggataatactcgcctagatgagtgcaagtctgctatagaggcctttggtaagcttggtaatgttgaaaaggcagagaaggttttcgaggatatgcttgtgaaatggaaaacactctctcccaaattctacaacactttgctaaaggtgtatgctgatcagaacctcttagacaaaggtaaggaactagcaaagcggatggatgagaaccatgtcaggtttggcacccaaactttggatgcgcttgtgaagctatatgttgacgccggagaggtggagaaagctgagtccctattgcacaagctatctctgaagaactacatcaagcctaattacagctcgtacatgaagctgcttgatagctactcaaagaaaggagacatccacaacgcagagaaagtgttcaacaagttgcggcagatcggctacactgggaggatcaggatgtaccagttgcttctccattcttatctacatgctaaggcccctgcttatgggttcaaagagaggatgaaggctgacaacattttccccaacggtgccgtggcaactttgattgcggctactgatccgtttgtcaagaagaagtcaatatcagatttgctcgattag

SEQ ID NO: 20701 - protein, 613 aa, Sorghum bicolor
  misc_feature: Ceres ANNOT ID no. 8659798
  misc_feature: Down-regulated in shoot tissues in response to salicylic acid treatment
  misc_feature (315)..(349): Pfam ID: PPR Pfam Description: PPR repeat
  misc_feature (246)..(280): Pfam ID: PPR Pfam Description: PPR repeat
MWALRRAGTPLRFHAQKAVSARGCASLEVLLTADAKNVEEHHDADCQKACCCHKPKPPAFQLSFSSGQFAWSRGFSSQPGENSGDKDDELEDGFSDLEVPPEAGKTDAGLTSEDSSDEDAADEFGLDDVDADAKPEKEYIKRTSGSILLKTVLEAPRHQLTSVLEKWRKDGNALDRSELYFVLIQLRKRKWYNKALELVEWVQKLQLFELEERDFAARVDLTAKVYGLHKAEQYIEKIPASHRGEVVYRTLLANCVATDNVKKSEEVFNRMKDLGFPPTTFSFNQLLLLYKRLDKKKIADVLTMMEKEDVKPSLFTYKLLVDAKGLVGDIEAMEKVVESMEKDGIEPDLMFNATIARHYIFNGQREKAETLLESMEGDDIQKNRFACKILLPLHAFLGNSDDVERIWKVCEDNTRLDECKSAIEAFGKLGNVEKAEKVFEDMLVKWKTLSPKFYNTLLKVYADQNLLDKGKELAKRMDENHVRFGTQTLDALVKLYVDAGEVEKAESLLHKLSLKNYIKPNYSSYMKLLDSYSKKGDIHNAEKVFNKLRQIGYTGRIRMYQLLLHSYLHAKAPAYGFKERMKADNIFPNGAVATLIAATDPFVKKKSISDLLD

SEQ ID NO: 20702 - DNA, 1593 bp, Sorghum bicolor
  misc_feature: Ceres ANNOT ID no. 8659905
  misc_feature: Down-regulated in shoot tissues in response to salicylic acid treatment
  misc_feature: Encodes the peptide sequence at SEQ ID NO 20703
atggccaccgctgcatcggcggccgcgccgctactcaacgggacccgaaggcctgcgaggctccgccgtcgcggactccgcgtgcgctgcgccgctgtggcgggcggcgcggccgaggcaccggcctccaccggcgcgcggctgtccgcggactgcgtcgtggtgggcggcgggatcagtggcctctgcaccgcgcaggcgctggccacgcggcacggcgtcggggaggtgcttgtcacggaggcccgcgcccgacccggcggcaacatcaccaccgtcgagcgccccgaggaagggtacctctgggaggagggtcccaacagcttccagccatccgaccccgttctctccatggccgtggacagcgggctgaaggatgacctggtttttggggatcccaacgcgccgcggttcgtgctgtgggaggggaagctgaggcccgtgccatccaagcccgccgacctcccgttcttcgatctcatgagcatccctggcaagctcagggccggtctcggcgcgcttggcatccgcccgcctcctccaggccgcgaggagtcagtggaggagtttgtgcgccgcaacctcggtgctgaggtctttgagcgcctaattgagcctttctgctcaggtgtctatgctggtgatccttccaagctcagtatgaaggctgcatttgggaaggtgtggcggttagaagaagctggaggtagtattattggtggaaccatcaagacgattcaggagagaggcaagaatccaaaaccaccgagggatccccgccttccgaagccaaaagggcagacagttgcatctttcaggaagggtcttgccatgcttccaaatgccatcacatccagcttgggtagtaaagtcaaactatcatggaaactcacgagcattacaaaatcagatggcaaggggtatgttttggagtatgaaacaccagaaggggttgttttggtgcaggctaaaagtgttatcatgaccattccatcatatgttgctagcgacattttgcgtccactttcaggtgatgctgcagatgctctatcaagattctattatccaccagttgctgctgtaacggtttcgtatccaaaggaagcaattagaaaagaatgcttaattgatggggaactccagggttttggccagttgcatccacgtagtcaaggagttgagacattaggaacaatatacagctcatcactctttccaaatcgtgctcctgctggtagggtgttacttctaaactacataggaggtgctacaaacacaggaattgtttccaagactgaaagtgagctggtagaagcagttgaccgtgacctccgaaaaatgcttataaattctacagcagtggaccctttagtccttggtgtccgagtttggccacaagccatacctcagttcctggtaggacatcttgatcttctggaggtcgcaaaatctgccctggaccaaggtggctatgatgggctgttcctaggagggaactatgttgcaggagttgccctgggcagatgcattgagggcgcatatgagagtgccgcacaaatatatgacttcttgaccaagtatgcctacaagtga

SEQ ID NO: 20703 - protein, 530 aa, Sorghum bicolor
  misc_feature: Ceres ANNOT ID no. 8659905
  misc_feature: Down-regulated in shoot tissues in response to salicylic acid treatment
  misc_feature (48)..(530): SWISSPROT Homolog: EC 1.3.3.4 Protoporphyrinogen oxidase
  misc_feature (59)..(521): Pfam ID: Amino_oxidase Pfam Description: Flavin containing amine oxidoreductase
MATAASAAAPLLNGTRRPARLRRRGLRVRCAAVAGGAAEAPASTGARLSADCVVVGGGISGLCTAQALATRHGVGEVLVTEARARPGGNITTVERPEEGYLWEEGPNSFQPSDPVLSMAVDSGLKDDLVFGDPNAPRFVLWEGKLRPVPSKPADLPFFDLMSIPGKLRAGLGALGIRPPPPGREESVEEFVRRNLGAEVFERLIEPFCSGVYAGDPSKLSMKAAFGKVWRLEEAGGSIIGGTIKTIQERGKNPKPPRDPRLPKPKGQTVASFRKGLAMLPNAITSSLGSKVKLSWKLTSITKSDGKGYVLEYETPEGVVLVQAKSVIMTIPSYVASDILRPLSGDAADALSRFYYPPVAAVTVSYPKEAIRKECLIDGELQGFGQLHPRSQGVETLGTIYSSSLFPNRAPAGRVLLLNYIGGATNTGIVSKTESELVEAVDRDLRKMLINSTAVDPLVLGVRVWPQAIPQFLVGHLDLLEVAKSALDQGGYDGLFLGGNYVAGVALGRCIEGAYESAAQIYDFLTKYAYK

SEQ ID NO: 20704 - DNA, 3276 bp, Sorghum bicolor
  misc_feature: Ceres ANNOT ID no. 8660103
  misc_feature: Up-regulated in root tissues in response to methyl jasmonate treatment
  misc_feature: Up-regulated in shoot tissues in response to methyl jasmonate treatment
  misc_feature: Encodes the peptide sequence at SEQ ID NO 20705
atggcgtacatctacactgcacctaaagccccagaaagaaaagcccattcccgcaccacaggggcacaggcgagctctggcttggccaaatcgaggaaggcgtcggattccaagctcgattactccgacatcacggttgagctctgtactgttgatggtttggttaaagaaagcacacagtgtgctcctaatggctactattttatcccagtttatgataaggttcctgtcatcatcgatcacaatggctgcaatggaaatgcggatataaatttccaattcactgggtttatgatatccggtaaagtagtgggagctgttggtggtaagagctgctcaaaagggggaggacctgctggtgtgaaagttgagctgatgacagattctgatgagttgattgcatctgcttcaacatcatcatcaggagaatattcatttacaaacataattccagggcgttacagattacgtgcttctcatcctgattacaaaatcgagttgagaggctcaccagaggttgacttgcgatttggaaacgtcgtggcagatgatgtcttctttgtatctggatatgacatttatggcactgtggttgcacagggaaacccgatagtgggagtccacctatatttgtattcaaatgatgtaacggaggtcccttgtccacaaggtttcagtgatgcacccaaggaaggtgctctttgccatgcaatatctggtgctgatgggaagttcacgtttagatcactaccttgtggtagctatgagctgctgccatactacaagggggagaacaccgtctttgatatttcaccatcttcacttcctgtttctgttgagcacagtcatttgaccattccccaaaaattccaggttactggattttctgttggagggcgtgttattgatggttacggtgctggtgtggagagtgccaatgttatagttgatgggcagtcgagagccataacagatagtctcggatactacagacttgatcaggttacatccaagaagtatactataactgctgagaaggatcattataagttcaatcgtttggagaattttatgattttaccaaatttggccagtattgatgatatcagatcagttagatatgatgtatgtggtattgttcgaacagttactccgaattcaaaagcaatggttactttaacacatggaccagaaaatgtaaagccacagcggaagttagtgggtgaaaatggacagttttgctttgaggttcctgctggtgaatacgaattatctgcattacctgtagattccgaacgctcttctagtcttatgttttcaccaggatctattagcatcaatgtaaatagcccattgcttgatctcgaattctctcagtcacaagtcaatgttcatggcaaagtctcatgcaaagagcaatgcaaccagaacattcttgtctcgcttgttagattggctggcggtgttgagcaggaaaagaagacaactacattggagcaagataatgtcagttttgtgttcaagaaagtatttcctggaaaatatcgtgtagaggtgaagaattctttacccgagggctcagctaaggatgattggtgctgggaccaaagtaccttgaatatagatgttggtactgatgatgtgagagacattgtgtttgtacaaaaaggctactggattgagctagtttcaactcatgatactaaagcttatattcagcagccagattcttctagacttgatttgtcgataaagaaaggatctcaaaggatttgtgttgaaacttcagggcaacacgagattcatttaactaatccttgtatttcctttgggagctcgtctgttttgtttgatacagctaaatcaatgcctattcatatcagcgcaaagaagtatcttgtaaaaggtgaaatccatgtggacatgagctcccttcaggaaaacattgattccaaggatatggtcgtggatgtcttgaagagtgacgacagtttcatagaaaagatatccacttcacctgttattggaaaggataatcaaaatgactttactgcctttgagtactctatttgggctgaccttggggaggacttcatctttgtcccccatgattctagcactggaaggaacaaggtcctattttatccagcaagacagcagtattcagtgtctatgaatggatgccaagatactgttcctctaatcactgcaaaaactggtctataccttgaaggatcagtgctacctgcaacttctgatgttgacatcaagattgtagcagctggaaagagcaactatgcccatctgaacaaaggggatgtagcaacagagacaaagacagattctgaaggatcattttttgcggatggttaccatctcaagcaaactggtccatacaccttttcttgtcagaagcttggtcagatatcagtgcggatttatggtgaaaattcagagcttttaccttcagtattattatctttgagtggcgaggaagggtacagaaataactcaattagtagttctggtggaactttcacctttgacaacttatttcctggaagtttctatctccggccacttctaaaggaatataaattcaatccatcagcagtagctattgatcttaattctggagagtctagggaggctgaatttcgtgcaaccagagtggcttacagtgccatgggttctgtaacactattaactggccacccaaaggagggtgtttttgttgaagcaagatctgaatccacaggtttttatgaggaagctaccacagatgcttttggtaggtttcgtcttagaggacttgtgcctggatcaacttactctataagagtggttgcaaaagataatcttcggtttgcagcagttgagcgtgcttcacccgaatatttgtcggttaatgttggtcgtgaagacataactggtattgattttgtggtttttgaacacccagaagtaacaatcttgagtggtcatgtggaaggagacggcattgatacgttacagccgcatctctctgttgagatcagatcagcagcagacccttctagagtagaatctgtacttcctgttcctctttcgtactattttgaagtgcgagatttgcccaagggcaagcatcttgttcagcttcgatctggccttccatcacatacacataggtttgaatcagagttagttgaagtagatctggaaaaggaaccccaaatccatgttggccccctcaaatataaaactgaagagcgtcatcaaaagcaggttaaatga

SEQ ID NO: 20705 - protein, 1091 aa, Sorghum bicolor
  misc_feature: Ceres ANNOT ID no. 8660103
  misc_feature: Up-regulated in root tissues in response to methyl jasmonate treatment
  misc_feature: Up-regulated in shoot tissues in response to methyl jasmonate treatment
MAYIYTAPKAPERKAHSRTTGAQASSGLAKSRKASDSKLDYSDITVELCTVDGLVKESTQCAPNGYYFIPVYDKVPVIIDHNGCNGNADINFQFTGFMISGKVVGAVGGKSCSKGGGPAGVKVELMTDSDELIASASTSSSGEYSFTNIIPGRYRLRASHPDYKIELRGSPEVDLRFGNVVADDVFFVSGYDIYGTVVAQGNPIVGVHLYLYSNDVTEVPCPQGFSDAPKEGALCHAISGADGKFTFRSLPCGSYELLPYYKGENTVFDISPSSLPVSVEHSHLTIPQKFQVTGFSVGGRVIDGYGAGVESANVIVDGQSRAITDSLGYYRLDQVTSKKYTITAEKDHYKFNRLENFMILPNLASIDDIRSVRYDVCGIVRTVTPNSKAMVTLTHGPENVKPQRKLVGENGQFCFEVPAGEYELSALPVDSERSSSLMFSPGSISINVNSPLLDLEFSQSQVNVHGKVSCKEQCNQNILVSLVRLAGGVEQEKKTTTLEQDNVSFVFKKVFPGKYRVEVKNSLPEGSAKDDWCWDQSTLNIDVGTDDVRDIVFVQKGYWIELVSTHDTKAYIQQPDSSRLDLSIKKGSQRICVETSGQHEIHLTNPCISFGSSSVLFDTAKSMPIHISAKKYLVKGEIHVDMSSLQENIDSKDMVVDVLKSDDSFIEKISTSPVIGKDNQNDFTAFEYSIWADLGEDFIFVPHDSSTGRNKVLFYPARQQYSVSMNGCQDTVPLITAKTGLYLEGSVLPATSDVDIKIVAAGKSNYAHLNKGDVATETKTDSEGSFFADGYHLKQTGPYTFSCQKLGQISVRIYGENSELLPSVLLSLSGEEGYRNNSISSSGGTFTFDNLFPGSFYLRPLLKEYKFNPSAVAIDLNSGESREAEFRATRVAYSAMGSVTLLTGHPKEGVFVEARSESTGFYEEATTDAFGRFRLRGLVPGSTYSIRVVAKDNLRFAAVERASPEYLSVNVGREDITGIDFVVFEHPEVTILSGHVEGDGIDTLQPHLSVEIRSAADPSRVESVLPVPLSYYFEVRDLPKGKHLVQLRSGLPSHTHRFESELVEVDLEKEPQIHVGPLKYKTEERHQKQVK

SEQ ID NO: 20706 - DNA, 3360 bp, Sorghum bicolor
  misc_feature: Ceres ANNOT ID no. 8660143
  misc_feature: Up-regulated in shoot tissues in response to salicylic acid treatment
  misc_feature: Encodes the peptide sequence at SEQ ID NO 20707
atgtcggcgacggtggaggagcagatggtggtgaaggcgatccgggaggagtgcccctgggagtcgctccccaagcgcctccagtccacgctccagaccaaggacgagtggcaccgcaggtaccccacttctctgctcttgccctctatggatttgctttgctacattgctgctgcaaccagtatctgccacctgaaagtgtccagatatatcatggagaacactgtcaaatttacaacaacagaccagggaaacagacaacgaacaaagaaaagtaaaagtctaaagactaacagacaacaaacaaagaaaagtaaaagtctaaagactaatgtaactgtaaagagcacaaatgaaattatggatggacaaccttttccaagatgcaaagaaaatctcatttggcttttgcatcatctcttaaccactagtgaaagaggagtgggctgcctggctggtggagctaaaaaaaggatttctggcaggaaacttccactgagaatacaggaactgacaaaacggattgttgagtattgtatccgaaaacggttgcaatggaatacctgctttgcccgtagagtatgcagagaaggggaatactatgaagaaatgatgcgctaccttcggaggaaccttgcattatacccataccaccttgcagactatatatgccgagtaatgaggatctcgcctttcagatattattgtgacatcctttttgaagctatgaagaacgaacaaccatatgatagtattccgaacttcactgctgctgatgcactaaggcttactggtgttgggagaaacgagtttattgatattatgaacaaatgcagatcaaagaaactaatgtggaagctgaacaaatcgattgcaaaagaaatgctgcctacacagcctgttgacatcccagttgagccttggtggggggtttgtcttgttaactttacactggaagagttcaagaaagtttcagaagaagagacagcaacaatagacaaaatatgtaaagaggaagccaattcatatgttctttttgatccaaaggttatagacggactttataaaagagggctagtgtacttcgatgtgcctgtttacccagatgaccgtttcaaagtttctaggcttgaaaattttgtttccaataaggatcaatcatatgaagacccaattgaagagctattgtatgctgtatttgttgtatcaagtgctaatgctactgttgctgaactggctgcaactttacaagctgacctctatcaactccaagcagctgcatcgtttgcttgccgattgggctgggctacgaaagtcatggacacagactctgttcttaatgatgaaggtgcacctgcgtttcctagtagtattcttagcgatgatgaagaaggttcgaatacaagtatcaactcagagaagtctggtcaacaattgattagcacggattctgatggacccaggaaaatttctggaactgctcatgtgggcttcgttgttgatgccaatgttacgtcatacttgatgatgggctcactatcgccagggttaaaatctcatgctgtcacactctatgaggctggaaaactgggttcttcttgcattgcagagctatgtagtgatctggctagcttagagggaaagaaatttgagggtgtgctagaggagtttgcaagtcatgcattcagtctgcgatgcttcttggagtgtttacagtctggtggagtttccgcaaatgaaattactgataatgctggtgaagcaaagactccaagaagctctgttcatgatattgacaatgccgctgaccatttggccaaggtaaacattgagggtgttgctgacaataatcataatgaagtttccgagcataaccagtgtgtaggtgatttagatagtagtgatgggaatatactatcaccagctttggctataccggaacatgcagaaagcatggcaaaaaatgacgaggagaatgattcaaccgtgcagctagatgtttcaactgaatctcgagttttgaagaacaaaaggaagtacaaagttgatattcttcgatgtgagagcttagcctcacttgccccagctacattggaacggctattccttcgggactatgacattattgtgtcaatggttcctcttccttcttcgtcagttcttccaggcccttcaggcccaattcattttggaccaccctcttattcctccatgacaccttggatgaaactagtactgtatacagcaggacattgtggaccggtatctgctgtgttcatgaaagggctacgttttagattgctgcctgaaccattagctggttgtgagaaggcactgatatggtcttgggatggctcttcggtgggtggcttaggggggaaatttgaagggaatttagtgaagggcaacttattgttacactgcttgaattcgatgcttaaacaatctgctgtgctggtgcaaccacttagcatacatgatcttaacacgtcaggaaaccttgttactgtggatatccctttacccctaaaaaatgatgatcagtcaattgaatctgtggtagctcaaactaatttgccaaaggaacagatcttagatttgacttctgtattgaaagacctatctagtaaatttgagctgagcacacttggctacctccgtctactgagacttcacaggattgatgaaccagataaatttgacccagaaaatgtaagctaccagtgggtgcctttgagcttggagttcgggattcccttattcagtccaaagttgtgcgagaagatttgtgaaagggtggttgcatcctatatgcttcagaaagattatctcaatgagcattctgatgtgatgcaaaatgtgagaaggcagctgagagaactttgcagtgaatatcaagcaactggtccaatagctaagttatttaacaagcgtggaagctcaagggactcgccacgtgccttgatcaatagtattagtggcagatggaatctctctaatgacccttcaacaccaactagtggagaagccccaagtgaacacgagaggctaaaatttgctggaaggcagcgatgccgaacggaagttgtgagctttgatgggagcactgtcaggtcatatgcacttagtcctgagcacaatgaggctaccttcagacctaactctgaagaacaatcgtccatacatgatgtaaaaccagatccagaggaaaccgagagcaaggatgtagtcttaccaggagtaaatcttatatttgatggagccgaattacacccctttgatattgctgcatgccttcaagcacgccagcctctttggcttatatctgaggcatcaactgcttcatcggcattactatga

SEQ ID NO: 20707 - protein, 1119 aa, Sorghum bicolor
  misc_feature: Ceres ANNOT ID no. 8660143
  misc_feature: Up-regulated in shoot tissues in response to salicylic acid treatment
MSATVEEQMVVKAIREECPWESLPKRLQSTLQTKDEWHRRYPTSLLLPSMDLLCYIAAATSICHLKVSRYIMENTVKFTTTDQGNRQRTKKSKSLKTNRQQTKKSKSLKTNVTVKSTNEIMDGQPFPRCKENLIWLLHHLLTTSERGVGCLAGGAKKRISGRKLPLRIQELTKRIVEYCIRKRLQWNTCFARRVCREGEYYEEMMRYLRRNLALYPYHLADYICRVMRISPFRYYCDILFEAMKNEQPYDSIPNFTAADALRLTGVGRNEFIDIMNKCRSKKLMWKLNKSIAKEMLPTQPVDIPVEPWWGVCLVNFTLEEFKKVSEEETATIDKICKEEANSYVLFDPKVIDGLYKRGLVYFDVPVYPDDRFKVSRLENFVSNKDQSYEDPIEELLYAVFVVSSANATVAELAATLQADLYQLQAAASFACRLGWATKVMDTDSVLNDEGAPAFPSSILSDDEEGSNTSINSEKSGQQLISTDSDGPRKISGTAHVGFVVDANVTSYLMMGSLSPGLKSHAVTLYEAGKLGSSCIAELCSDLASLEGKKFEGVLEEFASHAFSLRCFLECLQSGGVSANEITDNAGEAKTPRSSVHDIDNAADHLAKVNIEGVADNNHNEVSEHNQCVGDLDSSDGNILSPALAIPEHAESMAKNDEENDSTVQLDVSTESRVLKNKRKYKVDILRCESLASLAPATLERLFLRDYDIIVSMVPLPSSSVLPGPSGPIHFGPPSYSSMTPWMKLVLYTAGHCGPVSAVFMKGLRFRLLPEPLAGCEKALIWSWDGSSVGGLGGKFEGNLVKGNLLLHCLNSMLKQSAVLVQPLSIHDLNTSGNLVTVDIPLPLKNDDQSIESVVAQTNLPKEQILDLTSVLKDLSSKFELSTLGYLRLLRLHRIDEPDKFDPENVSYQWVPLSLEFGIPLFSPKLCEKICERVVASYMLQKDYLNEHSDVMQNVRRQLRELCSEYQATGPIAKLFNKRGSSRDSPRALINSISGRWNLSNDPSTPTSGEAPSEHERLKFAGRQRCRTEVVSFDGSTVRSYALSPEHNEATFRPNSEEQSSIHDVKPDPEETESKDVVLPGVNLIFDGAELHPFDIAACLQARQPLWLISEASTASSALL

SEQ ID NO: 20708 - DNA, 1890 bp, Sorghum bicolor
  misc_feature: Ceres ANNOT ID no. 8660241
  misc_feature: Up-regulated in shoot tissues in response to salicylic acid treatment
  misc_feature: Encodes the peptide sequence at SEQ ID NO 20709
atggggacggcggcgatggcgacggcggtgggcggcgccatgctgctctacttcgtgctgagccggcggctggcgggcgaggacgtctccgtcggcggcggaggcggagggggaggagtcgggtccgggaagcggcggagggggcgcagcgcgccgcggcgcccggtgcagccgccggcgacgtggatcgaggcggtgggcacgctcgcggagacgctgcggttcacctactcggagacgctcggcaagtggcccatcggggacctcgccttcggaatcaagtacctcatgcgccgacagggcaatttacatgttgccagtgtatatgctggaagcgagtgcattgaactgaaaggacctgaaatcatggaagagctgattgttctacggcggttgattgatctgtgcttccttttctctaagaaaccatttccagtgttccgggagttagctggattttcacaggaggatgttcttattgaagaaccaaaggcggggattttgaagcctgctcatacaattctacgtgatgagtgcaccaaatccttccttgttttgattcgagggactcatagcatgaaagatactctgactgctgctactggggctgtggtgccatttcacctctcacttttggatgaaggcggtgtgagcaaattagtgttaggctatgctcactgtgggatggttgcagcagcccgctggattgcaagaggtgtaacaccatgccttcgtgaagcagtcagacaatgtccagaataccaaatcaagattgttggccattcattgggtggtggtactgctgcattgctaacctacatccttagagaacataaagagttttcttcaacaacttgtgttgcattcgcaccagcttcttgcatgacatgggaattagcagaatcaggcaaacattttgtgactacgattgtcaatggagctgatctggttcccactgtatcgactgcatctattgatgatctccgttctgaggtaacagcttcatcatggttaaatgatttgagggatcaaatacaacagacacgtttcctaaatgtcgtttaccggtcagccactgctttaggaactcgcctgcaatctttttctggtgcgagagagagggttgcaggtgctggagcatttctacgtcctgtttcaaacaaaacccaggctgttgctagaagtcggtctgcactttcctcatggtcatgcatgggtgcacgtcgtcgaggtgtaggtgtagttactgcaagttctaaagatgatataagagcagaaacccatgtaacatcgacagttgagtcaaagtccttcgttgtagaacaatgtgtcaccaagaccatagaagaactgcagtatactgcagctagtatttctgttcatgatgcagcagacgaagaagaggctcttttgagtgagcatgaaacctctcgggagaatgccgaagaagaaataacagagggtgaattgtggtacgagttcgagaaggacttggatcgacagactgaagtggaggcacgaactcgagaggaagaggcagctgcagccaaggaaataatggaagaggaaagtgctgtgctaaaaggtgtagaggacaggcagtccttcacatcagatagcttggagaggcagcaattctacccacctggtagaatcatgcacatggttgcaatgcctcccacagatgctgacccagatgatccagtggctgctgacgagtgctctgttggaatatatgagacccctagagatctttacagcaagattcgactctcaaataccatgatcaatgatcactacatgccaatgtataagaagatgatggaaatattgattgagaagttcgcaaaggatgaggacagctattgtacaggttctactgtagaataa

SEQ ID NO: 20709 - protein, 629 aa, Sorghum bicolor
  misc_feature: Ceres ANNOT ID no. 8660241
  misc_feature: Up-regulated in shoot tissues in response to salicylic acid treatment
  misc_feature (184)..(325): Pfam ID: Lipase_3 Pfam Description: Lipase (class 3)
  misc_feature (50)..(131): Pfam ID: Lipase3_N Pfam Description: Lipase 3 N-terminal region
MGTAAMATAVGGAMLLYFVLSRRLAGEDVSVGGGGGGGGVGSGKRRRGRSAPRRPVQPPATWIEAVGTLAETLRFTYSETLGKWPIGDLAFGIKYLMRRQGNLHVASVYAGSECIELKGPEIMEELIVLRRLIDLCFLFSKKPFPVFRELAGFSQEDVLIEEPKAGILKPAHTILRDECTKSFLVLIRGTHSMKDTLTAATGAVVPFHLSLLDEGGVSKLVLGYAHCGMVAAARWIARGVTPCLREAVRQCPEYQIKIVGHSLGGGTAALLTYILREHKEFSSTTCVAFAPASCMTWELAESGKHFVTTIVNGADLVPTVSTASIDDLRSEVTASSWLNDLRDQIQQTRFLNVVYRSATALGTRLQSFSGARERVAGAGAFLRPVSNKTQAVARSRSALSSWSCMGARRRGVGVVTASSKDDIRAETHVTSTVESKSFVVEQCVTKTIEELQYTAASISVHDAADEEEALLSEHETSRENAEEEITEGELWYEFEKDLDRQTEVEARTREEEAAAAKEIMEEESAVLKGVEDRQSFTSDSLERQQFYPPGRIMHMVAMPPTDADPDDPVAADECSVGIYETPRDLYSKIRLSNTMINDHYMPMYKKMMEILIEKFAKDEDSYCTGSTVE

SEQ ID NO: 20710 - DNA, 2670 bp, Sorghum bicolor
  misc_feature: Ceres ANNOT ID no. 8660998
  misc_feature: Up-regulated in root tissues in response to methyl jasmonate treatment
  misc_feature: Up-regulated in shoot tissues in response to aminocyclopropane carboxylic treatment
  misc_feature: Up-regulated in shoot tissues in response to methyl jasmonate treatment
  misc_feature: Up-regulated in shoot tissues in response to salicylic acid treatment
  misc_feature: Encodes the peptide sequence at SEQ ID NO 20711
atggacacaggcagttcaaggaggtcacaagatgacaccgcaacattaatcccccacagtggcaatttgggagaatcaagccagaagggcgtgaagaccaccaggttcaaagatgatgacgaggttgtggaaatcaccattgtacagcgtgattcagtggcaatcgaagatgtcagggcagtcgatgacggctccggacatggtggtgggtttgatggactgtcacttgtgtcaccttcctcatcaaggagcggcaagctgtcatcgaagattaggcaggtgaaaaatgggttaaagatgaagagctcaagcagtaaggcgccacagacacagttgggaaagaacgtgaggaagagattgaacagaagcaagagtggcgctgctgtagcactcaagggcttgcagtttgtgactgcaaaagttggtcatgatggctgggctgcagtggagaaacggttcaaccagctacaggttgatggcgtgctgctacgttcaagatttgggaaatgcattgggatggatggatctgatgagtttgcagtgcaagtctttgattcattagcaaggaagagagggataacgaagcagctgctgactaaggatgagctgaaagatttctgggagcaactcagtgatcagggttttgacaaccgtctacagacgttctttgacatggttgacaagaatgctgatggaaggatcacagcagaggaggttaaggagattattaccctcagtgcttcagcaaacaaactttccaagctcaaggaccgggctgatgagtacacagcactcattatggaagaacttgaccgcgacaatctgggatacattgagcttgaggatctggaggcacttttgctgcaatcgccatctcaagctgctgcaagatcgacaacacaaagctcaaaacttagcaaagctcttagcatgaagcttgcatcaaacaagaacacaggtccactttaccactactggcaagagttcatgtacttccttgaggagaactggaagcgcatttgggttatgactctctggctctcaatctgcattggcctcttcatttggaagttcatccaataccgtaatcgagccgtatttcacatcatgggttattgtgtgtgcactgcaaaaggtgctgcagagaccctcaaattcaatatggccctggttctttttcctgtttgccgaaatacaatcacttggattcgatcaaagacaaagatcggagctgttgtgcccttcaatgacaacataaacttccataaggtaatagcagcaggtgttgcagttggtgttgctttgcatgcaggtgctcacctgacatgtgattttcctcggctgctccatgcaagtgatgttgcctatgaaccaatgaagcctttcttcggagacaaaaggccaccaaattattggtggtttgtaaagggaactgaagggtggacaggtgtggtcatggttgtacttatgactatagcttttgtattggcccagccatggtttcggcgtaataggctcaaggattctaatccccttaagaaaatgactggcttcaatgccttttggtttacgcaccacttatttgttattgtgtatgcactgctcgttgtccatgggatctgcttatatctaagcaggaaatggtacaagaaaacgacttggatgtaccttgctgtccctgtgctcctgtatgtaagtgagcgcattattcggctatttaggagccatgatgctgttaggattcagaaggttgcagtatatccagggaatgttttggctctctatatgtccaagccacctggattcaggtaccggagtgggcagtatatcttcataaactgccgtgctgtctctccatacgaatggcacccattttccattacatcagcaccaggagatgattatcttagtgtccacattcgcacaaggggtgattggacttcacgtcttaggactgtcttctctgaggcatgccgtcctccaactgatggagaaagtggactcctcagagctgacctttccaaggggatcactgagagcaacgccaggttcccaaaactcttaattgatggaccatatggtgctccggcacaagactatcgggaatatgatgtgctcctgctcattggactaggcattggagccactccattgattagcattgtgaaggatgtacttaaccacattcagcatggaggatctgttgcaggcaccgagcctgacggcagtggcaaggccaagaagaggccattcatgacaaagagagcctacttctactgggtgaccagagaagagggatcttttgaatggttccgaggggtcatgaatgaggtggctgagaaggacaaggatggagtcattgaactccacaaccactgctcgagtgtgtacgaggaaggggatgcacgttctgccctcattgtcatgctccaagagctccagcacgcaaaaaagggagtcgacatcttgtctggaactagtgtcaagacgcactttgcgcgtcccaattggcgaagcgtcttcaaacatgttgcagtgaaccatgagaaccaacgcgtcggagttttctactgcggtgagcccgtccttgtgccacagctacggcagttttcagcagacttcacccacaagacaaatacaaagtttgagttccacaaggagaacttctaa

SEQ ID NO: 20711 - protein, 889 aa, Sorghum bicolor
  misc_feature: Ceres ANNOT ID no. 8660998
  misc_feature: Up-regulated in root tissues in response to methyl jasmonate treatment
  misc_feature: Up-regulated in shoot tissues in response to aminocyclopropane carboxylic treatment
  misc_feature: Up-regulated in shoot tissues in response to methyl jasmonate treatment
  misc_feature: Up-regulated in shoot tissues in response to salicylic acid treatment
  misc_feature (327)..(663): SWISSPROT Homolog: EC 1.6.3.1 NAD(P)H oxidase
  misc_feature (703)..(872): Pfam ID: NAD_binding_6 Pfam Description: Ferric reductase NAD binding domain
  misc_feature (119)..(217): Pfam ID: NADPH_Ox Pfam Description: Respiratory burst NADPH oxidase
  misc_feature (576)..(697): Pfam ID: FAD_binding_8 Pfam Description: FAD-binding domain
  misc_feature (378)..(536): Pfam ID: Ferric_reduct Pfam Description: Ferric reductase like transmembrane component
  misc_feature (218)..(246): Pfam ID: efhand Pfam Description: EF hand
MDTGSSRRSQDDTATLIPHSGNLGESSQKGVKTTRFKDDDEVVEITIVQRDSVAIEDVRAVDDGSGHGGGFDGLSLVSPSSSRSGKLSSKIRQVKNGLKMKSSSSKAPQTQLGKNVRKRLNRSKSGAAVALKGLQFVTAKVGHDGWAAVEKRFNQLQVDGVLLRSRFGKCIGMDGSDEFAVQVFDSLARKRGITKQLLTKDELKDFWEQLSDQGFDNRLQTFFDMVDKNADGRITAEEVKEIITLSASANKLSKLKDRADEYTALIMEELDRDNLGYIELEDLEALLLQSPSQAAARSTTQSSKLSKALSMKLASNKNTGPLYHYWQEFMYFLEENWKRIWVMTLWLSICIGLFIWKFIQYRNRAVFHIMGYCVCTAKGAAETLKFNMALVLFPVCRNTITWIRSKTKIGAVVPFNDNINFHKVIAAGVAVGVALHAGAHLTCDFPRLLHASDVAYEPMKPFFGDKRPPNYWWFVKGTEGWTGVVMVVLMTIAFVLAQPWFRRNRLKDSNPLKKMTGFNAFWFTHHLFVIVYALLVVHGICLYLSRKWYKKTTWMYLAVPVLLYVSERIIRLFRSHDAVRIQKVAVYPGNVLALYMSKPPGFRYRSGQYIFINCRAVSPYEWHPFSITSAPGDDYLSVHIRTRGDWTSRLRTVFSEACRPPTDGESGLLRADLSKGITESNARFPKLLIDGPYGAPAQDYREYDVLLLIGLGIGATPLISIVKDVLNHIQHGGSVAGTEPDGSGKAKKRPFMTKRAYFYWVTREEGSFEWFRGVMNEVAEKDKDGVIELHNHCSSVYEEGDARSALIVMLQELQHAKKGVDILSGTSVKTHFARPNWRSVFKHVAVNHENQRVGVFYCGEPVLVPQLRQFSADFTHKTNTKFEFHKENF

SEQ ID NO: 20712 - DNA, 1329 bp, Sorghum bicolor
  misc_feature: Ceres ANNOT ID no. 8661132
  misc_feature: Up-regulated in shoot tissues in response to salicylic acid treatment
  misc_feature: Encodes the peptide sequence at SEQ ID NO 20713
atggctgcagttagcattgaaaacaacctatctcctccagaaactctacagaaattgtcagacagtctcacatcaatgcttcctttgctttcagaattgtctgatattataccaagggatactcttttgtggaagctcaaacttcttaaggcaggagcagcctatgcaaattctcgtcttcatgctgtgcaagccgaagttctacttcttgccagtggtaaggacaatcttctacctagtggagaagaagcggatcgactcttcaaggcactgaaaaactgcagagttcgatacttcaaggacaatggtcatacactactcttggaggatggtgtcaatctgttatctgtcataaaaggagcaaacatgtatcgccgtggaaggcaaagggattttgtaaccaattatctcccccctactttaagtgaattcaagcaaacatttgatgtggatcacaaactgtttcaccttgcactgagcccagtcatgatgtctaccctgaagaatggaaaagttgttcgcgggctttctggtgttcctgataaaggtcctgtcttgtttgtgggctatcatgcgctgatgggtattgagttgagtcctctgtatgaagagttccttagggagaagaagacagttgttcgtggcatggctcatccatttctgtttggaaacaaatttgactcatcgcgccaggagatatctcggatcgatactgtttctatgtatggtggattaccggtcaccccaatcaatatgtacaggttattcaagaggaatgactttgttctgctttatcctggcggagttcgggaagctctgcataggaagggtgaagaatacaagttgttttggccagatcaaccagaattcgtaagaatggccgcgcgctttgatgttactatcataccctttgggtgtgtaggagaggatgacgttctagagttggttctcgattacaatgatcagaagaacattcccggacttcgggagtggatagagtcaatcaacaaagaagccgagagagtgagggacagcgtaaaaggggaggatggaaatcaagacatgtacttgccagctcttctcccaaaagtacctggtcgattctactatctattcggccaaccgattgaaatgaaagggatgaacaaccttgtcagagatagaaagaggaccaacgaggtgtatttacgtatcaaatcagaagtggaggagataatgtcatatctcaagaggaagagagaggaagacccttacaggagtatagcgcagcgtgcgctgtaccaggcaacatggggcgcctctgctcaggtcccaacttttgagccatga

SEQ ID NO: 20713 - protein, 442 aa, Sorghum bicolor
  misc_feature: Ceres ANNOT ID no. 8661132
  misc_feature: Up-regulated in shoot tissues in response to salicylic acid treatment
MAAVSIENNLSPPETLQKLSDSLTSMLPLLSELSDIIPRDTLLWKLKLLKAGAAYANSRLHAVQAEVLLLASGKDNLLPSGEEADRLFKALKNCRVRYFKDNGHTLLLEDGVNLLSVIKGANMYRRGRQRDFVTNYLPPTLSEFKQTFDVDHKLFHLALSPVMMSTLKNGKVVRGLSGVPDKGPVLFVGYHALMGIELSPLYEEFLREKKTVVRGMAHPFLFGNKFDSSRQEISRIDTVSMYGGLPVTPINMYRLFKRNDFVLLYPGGVREALHRKGEEYKLFWPDQPEFVRMAARFDVTIIPFGCVGEDDVLELVLDYNDQKNIPGLREWIESINKEAERVRDSVKGEDGNQDMYLPALLPKVPGRFYYLFGQPIEMKGMNNLVRDRKRTNEVYLRIKSEVEEIMSYLKRKREEDPYRSIAQRALYQATWGASAQVPTFEP

SEQ ID NO: 20714 - DNA, 1239 bp, Sorghum bicolor
  misc_feature: Ceres ANNOT ID no. 8662351
  misc_feature: Up-regulated in shoot tissues in response to methyl jasmonate treatment
  misc_feature: Up-regulated in root tissues in response to methyl jasmonate treatment
  misc_feature: Up-regulated in root tissues in response to salicylic acid treatment
  misc_feature: Encodes the peptide sequence at SEQ ID NO 20715
atgtcgtcgtcgtcagggtcgtcttcggcggcggcgcaccaccagcagcattaccggcaccagacaggagggagtggtctcgtgccgctcgccgcgctcatcaaggaggaggcccgcacggagcgccactccgtagccagcggcgaaagcaggatctccgcgcgcgacgaggacgcggcgggagtaggaaactcaggcgtaggaggggaggtggcggcggagacgcggctggagcgcccgctgctgcgctatgggtgcgccgcgcagtgcaaaaagggcgaggacttcttcttgctcagaacggactgcccgcgtcccgccatctccgtctccttcccagactccccgcaccctaccttcgccgtcttcgccgtacttgatggccataatggtaacgctgccgcaatatacacaagagacaatttgctcaaccatgtccttagtgctatgccaagggggctgtccagggatgagtggttgcacatgttgcccatagcactggtcgcagggtttgttaagactgacaaggagttccagagcaaagggcaaacttctggcacaaccgctacatttgtgataattgatggatggactatcactgttgcatctgttggtgattctcgctgtattttagatgcccagggtggggctgtttctttgcttactgtggatcacagactagaagaaaacattgaggagagggagcgcgttacagcaagtggaggtgaagttggaaggctcagtgttgttggcggagcagagattggtccgctacgatgctggccaggaggtctatgcttatcaagatccattggagatattgatgttggcgaatttattgtccctgttccatatgtgaagcaagtgaagttgtcaaatgctggaggaagacttattattgcttcagatggcatttgggatgcattatcctcagaagcagctgctaagtcttgcagaggtttgcctgctgagcttgccgcaaagcaagttgttaaggaggcactcaggactagagggctaaaggatgatacaacttgcattgttgttgacataatcccacctggtcaaacaatacagcctctgtctcctccgaaaaagatgagcaagctgaagtctttaatctttagaaagaaagcaaaggacccttctcagaagttgactaaacaacattcagctgttggtatcgttgaagagatatttgaagaaggttcggccatgctatcagaaagaattttctag

SEQ ID NO: 20715 - protein, 412 aa, Sorghum bicolor
  misc_feature: Ceres ANNOT ID no. 8662351
  misc_feature: Up-regulated in shoot tissues in response to methyl jasmonate treatment
  misc_feature: Up-regulated in root tissues in response to methyl jasmonate treatment
  misc_feature: Up-regulated in root tissues in response to salicylic acid treatment
  misc_feature (116)..(319): SWISSPROT Homolog: EC 3.1.3.16 Phosphoprotein phosphatase
  misc_feature (84)..(344): Pfam ID: PP2C Pfam Description: Protein phosphatase 2C
MSSSSGSSSAAAHHQQHYRHQTGGSGLVPLAALIKEEARTERHSVASGESRISARDEDAAGVGNSGVGGEVAAETRLERPLLRYGCAAQCKKGEDFFLLRTDCPRPAISVSFPDSPHPTFAVFAVLDGHNGNAAAIYTRDNLLNHVLSAMPRGLSRDEWLHMLPIALVAGFVKTDKEFQSKGQTSGTTATFVIIDGWTITVASVGDSRCILDAQGGAVSLLTVDHRLEENIEERERVTASGGEVGRLSVVGGAEIGPLRCWPGGLCLSRSIGDIDVGEFIVPVPYVKQVKLSNAGGRLIIASDGIWDALSSEAAAKSCRGLPAELAAKQVVKEALRTRGLKDDTTCIVVDIIPPGQTIQPLSPPKKMSKLKSLIFRKKAKDPSQKLTKQHSAVGIVEEIFEEGSAMLSERIF

SEQ ID NO: 20716 - DNA, 1194 bp, Sorghum bicolor
  misc_feature: Ceres ANNOT ID no. 8664236
  misc_feature: Up-regulated in root tissues in response to salicylic acid treatment
  misc_feature: Encodes the peptide sequence at SEQ ID NO 20717
atgggggggaaaaaaaaagaaggaaaagattccattgagacaattatgagtttgattgagtttccgttactcgaccaaacaagttctaattccgttatttcaactacaccaaacgatctttcgaattggtcaagactctcaagtttatggccccttctatatggtaccagttgttgtttcattgaatttgcctcattaataggctcgcgattcgactttgatcgttatggattggtaccgagatcaagtcctagacaagcggacctaattttaacagctggtacggtaacaatgaaaatggctccatctttagtgcgattatatgagcaaatgcctgaaccgaaatacgtcattgctatgggagcctgtactattacagggggcatgttcagtacagattcctatagtactgttcgaggagttgataagttaattcctgtggacgtctacctgccgggttgcccgcctaaaccagaggctgttatagatgccctaacaaaacttcgtaagaagatagcgcgagaaataattgaggatcgaactctatgtcaaagtcaaaagaaaaatagatcttttactacccgtcacaaactttatgttcggcgcagtactcacactggaacttacgaacaagaattgctctatcaatcaccatctactttagatatatcttctgaaacttttttcaaatccaaaagttcagtatcttcctacaaattacagggttggttatctaattggctagttaaacatgacgtggttcataggtctttgggcttcgatcatcgaggagtcgagactttacaaataaaagcgggggattgggattccattgctgtcattttatatgtatatggttacaattatttacgttcccaatgtgcttatgacgtagcacccggtggatctttagctagcgtgtatcatcttacgagaatacagtatggtatagataacccagaagaggtatgcataaaagtctttgcccaaaaggataatcctagaatcccgtctgttttctgggtttggagaagtgccgattttcaagaacgcgaatcttatgatatggtgggaatttcttatgataatcatccacgtcttaaacgtatcttaatgcctgaaagttggataggctggcccttacgtaaggactatataacccccaatttctatgaaatacaagatgctcattga

SEQ ID NO: 20717 - protein, 397 aa, Sorghum bicolor
  misc_feature: Ceres ANNOT ID no. 8664236
  misc_feature: Up-regulated in root tissues in response to salicylic acid treatment
  misc_feature (23)..(174): SWISSPROT Homolog: EC 1.6.99.5 NADH dehydrogenase (quinone)
  misc_feature (61)..(169): Pfam ID: Oxidored_q6 Pfam Description: NADH ubiquinone oxidoreductase, 20 Kd subunit
  misc_feature (325)..(393): Pfam ID: Complex1_30kDa Pfam Description: Respiratory-chain NADH dehydrogenase, 30 Kd subunit
MGGKKKEGKDSIETIMSLIEFPLLDQTSSNSVISTTPNDLSNWSRLSSLWPLLYGTSCCFIEFASLIGSRFDFDRYGLVPRSSPRQADLILTAGTVTMKMAPSLVRLYEQMPEPKYVIAMGACTITGGMFSTDSYSTVRGVDKLIPVDVYLPGCPPKPEAVIDALTKLRKKIAREIIEDRTLCQSQKKNRSFTTRHKLYVRRSTHTGTYEQELLYQSPSTLDISSETFFKSKSSVSSYKLQGWLSNWLVKHDVVHRSLGFDHRGVETLQIKAGDWDSIAVILYVYGYNYLRSQCAYDVAPGGSLASVYHLTRIQYGIDNPEEVCIKVFAQKDNPRIPSVFWVWRSADFQERESYDMVGISYDNHPRLKRILMPESWIGWPLRKDYITPNFYEIQDAH

SEQ ID NO: 20718 - DNA, 786 bp, Sorghum bicolor
  misc_feature: Ceres ANNOT ID no. 8666363
  misc_feature: Down-regulated in root tissues in response to methyl jasmonate treatment
  misc_feature: Down-regulated in shoot tissues in response to aminocyclopropane carboxylic treatment
  misc_feature: Down-regulated in shoot tissues in response to methyl jasmonate treatment
  misc_feature: Down-regulated in shoot tissues in response to salicylic acid treatment
  misc_feature: Encodes the peptide sequence at SEQ ID NO 20719
atgtcgacgcccgcgcttgcgacggctgccgagggagcgacgcgcatcatcctggtgcacggcacgggccatggcgggtggtgctggtaccgggtcgccacgctgctccgcgccgcgggacaccgcgtggacgcgccggacatggcggcgtctggcatcgactcgcggcagctccgcgacgtgcccaccttcgaggactacacgcggccgctgctcgacgcgctccgggcgctcctgccgggagagaaggcggtcctggtcggccacagcttcggcggcatgaacatcgcgctcgccgcggagatgttcccggagaaagtggctgccgccgtgtttgtcaccgcgttcctgccggactgcaccaacccacgctcgcacgtcatcgagaaggttatcgggtcagactggatggacaccgtcacggatgcagagcacgtcccaccctcggtgttcctggggcctgaattcctacgccacaagctctaccagctgagcccaccggagaactacacgctgtcccagagcctggcccgggtgagctccttctacgtgccagacctgcagagccagacgccgttcagcgagtccaggtacggcgccgtgaggaaggtgtacgtggtctgcaagcacgacctggccataaccgaggcgtaccagcacacgatgatcgccggctgccccgtggaggaggtgagggagatcgccgccgccgaccacatgcccatgttctccacaccggctgagctcgctgggcacctcgcccacgtcgccaacaagtacgcttga

SEQ ID NO: 20719 - protein, 261 aa, Sorghum bicolor
  misc_feature: Ceres ANNOT ID no. 8666363
  misc_feature: Down-regulated in root tissues in response to methyl jasmonate treatment
  misc_feature: Down-regulated in shoot tissues in response to aminocyclopropane carboxylic treatment
  misc_feature: Down-regulated in shoot tissues in response to methyl jasmonate treatment
  misc_feature: Down-regulated in shoot tissues in response to salicylic acid treatment
  misc_feature (7)..(258): SWISSPROT Homolog: EC 3.1.1.78 Polyneuridine-aldehyde esterase
  misc_feature (41)..(255): Pfam ID: Abhydrolase_1 Pfam Description: alpha/beta hydrolase fold
MSTPALATAAEGATRIILVHGTGHGGWCWYRVATLLRAAGHRVDAPDMAASGIDSRQLRDVPTFEDYTRPLLDALRALLPGEKAVLVGHSFGGMNIALAAEMFPEKVAAAVFVTAFLPDCTNPRSHVIEKVIGSDWMDTVTDAEHVPPSVFLGPEFLRHKLYQLSPPENYTLSQSLARVSSFYVPDLQSQTPFSESRYGAVRKVYVVCKHDLAITEAYQHTMIAGCPVEEVREIAAADHMPMFSTPAELAGHLAHVANKYA

SEQ ID NO: 20720 - DNA, 1731 bp, Sorghum bicolor
  misc_feature: Ceres ANNOT ID no. 8666684
  misc_feature: Down-regulated in root tissues in response to methyl jasmonate treatment
  misc_feature: Down-regulated in shoot tissues in response to methyl jasmonate treatment
  misc_feature: Encodes the peptide sequence at SEQ ID NO 20721
atgactctgaggctgctcaccaccacagagcgcaaccatcttctctccccgaagccacagagcccccgggatgccgccctgtcgctgctgaggtcacccaggctgtcctgcggtggtactggtagccccaagcccaagagcgccaagatggcgcacggcggcctggagcgctcgctcagcttcaagaactgggaggcgtcaacggaggcggcggcggccagccggggcggcggcggcatcaacggcacgcgcccgggcaccctggccctgcagcagcagcagcagcagagcccccggcgcgtttccccgcaggcgcaggccatgatcgagtacatctcccctcgcccccgcgtggagctggaccaggcggccaccaagctgcagaagatctacaagggcctccgcacccgccgcaacctcgccgacggcgccatcatcgccgaggagctctggtggaagacggtcgactccgtctacctcaacatcaagtccatctccttcttccacgaggacaagcaggagaccgccgcgtcccggtggtccagggccggcaagaggatcgccaaggtcggcaagggtctctccaaggacgacaaggcgcagaagctcgctctccagcactggctcgaagctattgacccgcgccaccggtacggccacaacctgcacctctactacgacatctggtcggccagctccagctgcgagcccttcttctactggctggatgtgggcagcggcagggacctgcaccaccacaagtgcccacggagcaagctcaactcgcagctcatcatgtacctcggaccagtggagagggcggcgtacgaggtcgtcgtggaggaaggccggctgctgtacaagcagagcggagacctggtgaccacgaacgaggagtccaagtggatcttcgtgctcagcaccagcaggtcgctctacgtcggccagaagcgcaagggcaagttccagcactcgagcttcctgtccggcgccgccacctccgccgccggcaggctcgtcgccaaggagggcgtcctcaaggccatatggccctacagcggccactacctccccaccgaggagaacttcagggagttcatcactttccttgaggaaaacaacgtcgacctcgcaaatgtcaagcggtgctccgtggacgacgacgagtacccgtcgttcaagaagccggcggcggcggcggcagaggaggccgccccagtggccagcaccgaagaaggcgatgcacacgctgaggctgaggccgagcaaccaccagtggtggagctgcccgcggtggacatcgtgaaggaggaggccacggacgtgcaggagccggcgaagatgatgatggccagccggcggccgtcgttcaagtggtcgacgccgacgggcgcgcgcatcgggtgcctgcagaactacccggccgacgtgcagagcatggcgctggagcaggtcaacctgtcgccgagggtggcggtggcgccgtcgccgaggctgcccatcccgtcgccgcgccccagccccaagatcaggctgtcgcccaacctgcactacatggggtgccccaccccgacggccacgggcggcgccgccgccaccaccaccaccaccaccagcaggctcgcgatcccgagcccggcggccaggcgctcgtcgcccaagcagcacttcatgggcttccacacgcccgccgtggcgctcacgctccccaagcacaaggcggccaagtga

SEQ ID NO: 20721 - protein, 576 aa, Sorghum bicolor
  misc_feature: Ceres ANNOT ID no. 8666684
  misc_feature: Down-regulated in root tissues in response to methyl jasmonate treatment
  misc_feature: Down-regulated in shoot tissues in response to methyl jasmonate treatment
MTLRLLTTTERNHLLSPKPQSPRDAALSLLRSPRLSCGGTGSPKPKSAKMAHGGLERSLSFKNWEASTEAAAASRGGGGINGTRPGTLALQQQQQQSPRRVSPQAQAMIEYISPRPRVELDQAATKLQKIYKGLRTRRNLADGAIIAEELWWKTVDSVYLNIKSISFFHEDKQETAASRWSRAGKRIAKVGKGLSKDDKAQKLALQHWLEAIDPRHRYGHNLHLYYDIWSASSSCEPFFYWLDVGSGRDLHHHKCPRSKLNSQLIMYLGPVERAAYEVVVEEGRLLYKQSGDLVTTNEESKWIFVLSTSRSLYVGQKRKGKFQHSSFLSGAATSAAGRLVAKEGVLKAIWPYSGHYLPTEENFREFITFLEENNVDLANVKRCSVDDDEYPSFKKPAAAAAEEAAPVASTEEGDAHAEAEAEQPPVVELPAVDIVKEEATDVQEPAKMMMASRRPSFKWSTPTGARIGCLQNYPADVQSMALEQVNLSPRVAVAPSPRLPIPSPRPSPKIRLSPNLHYMGCPTPTATGGAAATTTTTTSRLAIPSPAARRSSPKQHFMGFHTPAVALTLPKHKAAK

SEQ ID NO: 20722 - DNA, 1548 bp, Sorghum bicolor
  misc_feature: Ceres ANNOT ID no. 8666748
  misc_feature: Up-regulated in root tissues in response to methyl jasmonate treatment
  misc_feature: Down-regulated in shoot tissues in response to methyl jasmonate treatment
  misc_feature: Down-regulated in shoot tissues in response to aminocyclopropane carboxylic treatment
  misc_feature: Down-regulated in shoot tissues in response to salicylic acid treatment
  misc_feature: Encodes the peptide sequence at SEQ ID NO 20723
atgggatcgtcgtcgcggatcttcgagtacttcgtagtgtgcgggctgggcccggagatccggtccctggatggcatcaagggtttccatggtgttgaggagatgtacatgtcggccttcctagaccagttcccgccgtccaaccacgctctgtaccctccgccgccgccgcagctccccacctgtgttttgccagcgggagtaagaatatattcttcagggctggacacagatgatgtctcaacttatccacgtagttatcctatagttttaacagagggagatggctcaaaaatttatgtcagttgtattgcatttcgggatcctatttgtgaagatataattgaagcctaccaaattccagcgaactcctttgctgataaatgcatctgccttgtgtcccattctcctagtttccaagtccttcgtgatgcccttgaggaaatatttgttctttgtttttctcctgcagggtgtagcaagcctttgtgggacataatatctcatatggtgtcacatgtgacattacccacaccaggaaagaatcgtgtcttatttgccattgagaattgtcttctttctgcggaagctcctccaaaagaatggcttccccacgctgatatatcgttccagccattggtgcagtgtctggatgttgataaactaatactgctctttactgctgtcctgcttgaaagaaggatattgcttcgatcaaataagtatactctattgactctagtttcagaagccatttgccatttaatatacccaattaggtggcagcatgtctatattccaataatattctctagtggggttgattacattgatgccccgacaccctacatgatgggacttcattctggtgttgacacatctgcggtgacaatggatggtgtagtggtggtagatcttgaatacaaccggataacaacgtcagaagaaattcctccaataccagaaactgaacatagcttccttcgtggtgagatattaaaattactacaacccaatgtcatgggaattgatttcatgaaagtcaatcttgccaatatgagtgaccgttctttaagggctggcacaaaatcatggagtcaggaacatgatttccaacttaggctgatatttttgagattctttgcacagatcctgagtggttaccgtaacttcattgatactacttcaacgactggtttcaattctcaagcttttctgaaaaagcgttctcgagcaactaatcagcctgtcgagtccatgtcaatgattctatgttcattggtcaccaaaaccaaagaggggtggtttaggagacaagagtatatgagcaagagacaaatttggggcttgtttgacagggctcaagacgagctccacaatagagctatgtggatccctgccaaacaggtggattatttgtacctacaatttcatttttttcctcaaaaacgcaggagggggggtaagaacccatacaacacaacacacacaaactctgcagcagcagcagcagcagcagctgctgctaagaaactaacgcgcctgtga

SEQ ID NO: 20723 - protein, 515 aa, Sorghum bicolor
  misc_feature: Ceres ANNOT ID no. 8666748
  misc_feature: Up-regulated in root tissues in response to methyl jasmonate treatment
  misc_feature: Down-regulated in shoot tissues in response to methyl jasmonate treatment
  misc_feature: Down-regulated in shoot tissues in response to aminocyclopropane carboxylic treatment
  misc_feature: Down-regulated in shoot tissues in response to salicylic acid treatment
  misc_feature (125)..(309): Pfam ID: DENN Pfam Description: DENN (AEX-3) domain
  misc_feature (369)..(432): Pfam ID: dDENN Pfam Description: dDENN domain
MGSSSRIFEYFVVCGLGPEIRSLDGIKGFHGVEEMYMSAFLDQFPPSNHALYPPPPPQLPTCVLPAGVRIYSSGLDTDDVSTYPRSYPIVLTEGDGSKIYVSCIAFRDPICEDIIEAYQIPANSFADKCICLVSHSPSFQVLRDALEEIFVLCFSPAGCSKPLWDIISHMVSHVTLPTPGKNRVLFAIENCLLSAEAPPKEWLPHADISFQPLVQCLDVDKLILLFTAVLLERRILLRSNKYTLLTLVSEAICHLIYPIRWQHVYIPIIFSSGVDYIDAPTPYMMGLHSGVDTSAVTMDGVVVVDLEYNRITTSEEIPPIPETEHSFLRGEILKLLQPNVMGIDFMKVNLANMSDRSLRAGTKSWSQEHDFQLRLIFLRFFAQILSGYRNFIDTTSTTGFNSQAFLKKRSRATNQPVESMSMILCSLVTKTKEGWFRRQEYMSKRQIWGLFDRAQDELHNRAMWIPAKQVDYLYLQFHFFPQKRRRGGKNPYNTTHTNSAAAAAAAAAAKKLTRL

SEQ ID NO: 20724 - DNA, 2367 bp, Sorghum bicolor
  misc_feature: Ceres ANNOT ID no. 8666873
  misc_feature: Up-regulated in shoot tissues in response to salicylic acid treatment
  misc_feature: Encodes the peptide sequence at SEQ ID NO 20725
atgccagtatatcctgagattgatgaagttatcataagtatattgttgtctacgaacatatcagtgttgtattgtgagtataggagcaaggagccgtacactagcttcaaggtgaagagcggtggcagttacgagcttgacaacgtgcagccacaacagcagccagcagggaaagtaccaatttgggagttccagctggtgctgctgtctgcattcttccaaggcaatcagtggggaatttttgttccttggtggcagatgggttgctccaactctaaagtggacaatgaggagcccgtgaggcgctccaaggacaggaagcagctcatgaagcagcttgtgcgccgccgtcctgagcttgcagctgcgcacattgcatacctgcacgccctccgcaacacaggagccactctccggcaatttgtggagctggagtctgcactgtcacagcagcctcctgaaggccttgcggcgccgccctcgcctgctccacagccgccgccgcgaccaccacctcctgaaccctcagtcacatcctcattgccaccctcgccacgccccccgccgcctctcccttttagtccaataaccaccataaggaagatggagaagagagatgatgagctgccaccaccacctctggttttgagtccaataagattaagaaagagggatgatgagctccatgggggtgattttactgatgatgatgatgacaccgacagctgctcaactcctctaccaccacccctgccacccggcatagattgggaggaattggatccctacaatgtgcgccccttgagtttcccatctccatttgctgataggaacgataaagaagtggcttcacaggttaccatggacaatgatcctgaggtagacacagaatttgatggagaggaggatgcaagtgtgcttggcattgatgatggcattgtggacagggtccatgtgaatccagccaagggtagggctctgggtgatgtcaactcttcaatggtgagcagggtgacaaaggattcagactctatggcggtgccttggaggagtaagaagtcacttgttgagattgttaaggagattgatgagtacttcttgaaagcagcagcaagtgggaaagacgttgtgattcttttggactctgctggtgggcggcctgatgccttagagatagaggcaaagaaaggtgcgggaaaaaattccaaatctgcgaaggttttctccacgctttcttggagctggtcttttaaatctcagcaggctaacagcgaatcctcagttctgaattctagtgattcctctggatatggttaccatggcaagacgctggagaagctttatgatgaggagcaaaaactctacaagttaatcaaggatgaagaatttgcaaggcttcagtataagaaacatgtctcagtgctacaaaagctagaatcaggggaacatgatagactgcatgcagaaagagtacgggatgctattgaagaactgcagactcggataatctcattggaggaagctgtgagtttggcgtgtttttccatatcaaatctcagagatgaggaattatatcctcagattattgaactatctgctgggcttgtgcatatgtggagaaacatgtacgagtgccatcaggtccagaaccatattgcccagcaagttagtctccttggcaacatacctgggagtgaaccaacaagtgacactcattgccaggcaacatctcagctggaaattgaggtgtctggatggcacaatgccttctgcaatctcatcacattgcagcgtgaatacattagcatccttaaccaatggattggtctcacagactgccttccagatgatggtggcttaatgagaagttcatctggaatacgtagcctctctgaggaactccagcgtgctcttgacaggctaccagagaagatagcagctgaagcaataatgacctttatgtcaatcatacactctatagttgtacagcagagtcaggagcgccaactaaagaagaagtcagataacatggatagcaagttccagacccagttagagaaacacagtgaaaatgcaatgcaaaattcagcccagcctccaaataagaatcactattcagtatcaaagaatgaaacgaaactggatgcatttagaaagcaggttgaggaggaaaaggccagatacctaacctctgtgagagtaagccgagccatgacactgaacaatctgcagacaagccttccaaatgtgttccatgctctggtgggcttctcaggaatgtgtgtgcaggcatttgaaggtatcagcagatgcagtgaagttgctgttattcactccggagcggcttcacctgctatttgctcgtga

SEQ ID NO: 20725 - protein, 788 aa, Sorghum bicolor
  misc_feature: Ceres ANNOT ID no. 8666873
  misc_feature: Up-regulated in shoot tissues in response to salicylic acid treatment
MPVYPEIDEVIISILLSTNISVLYCEYRSKEPYTSFKVKSGGSYELDNVQPQQQPAGKVPIWEFQLVLLSAFFQGNQWGIFVPWWQMGCSNSKVDNEEPVRRSKDRKQLMKQLVRRRPELAAAHIAYLHALRNTGATLRQFVELESALSQQPPEGLAAPPSPAPQPPPRPPPPEPSVTSSLPPSPRPPPPLPFSPITTIRKMEKRDDELPPPPLVLSPIRLRKRDDELHGGDFTDDDDDTDSCSTPLPPPLPPGIDWEELDPYNVRPLSFPSPFADRNDKEVASQVTMDNDPEVDTEFDGEEDASVLGIDDGIVDRVHVNPAKGRALGDVNSSMVSRVTKDSDSMAVPWRSKKSLVEIVKEIDEYFLKAAASGKDVVILLDSAGGRPDALEIEAKKGAGKNSKSAKVFSTLSWSWSFKSQQANSESSVLNSSDSSGYGYHGKTLEKLYDEEQKLYKLIKDEEFARLQYKKHVSVLQKLESGEHDRLHAERVRDAIEELQTRIISLEEAVSLACFSISNLRDEELYPQIIELSAGLVHMWRNMYECHQVQNHIAQQVSLLGNIPGSEPTSDTHCQATSQLEIEVSGWHNAFCNLITLQREYISILNQWIGLTDCLPDDGGLMRSSSGIRSLSEELQRALDRLPEKIAAEAIMTFMSIIHSIVVQQSQERQLKKKSDNMDSKFQTQLEKHSENAMQNSAQPPNKNHYSVSKNETKLDAFRKQVEEEKARYLTSVRVSRAMTLNNLQTSLPNVFHALVGFSGMCVQAFEGISRCSEVAVIHSGAASPAICS

SEQ ID NO: 20726 - DNA, 3564 bp, Sorghum bicolor
  misc_feature: Ceres ANNOT ID no. 8667341
  misc_feature: Up-regulated in root tissues in response to salicylic acid treatment
  misc_feature: Up-regulated in shoot tissues in response to salicylic acid treatment
  misc_feature: Encodes the peptide sequence at SEQ ID NO 20727
atgttctcttttgagcaaacaaacagagcacaacgatctttctccgctggttcaatcgaccgctcctcttcttcttctcccaaaaccctacgggccacggccaatcccccgctgcgattcgaccgatcgccgccggatcggagttaccgctcggatcatcaaccccaggcacgcacccgccgccggagcccggacggagacgatgcacagggacgtcgaggccgagtgcgcgccgtgctgccgcatatgcctctcgacggacaaccaccgcgctgcattagcttattacacagcaatcctgctgctgagctgtttctaattgatgcttctcttggtttaggactttttggtgcaggacatgagctcatatctccctgtaggtgcaaggggtcacaacagtttgtacaccgctcctgcctagaccagtggagaggtgtcaaggaagggactgctttttcacactgtactacttgcaaagcacagttccatctcctggttgagcttctggaggatgacatgtgtcttagaatgaagttctggttgtttgtttctagagatgtcttcctcatctttgtcgcaatacaagccgtcattgttgctattgctggcgtgacatttctgtcggacagagatggaaaattcagaaacaggtttactgactggatgctgtcaaagcatcctctacccttctactattgtgttggtgtggtgttcttctttgcactggttggactttttgggctgctatcacactgtttttcttgcgattatggtggcgatgatccatcatacctgcccgagcccgagtgctcctacggatgcctggactgcgagacctcacgcacctcacgctcaggggacgatgatgattgcatttgtgttgttatcatggtcgttgttctagttttcgctctccttggaatcttttatggtttcattgcagcaactatggccttccagaagattatgcagcgccactatcacatactgaaaaaaaaggagctgacaaagcgcagaggctacccccgccctcgccgcggctactcgggaaggccctcgacgccgcccccggacgcggccgctgagatcgtcagcggggattcccatcgcagcgccgttcgcgccgccaacgaatccctgcgtcgcggcggcggcgtccgcgggcccccaccgccctacaggcaggagcctcaccctcaccaaccgcagtacggctacggctatggctacggatacggccagacgcagcagccgagcccgccttatgggtttgtgccgtacaactacggccacccgcagccgctgccgccggggcctcagtacggctacggggctccgaacccgtacgttcacggtcagctgcggccgcagccttatgggcgcggggcaccgagtgcagggttccgccctggcgcaccgcagctgcctccgaggctggcagattaccgccgacggtggcgctttgcgaagcagaggccgccacatcaagctgagaggtttaaggttctatcgtacaatatacttgcggactatctggcccaggagcaccagtttctgtatgaacgaataccatctttcatcctggattggaactggcgcaaggataagttactgtttgagtttggcctgtggtctccagacattctatgtcttcaggaggttgacaaatttacagaccttgaacaagaaatggcaagccgaggatataacggcacatggaagatacggactggagatgcagctgatggatgtgctattttttggagaacaacaaggttccagttacgctacgaagaggacattgaattcaacaagcttggacttcgtgataatgttgcgcagctctgtgttttagagtcggtggtccctcaaaatgtgcaaactgactctactagtttatctacaagctctaacgatccacaacaagctaaacaagttgttatatgtaatattcatgttctttataatccgaagagaggggacatcaaacttggtcaggtcaggacacttctggataaagcttacactctatccaaaatgtggaataatgctccagtgatactttgtggagatttcaactctacacccaagagtccactgtacaagtttatgttggagcaaaagttgaatttgtctggccttgcgaaaaatactatatctggacagcaaactggtggtagttcacaggggctatatactggccctaatatatctcgatcccatccacctttttctccaaccaacaatagagagggaaacataactcttctaaatgattgtaagcctcaaactgaaacaacaaagttggtggagaattcttcccctgctggaagagaaccttttttaactgatacctcttcagagtctctcgttgactccaaatctttttctcgaacaaccgttgactccaaatcaagttacagttgtggcaataatgtaccttgttctggctcttctaagctcgatgatcaaggattattgaactctttggaagatactgtaaagagtgcctgtgcttttgatgctgatgaagagtgtaaacccactgacaaggggtctcctggagggatcacaactgaatctggagaaggacctgacattgcagatgctccgtctgctccagctacagtttatactgagatccttaggtcaggttcatgtgaaataattgatagcagtcagctgctttcttcagacaacttggctggtgatgtgatttcagaagaacttacagatcaactgtttactgtctcacaagataagcctcatgaaaaggaaaataacactgaatccatgttgtctgctgaagagaattgtgcaactaaagaaccagagtcatctcatttcaatggttctcagaatgtcactgatgccattcaccagatgagtaatgtgaagctagaaggagaaagtagtgctggagtagaagaaccagtacatcaaccaaatggtgctgtttcagatgcatgtgtcgatcaatgttctgctgaagtgataaagagtcattcagtctcttgtagagatgagcctgaaaacaatgctcatgctcttgaggatgatacagcaaatggtgaagttacctgtacagatgtgaactctgaccctactttctttgaagagttatctggtggtaatggtcacttacttgaagaggaagatcagcttccagaaacttcagatagttcaccatcttctcagcaggttactttgaatgaagggtattactattatgatccgtacaggtggacaccagaagaaataaaagctgccactgggaaggacgaatgcacttttatggaacacagtttgaaattaaggagcgtatatactgacgtggaggattttgatggaacaaaagacgccagcaaggaaccactagtgacaagctacaacagaaaattcatgggaacagtagactacatatgggcctcggaaggtctgcatactgttcaagtcttggatacatttcccaaagagattttgaaacaaacaattgggttcccgaccaagaaatggggaagcgatcacattgcccttgcctgtgaattggcttttacaaaatga

SEQ ID NO: 20727 - protein, 1187 aa, Sorghum bicolor
  misc_feature: Ceres ANNOT ID no. 8667341
  misc_feature: Up-regulated in root tissues in response to salicylic acid treatment
  misc_feature: Up-regulated in shoot tissues in response to salicylic acid treatment
  misc_feature (496)..(702): SWISSPROT Homolog: EC 3.1.13.4 Poly(A)-specific ribonuclease
  misc_feature (500)..(1183): Pfam ID: Exo_endo_phos Pfam Description: Endonuclease/Exonuclease/phosphatase family
MFSFEQTNRAQRSFSAGSIDRSSSSSPKTLRATANPPLRFDRSPPDRSYRSDHQPQARTRRRSPDGDDAQGRRGRVRAVLPHMPLDGQPPRCISLLHSNPAAELFLIDASLGLGLFGAGHELISPCRCKGSQQFVHRSCLDQWRGVKEGTAFSHCTTCKAQFHLLVELLEDDMCLRMKFWLFVSRDVFLIFVAIQAVIVAIAGVTFLSDRDGKFRNRFTDWMLSKHPLPFYYCVGVVFFFALVGLFGLLSHCFSCDYGGDDPSYLPEPECSYGCLDCETSRTSRSGDDDDCICVVIMVVVLVFALLGIFYGFIAATMAFQKIMQRHYHILKKKELTKRRGYPRPRRGYSGRPSTPPPDAAAEIVSGDSHRSAVRAANESLRRGGGVRGPPPPYRQEPHPHQPQYGYGYGYGYGQTQQPSPPYGFVPYNYGHPQPLPPGPQYGYGAPNPYVHGQLRPQPYGRGAPSAGFRPGAPQLPPRLADYRRRWRFAKQRPPHQAERFKVLSYNILADYLAQEHQFLYERIPSFILDWNWRKDKLLFEFGLWSPDILCLQEVDKFTDLEQEMASRGYNGTWKIRTGDAADGCAIFWRTTRFQLRYEEDIEFNKLGLRDNVAQLCVLESVVPQNVQTDSTSLSTSSNDPQQAKQVVICNIHVLYNPKRGDIKLGQVRTLLDKAYTLSKMWNNAPVILCGDFNSTPKSPLYKFMLEQKLNLSGLAKNTISGQQTGGSSQGLYTGPNISRSHPPFSPTNNREGNITLLNDCKPQTETTKLVENSSPAGREPFLTDTSSESLVDSKSFSRTTVDSKSSYSCGNNVPCSGSSKLDDQGLLNSLEDTVKSACAFDADEECKPTDKGSPGGITTESGEGPDIADAPSAPATVYTEILRSGSCEIIDSSQLLSSDNLAGDVISEELTDQLFTVSQDKPHEKENNTESMLSAEENCATKEPESSHFNGSQNVTDAIHQMSNVKLEGESSAGVEEPVHQPNGAVSDACVDQCSAEVIKSHSVSCRDEPENNAHALEDDTANGEVTCTDVNSDPTFFEELSGGNGHLLEEEDQLPETSDSSPSSQQVTLNEGYYYYDPYRWTPEEIKAATGKDECTFMEHSLKLRSVYTDVEDFDGTKDASKEPLVTSYNRKFMGTVDYIWASEGLHTVQVLDTFPKEILKQTIGFPTKKWGSDHIALACELAFTK

SEQ ID NO: 20728 - DNA, 2016 bp, Sorghum bicolor
  misc_feature: Ceres ANNOT ID no. 8667366
  misc_feature: Up-regulated in root tissues in response to methyl jasmonate treatment
  misc_feature: Up-regulated in shoot tissues in response to methyl jasmonate treatment
  misc_feature: Encodes the peptide sequence at SEQ ID NO 20729
atggcgtcccaggaaggcgctcggccatccccgtctcccgaatctatggacgcgcacttgcacactgcgtccgcgccgctgacgccgccgatggagattgggccgggagggttgttgccgcagcagcagccgcaaccaccatccccggaaatggcccctccactatgtgattattcagagcctgcacagccatcgccgctgtgtcatccggatgaatgcacaggggcctcgccagacgcaccggtggatgaggttgtggcaggaacgtcaggaaaagcagctaggccgtcaccatgtgaaaattcggagttcgcacagttaccgcagccgcatcttccagctgaaagcacatatgtctgttcaaatgcagcgggcaaggtatcagcagtggcttcagaagatggtactcagcctgcgatggagtcaattgatagcgaggggccattagagattggggtacagagatcattgcaggagccagaggagacaacaacgccctccaggatggaagctgagccttgttcgccagagatggctcctccagggtttgaagattgtaagtctcaatggctgccactgtcagatcctaatcctctggttgaatccacacacactgtggtacaagtgactgccaccaatgccatggacacgacgccagatacagcaactgggtcactgtcacctggcctacttccgctgttgaagagaggggcagaggggcaacatccaagatcatgctctcccacaacagaagctgaaccaggttcaccagatatgccacctccaggctttgagaattgtaagtcatcatggctaccgttaccgacccttcaacccgtagctgaaaccacatacgtgtcacatgatgtggctcccaccaagacaatggcagtgggatttatggaaaaggcatgctcagtggtggcattggagcgaacagatgtggagatagactcagagcggagcttattgccgccattggagagtggaactggtagttcattgcaagggccactgccaagattaccttctcccatgatgcgagccattccctgttcacctgatacagcacctccagggtttgaaaatttaaagttcacacagctaccgcctccgtctctacctctggtgcagactgcacatgtactgcaaaattcagctgataatgaggccatgtctgtgatatcagaggaagctcctcagccatcgcctgcagtagatgcaatggatttagacatcaatgccaaacctgtcctggcactaccatcggagagtaaaccagggaagtcattgccaccggaacctacccttctgctatctcatgtagcacagcatacaacctgttcactagggatggtgcttttaggttctgagaatatcaagtcctcgcagatgctgctaccagctctggttcttcctcttgatcagactccagacatcttggctgacgcagggaccaagaagacagtcacaattgaaggagtgtgtcatccgccgcctgtagcaggagcgacggaagaagccaatggctctgttcttccaccagcaacggaaaatggttgtgagggccaatcaccacagctagagccacaggcttcttcccctgcagtggatgctgcagctacatcactggagatagctcctagaagttttgagaattcggagtcctcccagttgatctctccttgtttagctgagacaatagacccctctacacatgcatcagctacaatgcctgtgcttgtgaagtcagagaaaacgagtctgccactatcaccattacaagctacgggcacagacatggaaagcacaatcctgcagcagtcgccatcgaagagtgaagagaggtcattggcagagccagagcaacacctgtcttctccatctgtgaagggcactacttgttcaccagaggttgcacccccaggttatgaaaattttgactccttggatcagccgccgccaccaccacctctttgctcgaagtttgacttacctttctttgtttttacttag

SEQ ID NO: 20729 - protein, 671 aa, Sorghum bicolor
  misc_feature: Ceres ANNOT ID no. 8667366
  misc_feature: Up-regulated in root tissues in response to methyl jasmonate treatment
  misc_feature: Up-regulated in shoot tissues in response to methyl jasmonate treatment
  misc_feature (62)..(606): SWISSPROT Homolog: EC 3.2.1.18 Exo-alpha-sialidase
MASQEGARPSPSPESMDAHLHTASAPLTPPMEIGPGGLLPQQQPQPPSPEMAPPLCDYSEPAQPSPLCHPDECTGASPDAPVDEVVAGTSGKAARPSPCENSEFAQLPQPHLPAESTYVCSNAAGKVSAVASEDGTQPAMESIDSEGPLEIGVQRSLQEPEETTTPSRMEAEPCSPEMAPPGFEDCKSQWLPLSDPNPLVESTHTVVQVTATNAMDTTPDTATGSLSPGLLPLLKRGAEGQHPRSCSPTTEAEPGSPDMPPPGFENCKSSWLPLPTLQPVAETTYVSHDVAPTKTMAVGFMEKACSVVALERTDVEIDSERSLLPPLESGTGSSLQGPLPRLPSPMMRAIPCSPDTAPPGFENLKFTQLPPPSLPLVQTAHVLQNSADNEAMSVISEEAPQPSPAVDAMDLDINAKPVLALPSESKPGKSLPPEPTLLLSHVAQHTTCSLGMVLLGSENIKSSQMLLPALVLPLDQTPDILADAGTKKTVTIEGVCHPPPVAGATEEANGSVLPPATENGCEGQSPQLEPQASSPAVDAAATSLEIAPRSFENSESSQLISPCLAETIDPSTHASATMPVLVKSEKTSLPLSPLQATGTDMESTILQQSPSKSEERSLAEPEQHLSSPSVKGTTCSPEVAPPGYENFDSLDQPPPPPPLCSKFDLPFFVFT

SEQ ID NO: 20730 - DNA, 2166 bp, Sorghum bicolor
  misc_feature: Ceres ANNOT ID no. 8667387
  misc_feature: Up-regulated in shoot tissues in response to methyl jasmonate treatment
  misc_feature: Encodes the peptide sequence at SEQ ID NO 20731
atggcgctcaacatgaagaccctgacgcaggcgctggcgaaggcgtcggcggtgatcgagaagacggtgtccacgacggtgcaggaggtgacgggcccgcgcccgctgcaggactacgagctgctggaccaggccgggtccggcgggccggggctcgcgtggcggatctacacggcgcggccgcgggacggcgccccctcggcgccctaccccgtcgtctccgtctgggtgctcgacaagcgcgccctcgccgaggcgcgggcgcgggcggggctgtcgaaggcggccgaggacgccttcctcgacctcgtccgcgccgacgcggcgcggcttgtgcgcttgcgccacccgggcgtgctccacgtcgtgcaggcgctcgacgagaccaaggccgccatggccatggccactgagcctgtcttcgcctccgtagccaacgcgctagggtgccttgacaacgtcggcaaggttcccaaggagctcaagggcatggaaatggggctacttgagattaaacatggactgctacaagttgcagagacgttggattttcttcataacaatgctcatcttgcccatcgagctatatcgcctgagacagtctttataacttctaatggatcttggaagcttggtgggtttggttttgctctttcggttgatcaagccacaggtggtttgacttcgtcacagctattccattattcggactatgatgtcgaggatacagctttgcctcttcaaccatcattgaactatactgcaccagaattggtccgaagtggagattctaaagttggctctgcttgcgacatgtttagctttggatgtctagcttaccatctggttgctcgtagaccacttctggactgccataacaatgttaaaatgtacatgaatgccttgacatatttaaccagtgaagccttttctaatattccttctgatttggtatcggatttgcaaaggatgctatcgatggatgcagtatcgcgtcccagtgctatggcctttacaggttcttctttcttccgggatgatacgaggttgcgcgctcttcgtttccttgaccatttgcttgagagagataatatgcagaagacagagtttttgaaggcattatcagatatgtggaaggatttcgattcccgagttcttcgatataaagttcttcctcctctttgtgctgagttacgcaacatggttatgcagccaatgattttgcctatggttctaacgatagcagaatctcaggataaaggggattttgaactcgcaacactgcctgcgcttgttccagtgtttacttcagcatcaggtgaaactctacttttgcttgtgaagcatgcagatctcatcattaacaaggccacacaggaacatttgatatcacatgttcttccaatgctggtccgagcttatgatgacaatgatccccggttacaggaagaagttctgcgtcgaacagtaccactgtctcgtcaacttgacaccaagctagtccaacaggctgtgcttcctcgtgtacatggattagctctaaagacaacagttgctgcggtgcgtgtgaatgcgttgcgctgtttaggagatcttgtgccatccctggacaaagaaggtatactgggcaccttggagactattcggcgttgcactgctgttgaccatactgcgccaactcttatgtgcacacttggtgttgctaatgcaatctataaacaatgcggtgttgagtttgctgcggaatacgtgattcctctcatcttcccattgctcacagcacatcaactgaatgtacagcaatttgccaagtatatgctatttgtcaaggacattacaagcaagattgaagagaagcgtggtgtgacagttacagataatgggaacacagaggtaaaagcatcgccttcattggcaaatgggatccattctgaacctatgtcaggacaaataccagctgcaaagagcagccctgcatgggatgaagactggggtcctaagaaaactagtgttccatctctctcagctgattctagtgcacaaacaaagcaaccctcagtagacccttttgacttcagtactcaaacaaagcaacccacagcactcccctttgatttgagcacccgactcaggtcctcaaacttctggctcatgtgttcctgttga

SEQ ID NO: 20731 - protein, 721 aa, Sorghum bicolor
  misc_feature: Ceres ANNOT ID no. 8667387
  misc_feature: Up-regulated in shoot tissues in response to methyl jasmonate treatment
  misc_feature (177)..(346): SWISSPROT Homolog: EC 2.7.11.1 Non-specific serine/threonine protein kinase
  misc_feature (39)..(344): Pfam ID: Pkinase Pfam Description: Protein kinase domain
MALNMKTLTQALAKASAVIEKTVSTTVQEVTGPRPLQDYELLDQAGSGGPGLAWRIYTARPRDGAPSAPYPVVSVWVLDKRALAEARARAGLSKAAEDAFLDLVRADAARLVRLRHPGVLHVVQALDETKAAMAMATEPVFASVANALGCLDNVGKVPKELKGMEMGLLEIKHGLLQVAETLDFLHNNAHLAHRAISPETVFITSNGSWKLGGFGFALSVDQATGGLTSSQLFHYSDYDVEDTALPLQPSLNYTAPELVRSGDSKVGSACDMFSFGCLAYHLVARRPLLDCHNNVKMYMNALTYLTSEAFSNIPSDLVSDLQRMLSMDAVSRPSAMAFTGSSFFRDDTRLRALRFLDHLLERDNMQKTEFLKALSDMWKDFDSRVLRYKVLPPLCAELRNMVMQPMILPMVLTIAESQDKGDFELATLPALVPVFTSASGETLLLLVKHADLIINKATQEHLISHVLPMLVRAYDDNDPRLQEEVLRRTVPLSRQLDTKLVQQAVLPRVHGLALKTTVAAVRVNALRCLGDLVPSLDKEGILGTLETIRRCTAVDHTAPTLMCTLGVANAIYKQCGVEFAAEYVIPLIFPLLTAHQLNVQQFAKYMLFVKDITSKIEEKRGVTVTDNGNTEVKASPSLANGIHSEPMSGQIPAAKSSPAWDEDWGPKKTSVPSLSADSSAQTKQPSVDPFDFSTQTKQPTALPFDLSTRLRSSNFWLMCSC

SEQ ID NO: 20732 - DNA, 1686 bp, Sorghum bicolor
  misc_feature: Ceres ANNOT ID no. 8667446
  misc_feature: Down-regulated in shoot tissues in response to salicylic acid treatment
  misc_feature: Encodes the peptide sequence at SEQ ID NO 20733
atgtcgaccagcgccaacccgaagccgaagcggcggcggaggggcccgccgaagcagtgccctgagtaccccatggttgccaccgtgggggcaatggttgcccacgaggtgggcgccgaagggccacggagggacgcgaggcaaggacctgcgttccctagggttgttaccaccacggccaggggaggaagaggtgccggtgagcagggcgctggcggagtggagggttcggcgtcaaacgctgataagagcgctcacgaggcaggtggcgtcgatggcacgtacctcaccgagacgcggtttgatcaatgtgctatttctccactgtcgctgaaagccatcaaagatgctggatatgaaaggatgacccaggtgcaggaggctactctgccaataattcttcaaggaaaggatgttcttgcaaaagcaaagacaggaacaggaaaaacagttgcctttttgctcccagccattgaagttctctctgcgttacctcgttcaacttctataaatttgctggtgatgtgccctaccagggagcttgcaaaccaagtggctgctgaggccaggaagcttctcaagtatcatcgctcactgggtgtgcaggttgtaataggtggcacacggttacctcaagagcaacgaagcatgcaagctaacccatgtcagatccttgttgctacccctggaaggcttaaggatcatcttgagaacacgcctggattctccacccgaattaaaggtgtgaaggttcttgttcttgatgaggctgaccgcctgttggatatgggattcagaagagacattgagaaaataatttctttcatccctaaagagaggcagacactgctgttttctgctactgtttcagaagaggtccgccaaatttctcaccttgcaatgaagagggactataatttcattaacactgttcaagagggcgatgaggagacacatgcccaggtaaaccagacgtacatgattgcacctctagatctgcacttccccatattgtatgatgtattgaagaagcatgttgcggaagatgcagaatacaaagtgatagtattctgtactactgcaatggttacaaaacttgtcgctgaggtactctcccagctaaaactgaatataagagagattcattccagaaagtcgcaatctgcaagaactaaggtctcagatgaattcaggaaatcgaagggtcttatattagtcagctccgacgtatctgcccgcggtgtagattatcctgatgtcacacttgtcatgcaggttggtctgccagctgatagagaacagtatatacatagactcggaaggactggacggaaaggcaaggaggggcaaggcatcttactattggctccctgggaaatgcattttcttagtatagttaacgatttgtcaatatcagaggctgcaacaccttcgattgattcaagcattcaggcagcagtcaaagacgcagtcagaagagtggagatgaagagcaaggaatcagcttaccaggcatggttggggtactacaactcaaacaaggccatcggccgagacaaggccagacttgtgaggctggctgaagagttcagccagagcatggggcttgcagtcccgccagccattcccaaactcattctacggaagatgggccttagcaatgttcctgggctccggtcttcataa

SEQ ID NO: 20733 - protein, 561 aa, Sorghum bicolor
  misc_feature: Ceres ANNOT ID no. 8667446
  misc_feature: Down-regulated in shoot tissues in response to salicylic acid treatment
  misc_feature (123)..(296): Pfam ID: DEAD Pfam Description: DEAD/DEAH box helicase
  misc_feature (370)..(446): Pfam ID: Helicase_C Pfam Description: Helicase conserved C-terminal domain
MSTSANPKPKRRRRGPPKQCPEYPMVATVGAMVAHEVGAEGPRRDARQGPAFPRVVTTTARGGRGAGEQGAGGVEGSASNADKSAHEAGGVDGTYLTETRFDQCAISPLSLKAIKDAGYERMTQVQEATLPIILQGKDVLAKAKTGTGKTVAFLLPAIEVLSALPRSTSINLLVMCPTRELANQVAAEARKLLKYHRSLGVQVVIGGTRLPQEQRSMQANPCQILVATPGRLKDHLENTPGFSTRIKGVKVLVLDEADRLLDMGFRRDIEKIISFIPKERQTLLFSATVSEEVRQISHLAMKRDYNFINTVQEGDEETHAQVNQTYMIAPLDLHFPILYDVLKKHVAEDAEYKVIVFCTTAMVTKLVAEVLSQLKLNIREIHSRKSQSARTKVSDEFRKSKGLILVSSDVSARGVDYPDVTLVMQVGLPADREQYIHRLGRTGRKGKEGQGILLLAPWEMHFLSIVNDLSISEAATPSIDSSIQAAVKDAVRRVEMKSKESAYQAWLGYYNSNKAIGRDKARLVRLAEEFSQSMGLAVPPAIPKLILRKMGLSNVPGLRSS

SEQ ID NO: 20734 - DNA, 1227 bp, Sorghum bicolor
  misc_feature: Ceres ANNOT ID no. 8667457
  misc_feature: Up-regulated in shoot tissues in response to salicylic acid treatment
  misc_feature: Up-regulated in root tissues in response to salicylic acid treatment
  misc_feature: Encodes the peptide sequence at SEQ ID NO 20735
atggaaagggaggctgcaccacccgcaccagcaccagcgccggacaaaccggccgcgcatgtcgtcctgctcgcgagccccggtgcaggccacgttctgcccatggccgagctcgcgcggcgcgtcgtcacgcaccacggcgacggtgccgagttcacggccacgctggtcacctacaccaacttttcggcggcggagcactccttcaacgcgctcccgccgtccgtttccacggccgtgctccccgaggtgccgctcgacgacctccccgccgacgctcgcgtcgagacccgcatcctgaccgtgatcaagcgcgcgctcccgcacatccgcgacctcctccgctcgctgctcgccgccgccccggccggcgtggcggcgttcgttccggacgtcttcagctcgtgggcgctcgaggtctctgcggagctcggcatcccgggctacatattctgcacgtcaaacctaacgtcgatgcactccatcatccacatcccggagctcgacaagaccaccgcctgcgactgcgagttccgcgacctgccggagcccgtccgactgccaggctgcgtgccgctgcgcggcgccgacctcgccgacccttttcaggaccgcaccgaccctgtgtaccctctcatggtcgaactggcgaacaagtgtcttctcgccgacgggttcatcgtcaacacctttgacgccatggagcacgaggccatagcggcgttcaacgtgctgtccgacagaggcgggtaccctccggcctacgccgtcggtcccttcgtccgtacgtgctcagagcggcgacgacgacagcccgctgggatacctgccggaagggtggagatcctgaaccacggggccatcggcgggttcctgtcgcactgcgggtggaactcgacgctggaggccgtggccgcgggcgtgccgttgctggcgtggccgcggtacgccgagcagaggaccaacgcggtgatgctgtctgagggggtgggcctcgccctcgcgctcgcgctgcggccgaggggcagaagtagaaccgatgggattgtgtcgagggaggaggtagcggcggcggtgacggagctgatcgtggaggcgaagggcgccgtggcgagggagaaggcgcgcgagctccgggaggcggcggcagaggcctgggcgccggaaggaccatcgcgcaatgcgttccaggccgtcgtcggtaggtggaagaaagccgctagctag

SEQ ID NO: 20735 - protein, 408 aa, Sorghum bicolor
  misc_feature: Ceres ANNOT ID no. 8667457
  misc_feature: Up-regulated in shoot tissues in response to salicylic acid treatment
  misc_feature: Up-regulated in root tissues in response to salicylic acid treatment
  misc_feature (20)..(262): SWISSPROT Homolog: EC 2.4.1.115 Anthocyanidin 3-O-glucosyltransferase
  misc_feature (277)..(368): SWISSPROT Homolog: EC 2.4.1.238 Anthocyanin 3'-O-beta-glucosyltransferase
MEREAAPPAPAPAPDKPAAHVVLLASPGAGHVLPMAELARRVVTHHGDGAEFTATLVTYTNFSAAEHSFNALPPSVSTAVLPEVPLDDLPADARVETRILTVIKRALPHIRDLLRSLLAAAPAGVAAFVPDVFSSWALEVSAELGIPGYIFCTSNLTSMHSIIHIPELDKTTACDCEFRDLPEPVRLPGCVPLRGADLADPFQDRTDPVYPLMVELANKCLLADGFIVNTFDAMEHEAIAAFNVLSDRGGYPPAYAVGPFVRTCSERRRRQPAGIPAGRVEILNHGAIGGFLSHCGWNSTLEAVAAGVPLLAWPRYAEQRTNAVMLSEGVGLALALALRPRGRSRTDGIVSREEVAAAVTELIVEAKGAVAREKARELREAAAEAWAPEGPSRNAFQAVVGRWKKAAS

SEQ ID NO: 20736 - DNA, 2100 bp, Sorghum bicolor
  misc_feature: Ceres ANNOT ID no. 8667522
  misc_feature: Down-regulated in root tissues in response to aminocyclopropane carboxylic treatment
  misc_feature: Down-regulated in shoot tissues in response to salicylic acid treatment
  misc_feature: Encodes the peptide sequence at SEQ ID NO 20737
atgaacggaggcggcggcgggcggcggcggtactcctcggagcagctcctcttcgacgtccccaccaatgccggtgccgccgcccggtgggcgcagcagcgcggcggggtgcggcgcggggacggggagatcttcgtgtcggtggagcccgcgacgccggcgcggctgcgcggaggggacgctgcagctggggattcgccgggacagaggcagcagctcagtcccgggttgctcgatctccatgcgttcgacaccgagctaatccccgattttcaagtaccagggatgtatgatggtgcccaaaagtttggctatggaggaggtttagatgaatctgatatgagattcacagcaaacaagctgatgagcaagtctactgtttttcctgatggtaactatctgaaggccttcactgagaaagaaaaggcagcacctgtcgcaaaaatcaaagtggtggtgcgcaaaagaccacttaacaaaaaggaagtgtcaaagaaggaagaagatatcatagacattgaacaaaactctctgactgtccatgagactaaacttaaggttgaccttactgaatatgtcgaaaagcatgagtttgtatttgatgctgtcttagatgaagatgtttcaaatgatgaggtttatcgtgaaacagtggagcctgtggttcctgcaatttttaatcgaacaaaagcaacttgttttgcttatggacaaactggtagtggaaagacgtataccatgcgtccccttccactcaaggcttcccaagatatcttgaggttaatgcaccatacgtatcgaaaccaaggatttcagttgtatgttagcttctttgagatatatggtggtaaattgtttgaccttctcaatgataggagcaaactttgcatgagagaggatggcaagcaaaaggtttgtattgttggtttgcaagagtatagagtctctgatgttgagactatcaaggagttgattgaaaaaggcagtgctaccagaagtactggcacaaccggtgcaaatgaagagtcatcgaggtctcatgccattcttcagcttgctattaaatgccgtgtggatggcaatgactccaaaccacccagaccagtcggcaagttgtcatttattgaccttgctggcagtgagcgtggtgctgatacaactgacaatgataaacaaacaagaatcgagggtgctgagatcaataaaagtttgcttgccttaaaggagtgcattagagcactcgacaatgatcagactcacattcctttccgaggtagcaaattaactgaagtcttgcgggactcgttcattggagactcacgcactgtcatgatatcatgcatttctcctagttctggctcttgcgagcatactctgaacacattgagatatgctgatagagtgaagagtttgtcaaagggaagcaatgccaagaaagatgtatctttggcagtgcctatgagagagtcgagtccttccccactgacttcagttgtaccttcattctctgcatctgaggtgatgaatgatatcaccgagagaagtaattttggttggcccaagcagcagtatgttaaagaacagcctgctccaacattcgctgaacgaatgcccaaggtgaaggattcggtggagttcacatcatcatatggtgcttattcgaagcaacaaagaagcaagggctttgtggcaccaaacatggctgaagtaccagatataatgtaccagcagggaaggcaaccaacaaggaaggctagagataccacttttgggaaggatatgagaaattccgttacttacccaactagaagggttgagccagatgaagatgagcatctaaataatcttctccaggaagaggaagacttggttagtgctcataggaagcaggttgaagagactctagacatcctcaaagaggaaatgaacatattaggcgaagcggatcagcctggcttccaacttgacgactacctcggaagactaagcagtatactctcccagaaggcggctggaattgtggacctacaggctcggttggagcagttccagaggcttttgaatgagaacaacgtgctgctatatgatcagagcccttga

SEQ ID NO: 20737 - protein, 699 aa, Sorghum bicolor
  misc_feature: Ceres ANNOT ID no. 8667522
  misc_feature: Down-regulated in root tissues in response to aminocyclopropane carboxylic treatment
  misc_feature: Down-regulated in shoot tissues in response to salicylic acid treatment
  misc_feature (154)..(472): Pfam ID: Kinesin Pfam Description: Kinesin motor domain
MNGGGGGRRRYSSEQLLFDVPTNAGAAARWAQQRGGVRRGDGEIFVSVEPATPARLRGGDAAAGDSPGQRQQLSPGLLDLHAFDTELIPDFQVPGMYDGAQKFGYGGGLDESDMRFTANKLMSKSTVFPDGNYLKAFTEKEKAAPVAKIKVVVRKRPLNKKEVSKKEEDIIDIEQNSLTVHETKLKVDLTEYVEKHEFVFDAVLDEDVSNDEVYRETVEPVVPAIFNRTKATCFAYGQTGSGKTYTMRPLPLKASQDILRLMHHTYRNQGFQLYVSFFEIYGGKLFDLLNDRSKLCMREDGKQKVCIVGLQEYRVSDVETIKELIEKGSATRSTGTTGANEESSRSHAILQLAIKCRVDGNDSKPPRPVGKLSFIDLAGSERGADTTDNDKQTRIEGAEINKSLLALKECIRALDNDQTHIPFRGSKLTEVLRDSFIGDSRTVMISCISPSSGSCEHTLNTLRYADRVKSLSKGSNAKKDVSLAVPMRESSPSPLTSVVPSFSASEVMNDITERSNFGWPKQQYVKEQPAPTFAERMPKVKDSVEFTSSYGAYSKQQRSKGFVAPNMAEVPDIMYQQGRQPTRKARDTTFGKDMRNSVTYPTRRVEPDEDEHLNNLLQEEEDLVSAHRKQVEETLDILKEEMNILGEADQPGFQLDDYLGRLSSILSQKAAGIVDLQARLEQFQRLLNENNVLLYDQSP

SEQ ID NO: 20738 - DNA, 1134 bp, Sorghum bicolor
  misc_feature: Ceres ANNOT ID no. 8667614
  misc_feature: Up-regulated in root tissues in response to salicylic acid treatment
  misc_feature: Up-regulated in shoot tissues in response to salicylic acid treatment
  misc_feature: Encodes the peptide sequence at SEQ ID NO 20739
atggctctcgccgtccgcacgccccgcttccagcctcgacggacctccatttctgcgcccgcaccacccgcctcgacatccctcgccgccgcgaacgcgagggcccgtgcctgcgcacgcgccgccgtccgagcctcgcccttcaccgagggcacctcctcctcgcgctaccgccgagacgcctggtcctacgccgccgccgatggctcctccagctccgcatccccgtcctcttccgatgctgccgctgccgccgccgctgcgctgccggagctgcggaggctcctggacgcgctgagggcgtccagggggaaaggcgccgagggggcagacggcggcggcgggcccgggagggtggcgctggtggggacagggcccggggaccccgagctgctcacgctcaaggcggtccgggccatcgaagcggcggacctggtgctctacgacaggctggtgtctaacgacgtgttggacttggtcggggagggcgccaggctgctctacgtcggcaagacggcgggataccacagccgcacccaggaggagattcacgagctgctgctgagctttgccgaggctggtgccaatgttgtccgcttgaaaggtggcgatcctctggtttttggaaggggcggagaagagatggatttcttacagcaacagggaatcaaagtcgaagttatcccaggaattacttctgcttcaggaattgcagcagaactaggcattccgctaacccatagaggtgttgctaccagtgtcagatttttaaccggacactccagaaatggtgggacagatccactacatgtagctggaagtgcagctgatccagacactactttggttgtgtacatgggtttgtcaacacttccatcactcgctccaaagttaatgaagcacggcctgccgccagatacccctgctgttgcagtagagcgcgggactacacctcaacaacgaacggtgttctccttgttaaaggatcttgtggatgaagtcaagtcagctgatctagtttctccaactctaataattatcgggaaagtggtatccttgtcgcccttctgggtggagtcatctgaacattatgcactgaaaattgagagctcttatacaaatgaaaccagatga

SEQ ID NO: 20739 - protein, 377 aa, Sorghum bicolor
  misc_feature: Ceres ANNOT ID no. 8667614
  misc_feature: Up-regulated in root tissues in response to salicylic acid treatment
  misc_feature: Up-regulated in shoot tissues in response to salicylic acid treatment
  misc_feature (126)..(354): SWISSPROT Homolog: EC 2.1.1.107 Uroporphyrinogen-III C-methyltransferase
  misc_feature (118)..(331): Pfam ID: TP_methylase Pfam Description: Tetrapyrrole (Corrin/Porphyrin) Methylases
MALAVRTPRFQPRRTSISAPAPPASTSLAAANARARACARAAVRASPFTEGTSSSRYRRDAWSYAAADGSSSSASPSSSDAAAAAAAALPELRRLLDALRASRGKGAEGADGGGGPGRVALVGTGPGDPELLTLKAVRAIEAADLVLYDRLVSNDVLDLVGEGARLLYVGKTAGYHSRTQEEIHELLLSFAEAGANVVRLKGGDPLVFGRGGEEMDFLQQQGIKVEVIPGITSASGIAAELGIPLTHRGVATSVRFLTGHSRNGGTDPLHVAGSAADPDTTLVVYMGLSTLPSLAPKLMKHGLPPDTPAVAVERGTTPQQRTVFSLLKDLVDEVKSADLVSPTLIIIGKVVSLSPFWVESSEHYALKIESSYTNETR

SEQ ID NO: 20740 - DNA, 1677 bp, Sorghum bicolor
  misc_feature: Ceres ANNOT ID no. 8667626
  misc_feature: Up-regulated in shoot tissues in response to salicylic acid treatment
  misc_feature: Encodes the peptide sequence at SEQ ID NO 20741
atggaggaagagggggcgcaatcttggtcacatctaatatctctgacggcagttcttgtaaggggtagagattgttcttgttcggagaaaacctcgtctgcacgtgttgctgatgatccgtcccgtgctgataatatacaagctcgactgaatcaactgtttgagcctgacagcaccatgggttccggcgatttgagctcggagatggagaggaaggttcttggcctgacgctgtgggtctggattgccatcggcgtggtcgcacttctcgtggcgatcctgctgatgatctgcatttgggtggcgtcccgccggaggaccaagagaaccatggacaccctgaggcagacgcagatccccatctactccaaggagatccccgtcgaccgggtcggcgggcgcagccttgcacagacaatgcacgagcgcgagaagccgagcttgccgccgccggacaagtacaacgcgagcagggagccggcaggggccacgctgggccacctggcactcagcaagtcctcggaccatgataacatgagccaggggagctcggtttgcaatgtcgaccgtgctggcagcgtgcactccggtgaggatgggagctctggacctcggaggaaaccaaattcgcctgcggctttcgtgtcagcgtcgcccttggttggccttccagagttctctcatcttggttggggtcactggtttactcagcgggaccttgagcttgctaccgaccgtttctctaaggagaatgtgcttggagagggtggttatggagttgtgtaccgtggacgtctagtgaatggaactgaagcagaaaaagaattcagagtggaagttgaggctattggccatgtccgacataagaatttggttcgactgttgggatattgtgttgagggggtaaacaggatgctagtatatgagttcgtgaacaatggtaatttagagcagtggcttcatggagctatgcatcagcgtggtgttttcagctgggaaaatcgcatgaaggttgtaacaggcactgcaaaagcgcttgcttacctccatgaagctatagagccaaaagttgtacatcgtgatataaaatcaagcaacatattgattgatgatgaatttaatggcaaggtatctgactttggattggctaaactcttgggatctgacaaaagccacattactactagagtgatgggaacatttggatatgttgcacctgaatatgctaatactggaatgttaaatgaaaagagcgacgtttatagttttggtgttctcttgttggaaactgtgacaggaaggaatcctgttgactacagccgatcttccaatgaggtcaatcttgttgaatggctcaaaacaatggtggctaaccggagggcagaggaagtggctgatccaagcttagaggttagacccagtattagggctctcaagcgggctcttttggtggcactgaggtgtgttgatcctgactctgaaaagagacctaagatgggccaggttgttaggatgcttgagtcagaagaagttccataccgggaggatcggagaaatcgtagaagtcgcactggaagcatggatattgagtccattgcagagggttcaaactccgcggagtttggaaagaaggtagaaaggactggaagctcaacatctgaccgatctcaaccatga

SEQ ID NO: 20741 - protein, 558 aa, Sorghum bicolor
  misc_feature: Ceres ANNOT ID no. 8667626
  misc_feature: Up-regulated in shoot tissues in response to salicylic acid treatment
  misc_feature (271)..(554): SWISSPROT Homolog: EC 2.7.11.1 Non-specific serine/threonine protein kinase
  misc_feature (247)..(506): Pfam ID: Pkinase Pfam Description: Protein kinase domain
MEEEGAQSWSHLISLTAVLVRGRDCSCSEKTSSARVADDPSRADNIQARLNQLFEPDSTMGSGDLSSEMERKVLGLTLWVWIAIGVVALLVAILLMICIWVASRRRTKRTMDTLRQTQIPIYSKEIPVDRVGGRSLAQTMHEREKPSLPPPDKYNASREPAGATLGHLALSKSSDHDNMSQGSSVCNVDRAGSVHSGEDGSSGPRRKPNSPAAFVSASPLVGLPEFSHLGWGHWFTQRDLELATDRFSKENVLGEGGYGVVYRGRLVNGTEAEKEFRVEVEAIGHVRHKNLVRLLGYCVEGVNRMLVYEFVNNGNLEQWLHGAMHQRGVFSWENRMKVVTGTAKALAYLHEAIEPKVVHRDIKSSNILIDDEFNGKVSDFGLAKLLGSDKSHITTRVMGTFGYVAPEYANTGMLNEKSDVYSFGVLLLETVTGRNPVDYSRSSNEVNLVEWLKTMVANRRAEEVADPSLEVRPSIRALKRALLVALRCVDPDSEKRPKMGQVVRMLESEEVPYREDRRNRRSRTGSMDIESIAEGSNSAEFGKKVERTGSSTSDRSQP

SEQ ID NO: 20742 - DNA, 1347 bp, Sorghum bicolor
  misc_feature: Ceres ANNOT ID no. 8667683
  misc_feature: Down-regulated in shoot tissues in response to methyl jasmonate treatment
  misc_feature: Down-regulated in root tissues in response to methyl jasmonate treatment
  misc_feature: Down-regulated in shoot tissues in response to aminocyclopropane carboxylic treatment
  misc_feature: Down-regulated in shoot tissues in response to salicylic acid treatment
  misc_feature: Encodes the peptide sequence at SEQ ID NO 20743
atgagcagttgcctttgcctccctaaaaagaaggagggccagggggcggcagcgaagccgtccatagattcaaccacctcgacagtcgttcagaacccgaagcctacccaacctccacctcctccctccaagggcatggacgccgtcgagcgcttgaaggtcgggttccagaagttcaagaccgaggtctatgacaaaaagccagagctgttcgagcctctcaaggctggccaggcccccaagtacatggtgttcgcctgctccgactcccgtgtgtgcccgtcggtgaccctgggcctgcagcccggcgaggccttcaccgtccgcaacatcgcctccatggtgccaccctacgacaagaccaagtacagcggcaccgggtccgccatcgagtacgccgtgtgcgccctcaaggtgcaggtgctcgtcgtcattggccacagctgctgcggtggcatcagggcgctcctctccctcaaggacggtgcacctcacaacttccacttcgttgaggactgggtcaggatcggctcccctgccaaggcgaaggtgcacaaagagcatgcctcagtgccgttcgatgaccagtgctccatcctggagaaggaggccgtgaacgtgtccctcgccaacctcaagacttaccccttcgtcaaggaacggctggccaaagggaccctcaagctggtcggcgcccactacgacttcgtgtccgggaagttcctcacatgggagcctgtgatggacgccgttgaccgcttgaagagcgggttcgagcagttcaagatcgaggtctatgacaagaagccagagctttttgagcctctcaaatctggccaggcccccaggtacatggtgttcgcctgcgctgactcccgtgtgtgcccgtcggtgaccctgggcctgatgcccggcgaggccttcaccgtccgcaacatcgccgccctggtcccaggctacgacaagaccaagtacaccggcatcgggtccgccatcgagtacgccgtgtgcgccctcaaggtgcaggtgctcgtcgtcattggccatagctgctgcggtggcatcagggcgctcctctccctccaggacggtgcacctgacaacttccactttgttgaggactgggtcaagattggcttccctgccaagatgaaggtgaagaaagagaacgcttcggtgccgttcgatgaccaatgctacattctagagaaggaggccgtgaatgtgtccttggagaacctcaagacctacccattcgtcaaggaagggctggccaacggtaccttaaagctggtcggcggccactatgacttcgtgaaaggagagttcctcacatggaaagtctag

SEQ ID NO: 20743 - protein, 448 aa, Sorghum bicolor
  misc_feature: Ceres ANNOT ID no. 8667683
  misc_feature: Down-regulated in shoot tissues in response to methyl jasmonate treatment
  misc_feature: Down-regulated in root tissues in response to methyl jasmonate treatment
  misc_feature: Down-regulated in shoot tissues in response to aminocyclopropane carboxylic treatment
  misc_feature: Down-regulated in shoot tissues in response to salicylic acid treatment
  misc_feature (46)..(245): SWISSPROT Homolog: EC 4.2.1.1 Carbonate dehydratase
  misc_feature (75)..(245): Pfam ID: Pro_CA Pfam Description: Carbonic anhydrase
  misc_feature (277)..(447): Pfam ID: Pro_CA Pfam Description: Carbonic anhydrase
MSSCLCLPKKKEGQGAAAKPSIDSTTSTVVQNPKPTQPPPPPSKGMDAVERLKVGFQKFKTEVYDKKPELFEPLKAGQAPKYMVFACSDSRVCPSVTLGLQPGEAFTVRNIASMVPPYDKTKYSGTGSAIEYAVCALKVQVLVVIGHSCCGGIRALLSLKDGAPHNFHFVEDWVRIGSPAKAKVHKEHASVPFDDQCSILEKEAVNVSLANLKTYPFVKERLAKGTLKLVGAHYDFVSGKFLTWEPVMDAVDRLKSGFEQFKIEVYDKKPELFEPLKSGQAPRYMVFACADSRVCPSVTLGLMPGEAFTVRNIAALVPGYDKTKYTGIGSAIEYAVCALKVQVLVVIGHSCCGGIRALLSLQDGAPDNFHFVEDWVKIGFPAKMKVKKENASVPFDDQCYILEKEAVNVSLENLKTYPFVKEGLANGTLKLVGGHYDFVKGEFLTWKV

SEQ ID NO: 20744 - DNA, 666 bp, Sorghum bicolor
  misc_feature: Ceres ANNOT ID no. 8667780
  misc_feature: Up-regulated in shoot tissues in response to salicylic acid treatment
  misc_feature: Up-regulated in root tissues in response to salicylic acid treatment
  misc_feature: Encodes the peptide sequence at SEQ ID NO 20745
atggcgctgccgaatcagcaggtcgtggattaccccagcttcaagctcgtcatcgttggcgacggtggaactggtaaaaccacatttgtgaaaaggcatcttactggcgagttcgagaagaaatatgagcccactattggtgtggaagttcaccctctggattttagcactaactgtggcaaaatccgcttctattgctgggacactgctgggcaagaaaagttcggtggcctcagggatggctactacattcatggtcagtgtgccatcattatgtttgatgttacttcgaggctgacatacaagaatgttccaacatggcacagggacctgtgcagggtgtgcgagaacattcccattgttctctgtggtaacaaggttgatgtaaagaacaggcaagtcaaagccaagcaagttacattccacaggaagaagaacttgcagtactatgagatttctgcaaagagcaattacaactttgagaagcccttcctttacctcgcaaggaaactggcaggggatcagaaccttcactttgtcgaagctgttgctctgaagccaccggaagtgcagattgatatggccatgcagcagcagcacgaagctgagcttgcagctgctgctgcgcaacccctccctgatgacgatgatgacctgatcgaatag

SEQ ID NO: 20745 - protein, 221 aa, Sorghum bicolor
  misc_feature: Ceres ANNOT ID no. 8667780
  misc_feature: Up-regulated in shoot tissues in response to salicylic acid treatment
  misc_feature: Up-regulated in root tissues in response to salicylic acid treatment
  misc_feature (6)..(179): SWISSPROT Homolog: EC 2.7.11.1 Non-specific serine/threonine protein kinase
  misc_feature (15)..(173): Pfam ID: Ras Pfam Description: Ras family
  misc_feature (15)..(128): Pfam ID: Miro Pfam Description: Miro-like protein
MALPNQQVVDYPSFKLVIVGDGGTGKTTFVKRHLTGEFEKKYEPTIGVEVHPLDFSTNCGKIRFYCWDTAGQEKFGGLRDGYYIHGQCAIIMFDVTSRLTYKNVPTWHRDLCRVCENIPIVLCGNKVDVKNRQVKAKQVTFHRKKNLQYYEISAKSNYNFEKPFLYLARKLAGDQNLHFVEAVALKPPEVQIDMAMQQQHEAELAAAAAQPLPDDDDDLIE

SEQ ID NO: 20746 - DNA, 1959 bp, Sorghum bicolor
  misc_feature: Ceres ANNOT ID no. 8667772
  misc_feature: Down-regulated in root tissues in response to methyl jasmonate treatment
  misc_feature: Encodes the peptide sequence at SEQ ID NO 20747
atggcggcggcggggaagggctgggccgagcgggtgcgccgcggggtgaggaccgcctggttcatggtggccatggtggcctcgctgctcgtggcgtcggcgccggcgctggtggcagcgggcgacgtggcagtggcgctctggctcgaggtgcggctcggctgcttccgcggcgacggcctgcggggccacctccagcgctaccgtttccggaactcgcttgccgacatacctctggtctccgtcgttcgatccatcgtcatcacctgtgtatacctcatgtctgatacttctggcctctctcatggtccttaccttggaacaacaactttctgttccttggcttctctgctcatcttgttaattaaggcatctgtttatagtccggctcaggacattggacctgagctctcgccatcattaccagatcacaatctcaatctcaagaagctatggggaatgcctgtacttttcctgtcttccttggtgtttgctcttggccatgttattgttgcttacagaacaagctgtagggctcgacggaagcttctcattcaccgcattgaccctgaatcgattttagcatacaagaatgccttctctggatgctacaaggttccaaggtctcctacaccatacagtggaaagctttttacaaggagtgaaagtgagacaaagagaaaaacacttatccaggaggatcatgatctgccaatcagttttcttgcagacagtgatagcatgttcattgcttgccaggggatcactatacactacaaagtttctgatccagcagccagcctaccttcatcccctgactccttttcagagagagatactcatcacgatgttatttcatcaagcatttctcctagaagacagaggcatgagagtccaccatctgcttcctctaatacccgccgtcttctgaataggagctttagccatcaatatcatcatacttcgctatatgcaccactattggtcgaaccagtggcatctccaactttgttggatgatatccctctgatgtgtcttgatgatggcaatgctgatggatgtttgaatcatgtgggctttgatcttgaggctggaaggcagggtaaatttgctgtagttttggtacatggatttggagggggagtattctcgtggagacatgtttccagtttgctagctcgacaattgggctgcactgtgatggcctttgatcgcccaggatggggattaacatctcgacctcgcagaaaggactgggaagataagaagttaccgaatccatatgagctggagtctcaggttgatcttcttatttcattttgctcagagatgggattgcactctgtggttttagttggtcatgatgatggagggttgcttgccttgaaagctgcggagaagctgcgcacttatggagttgatagaaaggttgaagtgaagggagtagttcttattggtgtaagcttatcaagagaagtcattcctgcatttgctcgtatactcctgcatacacctctgaggaaaaagcacatggttcgaccacttctacgcactgaaatcactcaggtcatcaatcggcgggcatggtatgatgccacaaagttgaccacagaaattcttaacctatacaaggctccactatttgttgagggctgggatgaagcacttcatgaagtaggccggctctcgttttctactgtcctaccatcaaaaagagcagcagatttactaaaatcagtggaagaccttccggttctggtggtagcgggctccgaggatgctcttgtttctgtgaagtcggcacaagccatggcttcgaaacttgtaaattctaggataataactatatctgggtgtggacatctgccgcatgaggagtgccccaaggcgttgctctctgctctttctcctttcatctctacattggtaccctcagaagatttgttgcaaagactgtag

SEQ ID NO: 20747 - protein, 652 aa, Sorghum bicolor
  misc_feature: Ceres ANNOT ID no. 8667772
  misc_feature: Down-regulated in root tissues in response to methyl jasmonate treatment
  misc_feature (398)..(637): Pfam ID: Abhydrolase_1 Pfam Description: alpha/beta hydrolase fold
MAAAGKGWAERVRRGVRTAWFMVAMVASLLVASAPALVAAGDVAVALWLEVRLGCFRGDGLRGHLQRYRFRNSLADIPLVSVVRSIVITCVYLMSDTSGLSHGPYLGTTTFCSLASLLILLIKASVYSPAQDIGPELSPSLPDHNLNLKKLWGMPVLFLSSLVFALGHVIVAYRTSCRARRKLLIHRIDPESILAYKNAFSGCYKVPRSPTPYSGKLFTRSESETKRKTLIQEDHDLPISFLADSDSMFIACQGITIHYKVSDPAASLPSSPDSFSERDTHHDVISSSISPRRQRHESPPSASSNTRRLLNRSFSHQYHHTSLYAPLLVEPVASPTLLDDIPLMCLDDGNADGCLNHVGFDLEAGRQGKFAVVLVHGFGGGVFSWRHVSSLLARQLGCTVMAFDRPGWGLTSRPRRKDWEDKKLPNPYELESQVDLLISFCSEMGLHSVVLVGHDDGGLLALKAAEKLRTYGVDRKVEVKGVVLIGVSLSREVIPAFARILLHTPLRKKHMVRPLLRTEITQVINRRAWYDATKLTTEILNLYKAPLFVEGWDEALHEVGRLSFSTVLPSKRAADLLKSVEDLPVLVVAGSEDALVSVKSAQAMASKLVNSRIITISGCGHLPHEECPKALLSALSPFISTLVPSEDLLQRL

SEQ ID NO: 20748 - DNA, 1221 bp, Sorghum bicolor
  misc_feature: Ceres ANNOT ID no. 8667817
  misc_feature: Down-regulated in root tissues in response to salicylic acid treatment
  misc_feature: Up-regulated in shoot tissues in response to methyl jasmonate treatment
  misc_feature: Encodes the peptide sequence at SEQ ID NO 20749
atgaagaagctccactggttggtgcggttcctgttcgggccggtgccggtctacttctcggcgctggccatcctcatcgtgctcaccaacgcgcagtacttcgggctggtgggcgtcggcgtggcgccgcgcgccgcgaagctggcctccaccacgcccgtggtcagcgtcatgaagtactgcgacatcttccgcggcgagtgggtgcccgacgccgaggcgccctactacaaccacaagacgtgccacatgatccaggagcaccagaactgcctcaagtacgggcgccccgacctcggattcctcaagtggcggtggcggccctccggctgcgacctgccgcgcttcgacccgctgcagttcctgcagttcgtccgcggcaagtcgctggccttcgtcggcgactccctggccaggaaccacatgcagtcgctgctctgcctcctctcccaggtggcgtatcccaaggacctgtcggcgaacccgtcggaccagaacaaggtgtaccactaccgggcgtacaacttcaccatcagcatgttctggtcgccgttcctggtgcgcgcgcgggagcccgaccacgacggccccgcgcacacgggccactggagcctgtacctagacgaggccgacgacaagtgggtctcgcagatctcccgcttcgactacgtgctggtgtcggcggccaactggttctcccgcccgtccctcttctacgagaagcgtcgcctgatcgggtgcagcttctgcagccgccagtacggcgtccccgacctgacgctctactactcgcagcgccgcgcgtggcgcgtggcgctgcgcgccatcaacgacctggagcacctccgcgggcgtgtcatcgtgcgcatgctctcccccatgtcgcacttcgagaacgggacgtgggaccacggcggcgactgcaagcgcacgcagccgctgcgggggaaccagaccaccatggaaggccgcgacctgcacttctacaccgcgcagatggaggagttccgcgcggcggagaaggtcgcgagcgacaaggggcggcggctgatgctcatggacgccacggcggcgatgctgatgcggcccgacgggcatcccagccggtacgggcactgggccaacgagaaggtgcagctctacaacgactgcatccactggtgcctccccggacccatcgacatctggaacgacatgctcttccagatgctcctcgcctag

SEQ ID NO: 20749 - protein, 406 aa, Sorghum bicolor
  misc_feature: Ceres ANNOT ID no. 8667817
  misc_feature: Down-regulated in root tissues in response to salicylic acid treatment
  misc_feature: Up-regulated in shoot tissues in response to methyl jasmonate treatment
MKKLHWLVRFLFGPVPVYFSALAILIVLTNAQYFGLVGVGVAPRAAKLASTTPVVSVMKYCDIFRGEWVPDAEAPYYNHKTCHMIQEHQNCLKYGRPDLGFLKWRWRPSGCDLPRFDPLQFLQFVRGKSLAFVGDSLARNHMQSLLCLLSQVAYPKDLSANPSDQNKVYHYRAYNFTISMFWSPFLVRAREPDHDGPAHTGHWSLYLDEADDKWVSQISRFDYVLVSAANWFSRPSLFYEKRRLIGCSFCSRQYGVPDLTLYYSQRRAWRVALRAINDLEHLRGRVIVRMLSPMSHFENGTWDHGGDCKRTQPLRGNQTTMEGRDLHFYTAQMEEFRAAEKVASDKGRRLMLMDATAAMLMRPDGHPSRYGHWANEKVQLYNDCIHWCLPGPIDIWNDMLFQMLLA

SEQ ID NO: 20750 - DNA, 4251 bp, Sorghum bicolor
  misc_feature: Ceres ANNOT ID no. 8667823
  misc_feature: Down-regulated in shoot tissues in response to aminocyclopropane carboxylic treatment
  misc_feature: Up-regulated in shoot tissues in response to methyl jasmonate treatment
  misc_feature: Up-regulated in root tissues in response to methyl jasmonate treatment
  misc_feature: Down-regulated in shoot tissues in response to salicylic acid treatment
  misc_feature: Encodes the peptide sequence at SEQ ID NO 20751
atggccgtcgaaaacaggcctactagcccattcgtcctgctcatcttgctcttctcttcgcctcctttctcaccgttgcagttgcaggttccgactcagatctccccgacctgccaccaccacccgcgacgccagccctgcacagcatcactgctacctcccctttgctcatccccagatctccagactccagatctctgctccggtccccgcccgcctctcgcccgcgacaaccccgccgcagcacgcggcggccgcggcgagatgctccgcctgcgggcgttccggccgacgagcgacaaggtcgtgaagatccagctccaccccactcacccctggctcgtcaccgccgacgccaacgaccgcgtctccgtctgggactgggagcaccgccaggtgatctatgagctgaaggcaggtggcgttgatgagcgtcgcttggttggagcgaagcttgagaaactcgctgagggagatgattcaaagggaaagcccaccgaggctattcgagggggaagtatggagttcctctctaggtcatcttctagcgatgctcctcttgtggcctttgggtcatctgatggtgtcatcagggttctttcgatgttgacatggaagcttgtgcggaggtatacgggtggacataaaggagcaatagcctgcttaatgacgtacatgtctgcagctggtgaggtacatttagtttctggtggcagcgatggcctgctgatattatggagcgctgatcatatccatgactcacgtgagcttgtgcctaaaattagtatgaaggcccatgatggaggtgtagttgcagttgaactttcaagggtgatggggagtgctccacagctcattacaataggggctgataaaactttagccatatgggatactgttactttcaaggaaataaggcgcattaaaccagtgcctaaacttgcttgtcatagtgttgcatcgtggtgtcatccccgtgcaccaaaccttgatattctaacttgtgtcaaggactcccatatttgggttaggcttcacagtttgatgatttttgttgttgtttgcaatagttggaatagattgcatgctgtgccctgcaaagaaaaaaatctcaccattgatactgtttattgcatggtggcacaccccttgcagccacatcttgttgctactggaactaatattggtatcatattaagcgagtttgatccaagagcacttccagctattgctcctttaccaacaccaacaggcaacaaggaacattctgctgtttacatagttgaaagagaacttaagttactgaatttccaattgtcaaacacagcgaatccatcccttgggaatgctggtgttgcatctgatgcaggaagatcaaggaatgattcaatagaacagttgatagtaaagcagaccaagaagcatatcagtactcctgctccccacgattcctattcggtcctttccgttagcagttctgggaagtatgttgcaattgtatggccagatatcccttcttttgctgtatacaaagcaagtgattggtcagttgttgattcaggcacagggaagctttttgcctgggacacctgtcgagacagatatgctttagtagagagtgcattggccccaagaatgccacttgttgtgaaaggtggttcttctaaaaaggcaaaagaagcagcagcagctgcagctcaagcagcagctgcggcagctagtgctgcttctgccgccacagtgcaagtgcgtatcttattagatgatggaacagcacatgttttgcagagatcgattgatggtcgtagtgaaccggttattggactgcatggtggtgctttacttggcgtcacataccgcacatctcgtagaatcagtcctttgacagcaacagctatatcaactgttcaatcgatgcccttatcaggttttggtggaagtggatcatcttttgcatctgatgatccattttcctctaaggaagggcctccacaaaatttccaactgtacagctgggagacctatcagcctgtaagcggcctgcttgcacaacctgagtggaccgtgtgggaccaaactgttgagtattgcgcatttgcttatcagcagtatatagtaatttcttccttgcggccccaatttaggtaccttggcgatgtctcaattccctttgcaactggtgccgtttggcatagaaggcagttatttgtggctacaccaacaacaattgagtgtgtctttgttgatgctggagtagcagctattgacattgaaacaaaaaggagaaaagaagaaatgaaagcaagagaagctcagagtcgggcagttgaagagcatggagatttggctcttattactgttgaagctccccaggttactgtgagtgaaaaagtatcattgaggccaccaatgttgcaggttgttcgtttagcctcctttcagcactctccatcgataccaccatttatagtgccaaagcaatccaagttcgatggagatgattcagtgtttcagaaagaactagatgacagaagatatgctgaagttgctgttgctggaggaggggtgtctgttgcagtaactcgcttccctcctgaacagaagagacctattggacctcttgttgtggttggtgtaagagatggagttctctggcttgttgacaggtatatgtgtgcacatgccttgtcactcagccatcctggtataagatgtcgttgccttgcagcatatggggaccctgttagtgctgtgaagtgggcaacgagactggccgagagcatcacgatgacctggctcagtttatgctgggtatgggctatgccactgaagctcttcatttgcctggaatatctaagagatgccgtgcagggaatagtgaaatttgtcaaggagttttttgaccttatcgatgcagcagatgccactgggcaatctgacattgctcgtgaagttttaaagagattagcggctgcagcttctgtaaagggtgccctccatggacagatgctacgaggcctggcacttcgtcttgcaaaccatggggagcttactagattgtcgggtttggtaagcaatttgatcacagctggccatggacgcgaagcagcatttgctgctgcagttctgggagataatgccctaatggagaaagcatggcaggacacaggaatgctggctgaagctgttttacatgctcaagcccatggtcgtccatcattaaggaacttggttataacatggaacaagatgctacagaaggaactggatcacacaccaactgtaaaaaccgatgccgccgcagcattcttggcttctcttgaggatccaaagctcacaagcttgggggaaactgagaaaaagcctcccattgaaatacttcctcctgggatgcctcctctatctgcacctccaatcgtgattaaaaaggctggagcaaaacctggcctccctaatgcagcaaaggcctcaaatggccctataggtgctccgatggttcaaggtgctcccatggctcaaggtactcctggggcacaaggggtccccatgaaccaagttactccatcacagggcagcgacgaggcaaagccatcagatgctacagtggcagatgcagctgccgcgacttcagaaggcactgcagctcccccagctgcagaaggtacagcagctcccagcagtgaggaacctaacgcagcagcacctggcaatgaggaaggcacagcacatccagtcaacgaggaagccacagcagctggagttccagatgcagcaggcagccctgatgtgcctgctccggctgctcctgctcctgctcctgctactgtagctgtagctgataccagtagctcggatgcacctgctgttactcccagtgaagttaccgtctccgccccctcaaccgaggcacctgagttgacggataagccatcttcaacagaggcatcgttgccacctccacccactgtttctgttccgaggttccgttccatgtcgacgagagggggcggcgaggcgaggcaggcgacggtgaagatcatcgagacggtgcacgtggaggtggaccggtatagcttcaagtcgatcgtccagaggctcacggggagggacgcgctggtcggcgactactcggaagggcccgagcgtagatcaaatgaagaggcgcctcagcgcgctgctgctgggtatatgagcaaccaagcgagcaagcccttcgctgatcgccactcaagcaaagacgagagctgttga

SEQ ID NO: 20751 - protein, 1416 aa, Sorghum bicolor
  misc_feature: Ceres ANNOT ID no. 8667823
  misc_feature: Down-regulated in shoot tissues in response to aminocyclopropane carboxylic treatment
  misc_feature: Up-regulated in shoot tissues in response to methyl jasmonate treatment
  misc_feature: Up-regulated in root tissues in response to methyl jasmonate treatment
  misc_feature: Down-regulated in shoot tissues in response to salicylic acid treatment
  misc_feature (1345)..(1375): Pfam ID: VQ Pfam Description: VQ motif
MAVENRPTSPFVLLILLFSSPPFSPLQLQVPTQISPTCHHHPRRQPCTASLLPPLCSSPDLQTPDLCSGPRPPLARDNPAAARGGRGEMLRLRAFRPTSDKVVKIQLHPTHPWLVTADANDRVSVWDWEHRQVIYELKAGGVDERRLVGAKLEKLAEGDDSKGKPTEAIRGGSMEFLSRSSSSDAPLVAFGSSDGVIRVLSMLTWKLVRRYTGGHKGAIACLMTYMSAAGEVHLVSGGSDGLLILWSADHIHDSRELVPKISMKAHDGGVVAVELSRVMGSAPQLITIGADKTLAIWDTVTFKEIRRIKPVPKLACHSVASWCHPRAPNLDILTCVKDSHIWVRLHSLMIFVVVCNSWNRLHAVPCKEKNLTIDTVYCMVAHPLQPHLVATGTNIGIILSEFDPRALPAIAPLPTPTGNKEHSAVYIVERELKLLNFQLSNTANPSLGNAGVASDAGRSRNDSIEQLIVKQTKKHISTPAPHDSYSVLSVSSSGKYVAIVWPDIPSFAVYKASDWSVVDSGTGKLFAWDTCRDRYALVESALAPRMPLVVKGGSSKKAKEAAAAAAQAAAAAASAASAATVQVRILLDDGTAHVLQRSIDGRSEPVIGLHGGALLGVTYRTSRRISPLTATAISTVQSMPLSGFGGSGSSFASDDPFSSKEGPPQNFQLYSWETYQPVSGLLAQPEWTVWDQTVEYCAFAYQQYIVISSLRPQFRYLGDVSIPFATGAVWHRRQLFVATPTTIECVFVDAGVAAIDIETKRRKEEMKAREAQSRAVEEHGDLALITVEAPQVTVSEKVSLRPPMLQVVRLASFQHSPSIPPFIVPKQSKFDGDDSVFQKELDDRRYAEVAVAGGGVSVAVTRFPPEQKRPIGPLVVVGVRDGVLWLVDRYMCAHALSLSHPGIRCRCLAAYGDPVSAVKWATRLAESITMTWLSLCWVWAMPLKLFICLEYLRDAVQGIVKFVKEFFDLIDAADATGQSDIAREVLKRLAAAASVKGALHGQMLRGLALRLANHGELTRLSGLVSNLITAGHGREAAFAAAVLGDNALMEKAWQDTGMLAEAVLHAQAHGRPSLRNLVITWNKMLQKELDHTPTVKTDAAAAFLASLEDPKLTSLGETEKKPPIEILPPGMPPLSAPPIVIKKAGAKPGLPNAAKASNGPIGAPMVQGAPMAQGTPGAQGVPMNQVTPSQGSDEAKPSDATVADAAAATSEGTAAPPAAEGTAAPSSEEPNAAAPGNEEGTAHPVNEEATAAGVPDAAGSPDVPAPAAPAPAPATVAVADTSSSDAPAVTPSEVTVSAPSTEAPELTDKPSSTEASLPPPPTVSVPRFRSMSTRGGGEARQATVKIIETVHVEVDRYSFKSIVQRLTGRDALVGDYSEGPERRSNEEAPQRAAAGYMSNQASKPFADRHSSKDESC

SEQ ID NO: 20752 - DNA, 1755 bp, Sorghum bicolor
  misc_feature: Ceres ANNOT ID no. 8667955
  misc_feature: Down-regulated in shoot tissues in response to salicylic acid treatment
  misc_feature: Encodes the peptide sequence at SEQ ID NO 20753
atgggcttcgacgtgggcttcgtcccctacaaccccgacgggtggggtccaccggaggccgcggccgcgccgctctccctcggcggtggctcctcgtctgtccccttcgctcccttctcccgctccgacaagctgggccgcatcgccgactggacccgcaacccgccgggccccgcggcgttcgccgccgctcgggacgccgtcttcgacttcgcggggctcgaggactccgtcggtctcgcgtccgcggacgactcgtccttccgcctcgtcgacggtaagccgccgccgcggcacccgcggttcgggccccgctggcgcttccagcagcggccccagctcccgcagcgccgcgacgaggaggtcgaggctcggcgccgcgaggccgagaaggagcgcgcccgccgcgaccgccactggcagcagaaccgccgcacgcaccaccagttcaaccgcggcgggccctcctcctcgtccgccaagccgtccgttgacatccagcccgagtggtcggtgaaggagcagatcccgttctcctccttctccaagctctccttcgccgtcgccgaccagcccgaggacctcctcgtctgtggcgcagttgagttctacgaccggacctacgaccgcgtcacccccagggcggagcgtcgcctcgagcgcttcaagtcgcggaacttcttcaaggtcaccaccaccgacgaccccgtcatccgccgccttgccgagaatgacacggccacggtattcgccactgacaccatcctggccgcactcatgtgtgcgcctcgaagcgtccagtcctgggacatcgtcattcagcgtgttggcaacaagttgttcttcgacaagcgtgatggttctcagcttgatcttctcactgtcaatgaaaccgcccaggagccactccctgaggccaaggaagacatcaactctgcgcattcactagcagttgaggccacatacgtcaatcagaacttctctcagcaggtgctgctccgcaatggtgagaaggtcactttcgatgagcctaacccgtttgccactgaaggggaggaagctgcttccgttgcttatcgctaccgccgctggaagcttgatgatgagacaagcttggttgctcgctgcgaggttcatgctgtgaatactgatccacgcggtgagcgccagttccttacactcaacgccctcaatgagtttgatcccaaggtcactggtgttgactggaggaagaagcttgagacccagcggggtgctgtgcttgccactgagctcaagaacaatgccaacaagcttgcacgctggactgcccaggcactgctcgctggtgcagacatgatgaagttgggttatgtgtcacgtctgcacccccgtgatcactacaaccattccattctcagtgtgattgggtacaagccaagggattttgctgcacagatcaatctcaacactgcaaatatgtgggggattgtgaagtctattgtggatgtatgcatgaagcttggtgagggaaagtatgtgcttgtgaaggatccagtgaagccgcaggtccggctttatgaagtgccaaatgacgcgtttgagaatgactatgttgaggaaccacttcctgaggaagagcaagtacgtcctttttctgaggacgtcgacgccaccgcgcaggaaatggatgctgctgcagaagcggaggctactggaacaactgcaggtgcagagggagacgctgagaagagcagtgacgttgctgctgtgtga

SEQ ID NO: 20753 - protein, 584 aa, Sorghum bicolor
  misc_feature: Ceres ANNOT ID no. 8667955
  misc_feature: Down-regulated in shoot tissues in response to salicylic acid treatment
  misc_feature (2)..(540): Pfam ID: eIF-3_zeta Pfam Description: Eukaryotic translation initiation factor 3 subunit 7 (eIF-3)
MGFDVGFVPYNPDGWGPPEAAAAPLSLGGGSSSVPFAPFSRSDKLGRIADWTRNPPGPAAFAAARDAVFDFAGLEDSVGLASADDSSFRLVDGKPPPRHPRFGPRWRFQQRPQLPQRRDEEVEARRREAEKERARRDRHWQQNRRTHHQFNRGGPSSSSAKPSVDIQPEWSVKEQIPFSSFSKLSFAVADQPEDLLVCGAVEFYDRTYDRVTPRAERRLERFKSRNFFKVTTTDDPVIRRLAENDTATVFATDTILAALMCAPRSVQSWDIVIQRVGNKLFFDKRDGSQLDLLTVNETAQEPLPEAKEDINSAHSLAVEATYVNQNFSQQVLLRNGEKVTFDEPNPFATEGEEAASVAYRYRRWKLDDETSLVARCEVHAVNTDPRGERQFLTLNALNEFDPKVTGVDWRKKLETQRGAVLATELKNNANKLARWTAQALLAGADMMKLGYVSRLHPRDHYNHSILSVIGYKPRDFAAQINLNTANMWGIVKSIVDVCMKLGEGKYVLVKDPVKPQVRLYEVPNDAFENDYVEEPLPEEEQVRPFSEDVDATAQEMDAAAEAEATGTTAGAEGDAEKSSDVAAV

SEQ ID NO: 20754 - DNA, 1299 bp, Sorghum bicolor
  misc_feature: Ceres ANNOT ID no. 8667961
  misc_feature: Up-regulated in root tissues in response to salicylic acid treatment
  misc_feature: Up-regulated in shoot tissues in response to salicylic acid treatment
  misc_feature: Encodes the peptide sequence at SEQ ID NO 20755
atgcctgcactgagaatgaagaggatgtttgatgttgatgattttgctaatgagttcaacaccaggaacgtgaaatccgttaaagtttcacacttttatgtcagtggattggagcagtcagctgtgttgaattcgtcagataatcctcatgatgagtcagatccaaccattcaacttgctgaccaggatattagggcaacggaaccttctggcttgcatgatccgatcggaggacaatccatgctcaaggatttaacatccgatgaagtgatagattcaccaaattcagaggttgattcctctgctaattatgatgacaacaaatctgtgttatatgcagtgaattatgttggcaaagattcttcagcccagaatttgtgtgttgttagtgatcatgagacaagctggggttcgaatcagtgttgcagactgctggatatttatagtccagatgatgatttcccgtacttgttggataatccacctgatcttctgcctagttatattggattgtgtgatgaatttgtatcaattgatgcattgatgaacatgagtagcagatgtggagcattcccacttattgagagtgccacggaagccagtgttgattataagccatgttcatctgaggtggatttgtgctttaattctgaggtattagagtggctcaaccctcatctgttggaggaggatttaccagatcttgttgattttgctgagttaaattcaaatgctgctcctgcaaaaaaagagcaatggaccaggaaggtcactcttgtgcttgatttggatgaaacccttgttcattcaactatggagcattgtgatgacgctgatttcacatttcctgtgttctatgatatgaaagagcatgtggtatatgtgaaaaagaggccacatgtccacatgttcctccaaaggatggttgaaatgtttgaggtagtgatatttacagccagtcaaagtgtttacgcagaccagttgcttgacatgctggatccagagaaaaaacttttctccaagcgtttcttccgggaatcatgtttgttcacagacaatggctacacaaaagatctgactgttgttggagtcgaccttgccaaggttgtcataattgacaacactccacaggttttccagctgcaagtgaacaatggtataccaatagagagttggtatagtaaccccttggacgaggctttacctcaattgatcccattcttagagacccttgctgtagctgatgatgtccggcctatcattgccaagaagtttggcaacataatagatagttgctaa

SEQ ID NO: 20755 - protein, 432 aa, Sorghum bicolor
  misc_feature: Ceres ANNOT ID no. 8667961
  misc_feature: Up-regulated in root tissues in response to salicylic acid treatment
  misc_feature: Up-regulated in shoot tissues in response to salicylic acid treatment
  misc_feature (247)..(421): SWISSPROT Homolog: EC 3.1.3.16 Phosphoprotein phosphatase
  misc_feature (247)..(423): Pfam ID: NIF Pfam Description: NLI interacting factor-like phosphatase
MPALRMKRMFDVDDFANEFNTRNVKSVKVSHFYVSGLEQSAVLNSSDNPHDESDPTIQLADQDIRATEPSGLHDPIGGQSMLKDLTSDEVIDSPNSEVDSSANYDDNKSVLYAVNYVGKDSSAQNLCVVSDHETSWGSNQCCRLLDIYSPDDDFPYLLDNPPDLLPSYIGLCDEFVSIDALMNMSSRCGAFPLIESATEASVDYKPCSSEVDLCFNSEVLEWLNPHLLEEDLPDLVDFAELNSNAAPAKKEQWTRKVTLVLDLDETLVHSTMEHCDDADFTFPVFYDMKEHVVYVKKRPHVHMFLQRMVEMFEVVIFTASQSVYADQLLDMLDPEKKLFSKRFFRESCLFTDNGYTKDLTVVGVDLAKVVIIDNTPQVFQLQVNNGIPIESWYSNPLDEALPQLIPFLETLAVADDVRPIIAKKFGNIIDSC

SEQ ID NO: 20756 - DNA, 1521 bp, Sorghum bicolor
  misc_feature: Ceres ANNOT ID no. 8668083
  misc_feature: Down-regulated in shoot tissues in response to methyl jasmonate treatment
  misc_feature: Down-regulated in root tissues in response to methyl jasmonate treatment
  misc_feature: Encodes the peptide sequence at SEQ ID NO 20757
atggtgtcgcagcacggcatcctcctcgctgttaacatcatctccgaccacttcggccccatcgtatccaaagtgtgtggctgccttctgcgccacggcgcgctgtccctgctggagatcgggcgccgcctcgagctctcgcccgcgcaggtgaagaactccctcctcatcctcattcagcacaactgcgtccaggcctacacaagccccagagggggtggcgataagacggtgacgctctacttggccatctttgacaatgtcctgcaccggctgcgcttctcaaagttcctttctgtcgtccgtgtggatattccagagtcagaagttcttctcgaaggattacttcagaatggtaggctaacatttgagcaacttgtggagcgaacaatatttaaagtaccagaaggcagccccttaccaacaagggaagaaatacgaatgaacttcaacaaacttgtatatgcacattatgtggaacgctgcccaaaatcggaaccttttttcgatcctcttgcagttgaacaacctacatccacaaggaaacgagctcctaaaattgttgaggcggttctttcacttgagcagaaagttgtctctactgcagctctatctgatgctgaaaggttttctcagataccatacttcatggaagggtcatcgagtgcaaatgatggccatcatgctgttgctggtaataagcgaaaacatgaagccttagaagttgatgaagaggattccataattgcagaaagtgaatttctctggcggataaattttgagaggttcatattttgtttaaagaagaagttctgtgcagaacgaaagaaagcaaagatgaggcttggaacacttgctatatgggaagcattttttgaggccaatgtaacaaacaacgacaacaagactgtgacatcaccaatagatggaattttggagagagtaggacaaaaggaaggaggcacgtcaatgactttggatcagataataagtgtattgaatgatttagagtgtacttctaccactaataacccagaagaatttacattcgatttgaataaattggttgagacatgtcgaaatgatgagatagagtcccttgtgaaaaagaaacatgggcaagaagcttacacaatctttaggttattgctgaaacaaggctgtccggttgagactgatgaaattactgacaggacaattctagacaagcaggttgttcatgaaactctatacaaactttggaaggacgaatacatagattcagagagagtcccttctacatcaggaacaggaaccggaagcactcagttctttgtttggagagtaaaaaatatttatagggaacacttcatggaccatctttaccatgctgctttaaacttgcgccagatgatcaattacatggctgaactattacttgagggttcaaaggacgaaatcaagcttcggaacagaaaaaacattttggtcctagctctcactagacatgatgaatcccttatgctgttccatgatttttga

SEQ ID NO: 20757 - protein, 506 aa, Sorghum bicolor
  misc_feature: Ceres ANNOT ID no. 8668083
  misc_feature: Down-regulated in shoot tissues in response to methyl jasmonate treatment
  misc_feature: Down-regulated in root tissues in response to methyl jasmonate treatment
  misc_feature (148)..(422): Pfam ID: RNA_pol_Rpc82 Pfam Description: RNA polymerase III subunit RPC82
  misc_feature (8)..(69): Pfam ID: HTH_9 Pfam Description: RNA polymerase III subunit RPC82 helix-turn-helix domain
MVSQHGILLAVNIISDHFGPIVSKVCGCLLRHGALSLLEIGRRLELSPAQVKNSLLILIQHNCVQAYTSPRGGGDKTVTLYLAIFDNVLHRLRFSKFLSVVRVDIPESEVLLEGLLQNGRLTFEQLVERTIFKVPEGSPLPTREEIRMNFNKLVYAHYVERCPKSEPFFDPLAVEQPTSTRKRAPKIVEAVLSLEQKVVSTAALSDAERFSQIPYFMEGSSSANDGHHAVAGNKRKHEALEVDEEDSIIAESEFLWRINFERFIFCLKKKFCAERKKAKMRLGTLAIWEAFFEANVTNNDNKTVTSPIDGILERVGQKEGGTSMTLDQIISVLNDLECTSTTNNPEEFTFDLNKLVETCRNDEIESLVKKKHGQEAYTIFRLLLKQGCPVETDEITDRTILDKQVVHETLYKLWKDEYIDSERVPSTSGTGTGSTQFFVWRVKNIYREHFMDHLYHAALNLRQMINYMAELLLEGSKDEIKLRNRKNILVLALTRHDESLMLFHDF

SEQ ID NO: 20758 - DNA, 1437 bp, Sorghum bicolor
  misc_feature: Ceres ANNOT ID no. 8668101
  misc_feature: Down-regulated in root tissues in response to methyl jasmonate treatment
  misc_feature: Down-regulated in shoot tissues in response to salicylic acid treatment
  misc_feature: Encodes the peptide sequence at SEQ ID NO 20759
atgctcgagggcaaaacggggagagcgcaacagataaatcctctatttggacccggcgctgcttcccatcaccattgctgcctcttctcttctcttctcttctcttctctcccatcccctgttcacaattttgcttgtgaatttcctgccagttcctcggcatcttatttctcgtgtctactgagacgtagaccaagaacgaggagagtaattggcgagcggttggagaacgaagacgagacggctgcggcggccggcggaggcccatttttgatgcgtggcgccgtcgaggtccacgcgattggcagagacgtcgcgtcgccgagccccctgagactcagagacgctccggcattggacatgatgaggtaccaaaggctgagcccggactgcctccccctcggcaacggcggcggtggcggaggcggaagcgccgtgccccggaagcaggcgtccagatcctccttcatcagagacgacgacgccccggccgtggccacggatggctcccgcctcgcttcgtacctcgcggcctccccgcacgagtccaagccgctgcgcgcccgcgcgccgcagccggcgcctctttcttcggcgacggccggccggagcccagcgcgcgagcaggcgcaccaccacacctccgactcctccgacaccgcctccccgagctccaccggcggcggcggtgccgtcgtcggcgacgtgctgctgcagtgggggcacaacaagcggtcgcgctgccggcgcgactcggccaccgccgcgccgtccgcgcagcggcggcagtctgcggtcggcggcggcggggtcaagatccagcggcgcgcatcggcgccggcggagaagctcatgccgccgccgccgacgacgaccgccgcaggttcctacacgcgcgggtccaacctgcggtcggcgtcgtccttcccgtcccgcgcctccgcttccgcctccaccgctgccgtcggcagccaccacctgccccaccaccacaggtccgtcgaggagcgatcggcgcagaagcggtcgtcgccggacaaggggcacaagtccgcgtccgccatggacgccgtcctgcacatggaatccaagaactatcaccaccaccaccaccacgactcgccgttgaccagcaacggcgccgccaccactgcagccgagaagctgggcgtggagcggttcgagctgccgcggatctacatctcgctgtcgcgaaaggagaaggaggacgacttccttgcgatgaagggctccaagctgccccagcggcccaagaagagggccaagaacgtggacaagaccctccaatttgtcttcccggggatgtggttgccagatttgacgaaaggccggtacgaggtgcgcgagaagaaatgcgtgaagaagaagagaagagggctgaaagggatggagagcatggacagcgactcggagtga

SEQ ID NO: 20759 - protein, 478 aa, Sorghum bicolor
  misc_feature: Ceres ANNOT ID no. 8668101
  misc_feature: Down-regulated in root tissues in response to methyl jasmonate treatment
  misc_feature: Down-regulated in shoot tissues in response to salicylic acid treatment
MLEGKTGRAQQINPLFGPGAASHHHCCLFSSLLFSSLPSPVHNFACEFPASSSASYFSCLLRRRPRTRRVIGERLENEDETAAAAGGGPFLMRGAVEVHAIGRDVASPSPLRLRDAPALDMMRYQRLSPDCLPLGNGGGGGGGSAVPRKQASRSSFIRDDDAPAVATDGSRLASYLAASPHESKPLRARAPQPAPLSSATAGRSPAREQAHHHTSDSSDTASPSSTGGGGAVVGDVLLQWGHNKRSRCRRDSATAAPSAQRRQSAVGGGGVKIQRRASAPAEKLMPPPPTTTAAGSYTRGSNLRSASSFPSRASASASTAAVGSHHLPHHHRSVEERSAQKRSSPDKGHKSASAMDAVLHMESKNYHHHHHHDSPLTSNGAATTAAEKLGVERFELPRIYISLSRKEKEDDFLAMKGSKLPQRPKKRAKNVDKTLQFVFPGMWLPDLTKGRYEVREKKCVKKKRRGLKGMESMDSDSE

SEQ ID NO: 20760 - DNA, 1383 bp, Sorghum bicolor
  misc_feature: Ceres ANNOT ID no. 8668110
  misc_feature: Up-regulated in root tissues in response to salicylic acid treatment
  misc_feature: Up-regulated in shoot tissues in response to salicylic acid treatment
  misc_feature: Encodes the peptide sequence at SEQ ID NO 20761
atggccgagacccctacgtatcagatcctggtgcgtctcctcgacgggcgcaccagatgtctccgcttctccacgcccaccgtttccggcacggtgctcctcgacgccgtcgcgtcgatctctcgcgtacccgctgacgccctccgcctcgtcaccggccgcatcgacgtctcgccctcctccgtcctcacctcggcagctgatggccagttcccctacgcgtccgcgctcctccgccttcgaggaggcaagggcgggttcggctccctcctcagaggggccgcctccaaggcggggcagaagaagaccagcaactttgacgcctgccgcgacatcaacggccgccgcctccgccacgtcaacgctgagcgccgcctcgaggaatggaaggccgaggccgccgaccgccagctagaaaagctcgctgagaactttatcaagaagaaggccaaggaggcgggccgcagcggcggaccctcagctgccgaggtggacaagtacctggagaagtaccgcaaagatgctgagatctgcgtgaacgcggttgaggaatccgtgcgtgcatctcttggaaagaggaagaccgctcctaagctgccctctggcgcagacgctaagaagcttaagatttggttgggaaagaacaaagtagaagaagatgaaagtgatagtgacagtgacattgacagtgatgtagatgatgagaacagtgaagatcatgagaacacagatgcaaaatctgtactagttgatgacgggaattgctcaaatggatccagcaaaaatgaaaagcttgaactgggttctgtttctgggtcacattcagaaggagagtcctcaggggaaaagtcccaactgacaacaagatcaggagctgaaggtggtgacttcgaatctgatggtagtgcagagcctgaggtaggaatggtggatcatctcatttctgtgaacagtgctgctgctgctgcttcagaagaagtgctgaaatcagatgaagtgacagcagatgaggataacactgcttcagctacttcaaaccaaagcaatccaggggtaccacaagttgaagaagcgctgaaagcagatgaggataaagctgcttcagctacttcaaaccaaaacaatccagaggtgccacaattagaagaatatgctgacgccagaaaatcttattcagagccattggaccttgcaaagtacagttcagctgcagaattggaggtgcttggtctggagaagctaaaaatagagctgcagtcccgcggattaaaatgtggtggaactttacaggagcgagctgcccgactcttccttctgaagacaactccattggataagttaccaaagaagctgcttgcaaaggccactactggggggaagtga

SEQ ID NO: 20761 - protein, 460 aa, Sorghum bicolor
  misc_feature: Ceres ANNOT ID no. 8668110
  misc_feature: Up-regulated in root tissues in response to salicylic acid treatment
  misc_feature: Up-regulated in shoot tissues in response to salicylic acid treatment
MAETPTYQILVRLLDGRTRCLRFSTPTVSGTVLLDAVASISRVPADALRLVTGRIDVSPSSVLTSAADGQFPYASALLRLRGGKGGFGSLLRGAASKAGQKKTSNFDACRDINGRRLRHVNAERRLEEWKAEAADRQLEKLAENFIKKKAKEAGRSGGPSAAEVDKYLEKYRKDAEICVNAVEESVRASLGKRKTAPKLPSGADAKKLKIWLGKNKVEEDESDSDSDIDSDVDDENSEDHENTDAKSVLVDDGNCSNGSSKNEKLELGSVSGSHSEGESSGEKSQLTTRSGAEGGDFESDGSAEPEVGMVDHLISVNSAAAAASEEVLKSDEVTADEDNTASATSNQSNPGVPQVEEALKADEDKAASATSNQNNPEVPQLEEYADARKSYSEPLDLAKYSSAAELEVLGLEKLKIELQSRGLKCGGTLQERAARLFLLKTTPLDKLPKKLLAKATTGGK

SEQ ID NO: 20762 - DNA, 717 bp, Sorghum bicolor
  misc_feature: Ceres ANNOT ID no. 8668203
  misc_feature: Up-regulated in root tissues in response to methyl jasmonate treatment
  misc_feature: Up-regulated in root tissues in response to salicylic acid treatment
  misc_feature: Up-regulated in shoot tissues in response to salicylic acid treatment
  misc_feature: Encodes the peptide sequence at SEQ ID NO 20763
atggcagcgccaggagccggcggcgagctgctcctgctgggcacatggtcgagcccatgggtgatccgagtgagggtggcgctggggctcaagggcctgagctacgactacctcgaggaggacctcgccaacaagagcgacctcctgctccggtccaacccggtgcacaagaaggtgccggtcctcatccacggcggccgcccggtgcgcgagtcgctcgtgatcctgcagtacctcgacgagtcgtggccgacgacgaccggtcctcctccgctcctcccagccgacccctacgaccgcgccacggcacggttctgggcggcctacgtcaacgacaagttttttccggcgtttagggtgctgttcagatcgctgacggacgagcagagagcggaggcgctccagagcgccgtccctgcggtggagacgttggaacgggcgttcgcggagtgctccagggggaaggcgttcttcggcggcgacgccgtcgggatcgtggacatcgcgctcgggagccacctgatttggatcagagtggtagacgaggtgggaggcaccgaccttctggacggggccaagttcccgggcttggcggcgtgggcggagcggttcgtggccgtggacgccgtgaagaaggtgacgccggacgcggggaaggtcctggagcagtacaaggggtttcgggctaaatggattgcggccgctggttctacctga

SEQ ID NO: 20763 - protein, 238 aa, Sorghum bicolor
  misc_feature: Ceres ANNOT ID no. 8668203
  misc_feature: Up-regulated in root tissues in response to methyl jasmonate treatment
  misc_feature: Up-regulated in root tissues in response to salicylic acid treatment
  misc_feature: Up-regulated in shoot tissues in response to salicylic acid treatment
  misc_feature (15)..(220): SWISSPROT Homolog: EC 4.4.1.5 Lactoylglutathione lyase
  misc_feature (8)..(81): Pfam ID: GST_N Pfam Description: Glutathione S-transferase, N-terminal domain
  misc_feature (110)..(208): Pfam ID: GST_C Pfam Description: Glutathione S-transferase, C-terminal domain
MAAPGAGGELLLLGTWSSPWVIRVRVALGLKGLSYDYLEEDLANKSDLLLRSNPVHKKVPVLIHGGRPVRESLVILQYLDESWPTTTGPPPLLPADPYDRATARFWAAYVNDKFFPAFRVLFRSLTDEQRAEALQSAVPAVETLERAFAECSRGKAFFGGDAVGIVDIALGSHLIWIRVVDEVGGTDLLDGAKFPGLAAWAERFVAVDAVKKVTPDAGKVLEQYKGFRAKWIAAAGST

SEQ ID NO: 20764 - DNA, 1593 bp, Sorghum bicolor
  misc_feature: Ceres ANNOT ID no. 8668218
  misc_feature: Up-regulated in shoot tissues in response to methyl jasmonate treatment
  misc_feature: Up-regulated in root tissues in response to methyl jasmonate treatment
  misc_feature: Encodes the peptide sequence at SEQ ID NO 20765
atggcgaccttcaccgcggcctcctccctctccctcctcttctcccaccccaactcccactcccgccaaccatccgtgcgcggggggcccgccgccggctcccacctccgcctgcctccccgcgccagccccagccgcgcgcgctgcgcctcctccgacacgacggccacgaagcaccgccgcccagcggaggagaacatccgcgaggaggcggcgcggctccggggccccgcgcagggcttctcggcgtggtacgagcccttcccgccggcgcccggcggcgaccccgacgagcgctactcgctggacgaggtcgtctaccgctccagctcggggggcctcctcgacgtgcgccacgacatggaggcgctggcgcgctacccgggctcctactggcgcgacctcttcgactcccgcgtcggccgcaccgcctggccctacggctcgggcgtctggtccaagaaggagttcgtgctccccgagatcgactccgaccacatcgtctccctcttcgagggcaactccaacctcttctgggcggagcgcctcggccgcgagcacctcggcgggatgaacgacctctgggtcaagcactgcggcatctcccacacgggctccttcaaggacctcggcatgaccgtgctcgtcagtcaggtgaaccgcctccgccgcgcgccgctctcgcgccccatcaacggtgtcggctgtgcgtccacgggagacacctccgccgcgctctcggcctactgcgcggccgcgggaatccccgccatcgtgttcctgccagcggaccgcatctcgctgcagcagctcatccagccaatcgccaacggcgccaccgtgctctctctagacactgattttgatggctgcatgcgactcattcgcgaggtgactgcagagctgccaatctaccttgccaattcactcaactcgcttcgcctcgaggggcagaagacagcggccatcgagatattgcagcagttcaattggcaggtgccggattgggtcattgttccaggaggcaatcttgggaatatctatgcattctacaaggggtttgagatgtgccgcgttcttggccttgttgatcgtgtgccacggcttgtctgtgcacaggctgcaaatgcaaatccgttgtaccggtactacaagtcaggctggactgagtttcagccacaagttgctgaaactacatatgcatctgcaatacagattggtgatcctgtatctgttgaccgtgcggtggtcgcgctgaaggctaccaatggtattgtggaggaggctacagaggaggagctaatggatgcgacggctcttgctgaccgcactgggatgtttgcttgcccacatactggggttgcacttgctgctttgtttaagctccgggatcagcgtataattgggcctaatgaccgcactgtggttgttagcacagctcatgggctgaagttcacgcagtcaaagatcgactaccatgacaaaaacatcaaggacatggtttgccagtatgctaatccaccgatcagtgtgaaggctgactttggttctgtgatggatgttctccagaaaaatctcaatggtaagatataa

SEQ ID NO: 20765 - protein, 530 aa, Sorghum bicolor
  misc_feature: Ceres ANNOT ID no. 8668218
  misc_feature: Up-regulated in shoot tissues in response to methyl jasmonate treatment
  misc_feature: Up-regulated in root tissues in response to methyl jasmonate treatment
  misc_feature (58)..(526): SWISSPROT Homolog: EC 4.2.3.1 Threonine synthase
  misc_feature (168)..(480): Pfam ID: PALP Pfam Description: Pyridoxal-phosphate dependent enzyme
MATFTAASSLSLLFSHPNSHSRQPSVRGGPAAGSHLRLPPRASPSRARCASSDTTATKHRRPAEENIREEAARLRGPAQGFSAWYEPFPPAPGGDPDERYSLDEVVYRSSSGGLLDVRHDMEALARYPGSYWRDLFDSRVGRTAWPYGSGVWSKKEFVLPEIDSDHIVSLFEGNSNLFWAERLGREHLGGMNDLWVKHCGISHTGSFKDLGMTVLVSQVNRLRRAPLSRPINGVGCASTGDTSAALSAYCAAAGIPAIVFLPADRISLQQLIQPIANGATVLSLDTDFDGCMRLIREVTAELPIYLANSLNSLRLEGQKTAAIEILQQFNWQVPDWVIVPGGNLGNIYAFYKGFEMCRVLGLVDRVPRLVCAQAANANPLYRYYKSGWTEFQPQVAETTYASAIQIGDPVSVDRAVVALKATNGIVEEATEEELMDATALADRTGMFACPHTGVALAALFKLRDQRIIGPNDRTVVVSTAHGLKFTQSKIDYHDKNIKDMVCQYANPPISVKADFGSVMDVLQKNLNGKI

SEQ ID NO: 20766 - DNA, 1227 bp, Sorghum bicolor
  misc_feature: Ceres ANNOT ID no. 8668242
  misc_feature: Up-regulated in root tissues in response to methyl jasmonate treatment
  misc_feature: Down-regulated in shoot tissues in response to aminocyclopropane carboxylic treatment
  misc_feature: Down-regulated in shoot tissues in response to methyl jasmonate treatment
  misc_feature: Down-regulated in shoot tissues in response to salicylic acid treatment
  misc_feature: Encodes the peptide sequence at SEQ ID NO 20767
atgcccgtggtgcccgcggtggctgaggccgaggccggcgtcaccgctcagactggaaatcgctcgccggcggaggtggagcatgtgttccggcgctacgacgccaacggcgacgacaagatctcggcggaggagctggcgtctgtgctgtgggtgctgggcatgccgccgggtccttgggaggtgcggcgcatgatggacgatatggattccgaccgcgacaacttcgtggaccttgacgagttcgtcgccttccactgcagcaatggggaggagaagggggagggcagggaggacgccaacgagggtccgaggccgacctactcagctaagaaacgaaccaaacacacccatactcccgtactgtactacgctcttgacgccgctgcctccctcaaccctattatgcggccgacgccggcgcttgccgccggcggacgcacggtcgcaagcttcctatccgccacggaatggatgcttccgtctccggccacccaagtccacaccatctccgtccttccctctcgtctcgagttcgccttctccaacctcacgacgtcgctcaggaatggcggcggcaacggtagtgagactggcaatcctaagttccagatagtacgggacgacctcctccacccgctcgccaacggcaacaaggcgcgcaagctcgacgccctcctgcccgtcctccgccactgcggcgctactgacatcgttacatgtgggggttgccagagcgctcatgccgcagcagttgcggttcattgtgccgagtggggaatcaggccacatatactgctgagaggcgagcaactggatgttcccacagggtataatctgatctcattgatgtttggcaatgtgacatatgcctctcggtctttgtatgcccaaagagatgagatgctttatgagcatgccataaaggttgcaggatgtagtggcacagtgatgtgggcagatgaaattataggaaaggatttgggtttagatgaggacaccactgatggaaatggttcaagaaaagtaatgattgttaaggaaggggcaggtagtgttcaagcactgcttggtgtcatgcggctactggagtatctttctggtttgacattatttgggaaggatgagaaagttcatatcgttgtagattctggaacaggcacaacagctgtggggttagctcttggagcgactccagtggagggttaccggtgttatgcttgctga

SEQ ID NO: 20767 - protein, 408 aa, Sorghum bicolor
  misc_feature: Ceres ANNOT ID no. 8668242
  misc_feature: Up-regulated in root tissues in response to methyl jasmonate treatment
  misc_feature: Down-regulated in shoot tissues in response to aminocyclopropane carboxylic treatment
  misc_feature: Down-regulated in shoot tissues in response to methyl jasmonate treatment
  misc_feature: Down-regulated in shoot tissues in response to salicylic acid treatment
  misc_feature (25)..(53): Pfam ID: efhand Pfam Description: EF hand
MPVVPAVAEAEAGVTAQTGNRSPAEVEHVFRRYDANGDDKISAEELASVLWVLGMPPGPWEVRRMMDDMDSDRDNFVDLDEFVAFHCSNGEEKGEGREDANEGPRPTYSAKKRTKHTHTPVLYYALDAAASLNPIMRPTPALAAGGRTVASFLSATEWMLPSPATQVHTISVLPSRLEFAFSNLTTSLRNGGGNGSETGNPKFQIVRDDLLHPLANGNKARKLDALLPVLRHCGATDIVTCGGCQSAHAAAVAVHCAEWGIRPHILLRGEQLDVPTGYNLISLMFGNVTYASRSLYAQRDEMLYEHAIKVAGCSGTVMWADEIIGKDLGLDEDTTDGNGSRKVMIVKEGAGSVQALLGVMRLLEYLSGLTLFGKDEKVHIVVDSGTGTTAVGLALGATPVEGYRCYAC

SEQ ID NO: 20768 - DNA, 3729 bp, Sorghum bicolor
  misc_feature: Ceres ANNOT ID no. 8668253
  misc_feature: Up-regulated in shoot tissues in response to salicylic acid treatment
  misc_feature: Up-regulated in root tissues in response to salicylic acid treatment
  misc_feature: Encodes the peptide sequence at SEQ ID NO 20769
atggaagcagcgggaggtgcgaaagggagggatggcgtggagaagaaggaagaggagaacggcaacggccacggcggcggcgacgccgtgaagaaggtgccgttcacggggctgttccggtacgccgacggcacggacgtgctgctcatgctcctcggcacggtggggtcggtggccaacggcgtgtcgcagcccgtcatgacgctcatcttcggccaggcagttctgaactttgtctacctaggcattgcaacagcggttgtttcctttcttcaggtgtcatgttggacaatgacaggagaaaggcaggcaacacgcatccgatctctatacctaaaatctgtcttgagacaagaaatagcattcttcgatgtagaaatgacaactgggcagatagtttcaaggatgtctggtgataccgtgttagttcaggatgccattggtgagaaggtcggcaagtttcaacagcttgtggcaaccttcgttggtggtttcgtgatagcattcgtaaaaggatggcttctatctcttgtcatgttggcatgcatacctcccgttgtcattgctggtggaattgtctcaaaaatgcttgctaaaatatcaaccaaggggcaagcatcatacagtgatgcaggcaacattgttgaacagacacttgggtctataaaaacagttgtctctttcaatggggagaaacaggctattgcattgtataataaactcatacacaagtcatacaaggctgctgttgaagaaggaatcaccaatggttttggcatgggttctgttttcttcatatttttctcaagctatggtttagccatatggtatggcggaaagttgattcttagcaaaggttactcaggaggagacatcatcaatatcttgtctttaggtaatgcaacaccctgcatggcagcctttgcaggaggacaatctgcggcatacagattgttcacaacgatcaagaggaaaccagagattgacccagatgacccaactggtaagcaactagaagacatcaagggtgatgttgacctaaatgacgtgtacttcagctacccagcgagaccagagcaactagtatttgatgggttctcgctacatgtgtctagcggcactacaatggctatagttggggagagtggaagtggcaagtcaactgtgatcagtcttgtagagagattctatgatccacaagccggtgaggttttgattgatgggattaacatcaagagtttgcagcttgattggataagagggaagattggtcttgttaaccaagagccattgctctttatgacatctatcaaagataatataacatatggaaaagaggatgcaacaattgaggagatcaaaagagcagctgagcttgctaatgcagcaaatttcatcgataagttacccaatggttatgacacgatggttggccaacgtggtgctcagctatcagggggacaaaagcaaaggatcgctattgcaagagcaatcatcaaaaaccccagaattcttttgttagacgaggctactagtgcattggatgtggagtcggagcggattgttcaggaggcactaaataggatcatgctggataggacaacacttgtggttgcacatcgcctaagtactgtgagaaatgctgattgcatatcagttgttcaacaagggaaaatagttgaacaaggtccccacgatgaactgataatgaaccctgatggtgcttattctcaacttattcgtctccaagaaagcaaagaagaagaacagaaattagatcatcacatgtctgattcaaggtctaaaagtagaagcctctcactgaagcgatcaataagcagaggttcagcgggaaacagtagtcggcattctttgaccctcccctttggcatgcctggttcagttgaattgcttgaaggcaatgatgcaaattgggaggatgagaaagaccaggctcgtgatggtgaggccccaaagaaagctccaatgggacggctagctagtctaaacaagccagaggtgccgattcttttgttaggatcgctagctgctggagtccatggagtgcttttcccaatgtttggtctaatgatctccaatgccatcaaaacattctacgagccgccacaccaactaaaaaaggatgcaagcttttggggtttgatgtgtgttgtgttgggtattgtatcaatactatcaataccagtggagtatttcttatttgggatagccggggggaagcttatcgagcgtgtccgtgccatgtcgtttcggagcattgtgcaccaagaagttgcttggtttgatgatcccaaaaattccagtggagcacttggcgcaaggttgtcagttgatgctttgaatgtccgacgtttagtgggtgataacttggccttggcagttcaggtcatctcgacactaattgcaggatttgtcattgcttttgtggcagattggaagctcacattgatcatcctttgtgtgatgccactatcgggtgttcaaggttatgcacaagtgaagttcttgaagggtttcagtgaagatgccaagatactgtatgaagacgcaagtcaagtggccaccgatgcagtcagcagtatcaggactgtagcttctttttctgctgaaaaaagagtgacgacaatttatgaagataaatgtgaagcctcaaagaaacaaggagtcagaacaggaatggttggaggccttggttttggtttctcattcttgatgatgtaccttacatatggactttgtttctacgttggagcacagtttgttcgtcacaacaaatctacttttggagatgttttcaaggtattttttgcactgatgttggcaacaattggaatatctcaaacaagtgcattggcttctgattctacaaaggccaaggattcagctgtctccatattcgcattattggacagaaagtccaaaatcgactcaagcaatgatgaaggttcgacgctacatgaggtcaagggcgacatcgatttccgacatgtcagcttcaagtatccaagccgcccagatattcaaatatttagcgattttaccttgcacattcccgctggcaagactgttgcacttgtgggagagagtggcagtggcaagtcaacggtaatctctttgttggaaagattctacaaccccgactctggtactatctcattggatggagtagagatcaaaagcctaaaagtcacttggttaagggaccaaatgggtctggtgagccaagagcctattctcttcaatgacacaatccgtgccaacatagcttatgggaaacatggggaagtcactgaggaggagctcatcaaggccgcaaaggcagccaatgcacatgagttcgtatcaagccttccccaggggtatgacaccactgttggagagaggggggttcagctatctggtggccagaaacagcgggtagccatagcaagggccatactaaaagatcctaggattctacttcttgacgaggcaacgagtgccttggatgctgagtctgagcgcatagtgcaggatgccttggatcatgtaatggttggcaggacaacagttattgtggcacaccgcctctccacgatcaaaagtgctgacattatcgcagttcttaaggatggtgtgatagtggagaaaggaagacatgaggcactcatgaatatcaaagatggattctatgcttctctagttgaacttcgttcagcctcatcatag

SEQ ID NO: 20769 - protein, 1242 aa, Sorghum bicolor
  misc_feature: Ceres ANNOT ID no. 8668253
  misc_feature: Up-regulated in shoot tissues in response to salicylic acid treatment
  misc_feature: Up-regulated in root tissues in response to salicylic acid treatment
  misc_feature (650)..(1241): SWISSPROT Homolog: EC 3.6.3.44 Xenobiotic-transporting ATPase
  misc_feature (343)..(567): SWISSPROT Homolog: EC 3.6.3.17 Monosaccharide-transporting ATPase
  misc_feature (373)..(557): Pfam ID: ABC_tran Pfam Description: ABC transporter
  misc_feature (1027)..(1212): Pfam ID: ABC_tran Pfam Description: ABC transporter
  misc_feature (46)..(306): Pfam ID: ABC_membrane Pfam Description: ABC transporter transmembrane region
  misc_feature (677)..(953): Pfam ID: ABC_membrane Pfam Description: ABC transporter transmembrane region
MEAAGGAKGRDGVEKKEEENGNGHGGGDAVKKVPFTGLFRYADGTDVLLMLLGTVGSVANGVSQPVMTLIFGQAVLNFVYLGIATAVVSFLQVSCWTMTGERQATRIRSLYLKSVLRQEIAFFDVEMTTGQIVSRMSGDTVLVQDAIGEKVGKFQQLVATFVGGFVIAFVKGWLLSLVMLACIPPVVIAGGIVSKMLAKISTKGQASYSDAGNIVEQTLGSIKTVVSFNGEKQAIALYNKLIHKSYKAAVEEGITNGFGMGSVFFIFFSSYGLAIWYGGKLILSKGYSGGDIINILSLGNATPCMAAFAGGQSAAYRLFTTIKRKPEIDPDDPTGKQLEDIKGDVDLNDVYFSYPARPEQLVFDGFSLHVSSGTTMAIVGESGSGKSTVISLVERFYDPQAGEVLIDGINIKSLQLDWIRGKIGLVNQEPLLFMTSIKDNITYGKEDATIEEIKRAAELANAANFIDKLPNGYDTMVGQRGAQLSGGQKQRIAIARAIIKNPRILLLDEATSALDVESERIVQEALNRIMLDRTTLVVAHRLSTVRNADCISVVQQGKIVEQGPHDELIMNPDGAYSQLIRLQESKEEEQKLDHHMSDSRSKSRSLSLKRSISRGSAGNSSRHSLTLPFGMPGSVELLEGNDANWEDEKDQARDGEAPKKAPMGRLASLNKPEVPILLLGSLAAGVHGVLFPMFGLMISNAIKTFYEPPHQLKKDASFWGLMCVVLGIVSILSIPVEYFLFGIAGGKLIERVRAMSFRSIVHQEVAWFDDPKNSSGALGARLSVDALNVRRLVGDNLALAVQVISTLIAGFVIAFVADWKLTLIILCVMPLSGVQGYAQVKFLKGFSEDAKILYEDASQVATDAVSSIRTVASFSAEKRVTTIYEDKCEASKKQGVRTGMVGGLGFGFSFLMMYLTYGLCFYVGAQFVRHNKSTFGDVFKVFFALMLATIGISQTSALASDSTKAKDSAVSIFALLDRKSKIDSSNDEGSTLHEVKGDIDFRHVSFKYPSRPDIQIFSDFTLHIPAGKTVALVGESGSGKSTVISLLERFYNPDSGTISLDGVEIKSLKVTWLRDQMGLVSQEPILFNDTIRANIAYGKHGEVTEEELIKAAKAANAHEFVSSLPQGYDTTVGERGVQLSGGQKQRVAIARAILKDPRILLLDEATSALDAESERIVQDALDHVMVGRTTVIVAHRLSTIKSADIIAVLKDGVIVEKGRHEALMNIKDGFYASLVELRSASS

SEQ ID NO: 20770 - DNA, 3477 bp, Sorghum bicolor
  misc_feature: Ceres ANNOT ID no. 8668387
  misc_feature: Down-regulated in root tissues in response to salicylic acid treatment
  misc_feature: Encodes the peptide sequence at SEQ ID NO 20771
atgtcgtctcgcttcccccaccaccacggcggcggcggcgaccacccgcgcgggggcgacgcgggcgacgccgccctcgcccgcgacatcgtcacgctccacaaggcgctttccctagacccctccgcccgccgccgccgctccctaccgctcccctccccatcccccgccgccaccgagcagccgcgcaacaagccccggctcaagccctccttctcctcctcctcctcgtcgtcgcgcaagctcctgccgtccaccgtcaactcctccaccgcttccacttcctcttcctcttcctcaacctcttccttctggaagaagtccctgaccgccatctcgcacctgggccgccgccgcctcgactgcgcgttcgcgctgcacgtgcactccgtcgacggcctccccgccgcgctcgacgggtccgcggtctccgtccagttccgccggatgtccgtgtccgcctccacccgctccgtcccggccgccctcggcgccgccgccttcgaggaggcgctcacgctgcgctccccggtctacttctcccgcggcgcgaaggccgtggtcaagtacgagccccgcgcctttgctgtctccgtcgccgcctccactctcgagctcggtaagcacgaggtcgacctcacccgcctgctcccgctctccttcgacgatctcgaggacggcggcgactccggcttcggcaagtggagcaccagcttccggctgtccggccccgcccgcggcgcgcgtcttaacgtaaccttctcttgctcgctcctcgcgggcggcgccgccgccagcgagcagcacaaggccggggaagtggcggggctgcggcgcgggtccatggcgcggccggtgtcggtgcaggcgccgacgcctgtgccggcgcggagcagggacgtcagggtgctgcacgaggtgctgcccagcttgaggtctgccaggtcgcttccttttgttggtgacggagctcctgatgcgaggaaagaggaggtggcagcactggactgcacggaggaggggtctccggaggcaaagcactgcacgtcggtagaggttaagaagggggactcggtgcgtcaagatggcgattggggcacggtggacttcaatgttgttgagcatggagttgaggttgcttcagatgacccaccaaggctcaaacatgcggaaaccagcaatgctgctgatcaaaatgaggattcagggtttcaaattgacgaagagggatcattcaagcctgtgctaataagtggcgatgtcgctgatcttgctgaagatcagactgttggagtgaagactgaggtggcagtcagtgatgttgctgttgaaaaggagaatgtggaagacaaacaggatggaatagtcaaagccgcttcactgcctagtgctgctcttgaagcagaggatcagtttggagcagatgcggaactggaggacctggaatgtattttgaacgagctctcagttgctgagccagaggaatttgaatcaccagctgtagaagataagcattctaggcgattgagctgcacaggtgtgactgatagttacaagtctgccagtaggaagggcagatcgcacagcatggatgtttcaacagattctgttgctaatgagttcttggatatgcttggaatagagcatagcccatttgggcaaccctcagatagtgattccgagtcaccaagagaacgactttggaagcagtttgaaaaggaagcgctagcatctggcaacgctattcttggtttggactttgaccatggaattgaaggacctacttgtgaggatgttgtggaggatttcgatctctctgcaatgatacatgaggctgagctcgagcttcagaatggaagccaacccattgataccaaatttcgagctaagtcgctggaagacgaagaaactgaggccttaatgcgtcaatttgggctaaacgagaagtccttccaatcttctcctcctgaaagtagaagtgggtttggtagccccattaacctcccacctgagcagcccctggagctaccaccattggctgaaggtttaggtccatttattcagaccaaagatggaggatttctgcgatcaatgaacccagccctgttcaaaaatgcaaagaacaactgcagcttggttatgcaggcttcttctccgattgtactgccagcagagatgggatctgggattatggatatactgcatggtctggcatcagttggaattgagaagttatcaatgcaggcaaacaaacttatgcccttggaagatgttaatggtaaaatgatgcagcagattgcttgggaagctgctccagctctggagtctggcgaaagatatgatgcattggactatcatagcatcgatgctttggtaggagggggtggaaatgctccctctggtaagaagaagaagggcaggtgtgctgaactttcatccttgggtggggagaatgcttcagaatatgtttcacttgaggaccttgcaccattagctatggaaaagattgaagctctttccattgagggtttgaggatacaatctggcatgtcagaagaagatgcaccctccaatatcagtgcaaagcctattggggaattttcatctctgcaaggaaaatgtgcagagagtaccttgtctcttggtttagagggaactgctggtttgcagcttctggatgttaagcaaagtggagaagaagttgatggattaatgggcttgtcaatcactctggatgagtggatgaggcttgattctggggtagtggacgaagaagaacagtacagtgaccggacatcgaagatacttgctgctcaccatgcaaaatccatggagttagttgccgaaaaccggaatggagacagaaagagtaggagatctggtagaagatggggcttgttagggaataactttacagtagctctcatggttcaactgcgtgacccactacgcaactacgagccagtgggcacaccaatgcttgcattaatccaagttgaaagggtttttgtacccccaaagcccaaaatctacagtactgtcttagacaaacccaacagcgagcaggatgatgaggaacccaaaaccgaagaggttccagataaggcattggtcacggaagagaaggctgaggagttagaggatcccattccccaattcaaggttacagaagtgcatgtcgctggtttcaagagcgaacctgagaagacgaaaccatggggcaatcaaacgcagcagcagtctggctctagatggttgcttgcagctggcatgggcaagggaaacaagcatcctctgatgaaatccaaagctatcgtgaagccaaccaaagaggcagctggtcaggcaggagacaccctctggagcatttcttcacgtgttcatggagcagggaccaggtggggcgagctaacaggaaacaagaatcattcacgtaacccaaatatcgtgcttcaaaaggacaagagatttcggtga

SEQ ID NO: 20771 - protein, 1158 aa, Sorghum bicolor
  misc_feature: Ceres ANNOT ID no. 8668387
  misc_feature: Down-regulated in root tissues in response to salicylic acid treatment
MSSRFPHHHGGGGDHPRGGDAGDAALARDIVTLHKALSLDPSARRRRSLPLPSPSPAATEQPRNKPRLKPSFSSSSSSSRKLLPSTVNSSTASTSSSSSSTSSFWKKSLTAISHLGRRRLDCAFALHVHSVDGLPAALDGSAVSVQFRRMSVSASTRSVPAALGAAAFEEALTLRSPVYFSRGAKAVVKYEPRAFAVSVAASTLELGKHEVDLTRLLPLSFDDLEDGGDSGFGKWSTSFRLSGPARGARLNVTFSCSLLAGGAAASEQHKAGEVAGLRRGSMARPVSVQAPTPVPARSRDVRVLHEVLPSLRSARSLPFVGDGAPDARKEEVAALDCTEEGSPEAKHCTSVEVKKGDSVRQDGDWGTVDFNVVEHGVEVASDDPPRLKHAETSNAADQNEDSGFQIDEEGSFKPVLISGDVADLAEDQTVGVKTEVAVSDVAVEKENVEDKQDGIVKAASLPSAALEAEDQFGADAELEDLECILNELSVAEPEEFESPAVEDKHSRRLSCTGVTDSYKSASRKGRSHSMDVSTDSVANEFLDMLGIEHSPFGQPSDSDSESPRERLWKQFEKEALASGNAILGLDFDHGIEGPTCEDVVEDFDLSAMIHEAELELQNGSQPIDTKFRAKSLEDEETEALMRQFGLNEKSFQSSPPESRSGFGSPINLPPEQPLELPPLAEGLGPFIQTKDGGFLRSMNPALFKNAKNNCSLVMQASSPIVLPAEMGSGIMDILHGLASVGIEKLSMQANKLMPLEDVNGKMMQQIAWEAAPALESGERYDALDYHSIDALVGGGGNAPSGKKKKGRCAELSSLGGENASEYVSLEDLAPLAMEKIEALSIEGLRIQSGMSEEDAPSNISAKPIGEFSSLQGKCAESTLSLGLEGTAGLQLLDVKQSGEEVDGLMGLSITLDEWMRLDSGVVDEEEQYSDRTSKILAAHHAKSMELVAENRNGDRKSRRSGRRWGLLGNNFTVALMVQLRDPLRNYEPVGTPMLALIQVERVFVPPKPKIYSTVLDKPNSEQDDEEPKTEEVPDKALVTEEKAEELEDPIPQFKVTEVHVAGFKSEPEKTKPWGNQTQQQSGSRWLLAAGMGKGNKHPLMKSKAIVKPTKEAAGQAGDTLWSISSRVHGAGTRWGELTGNKNHSRNPNIVLQKDKRFR

SEQ ID NO: 20772 - DNA, 1629 bp, Sorghum bicolor
  misc_feature: Ceres ANNOT ID no. 8668549
  misc_feature: Up-regulated in shoot tissues in response to salicylic acid treatment
  misc_feature: Encodes the peptide sequence at SEQ ID NO 20773
atggccgccacggtcgtggtcttgtcccaggccatcatcgtctgcatcgctcgccctcatttcactgggagcatcgatctatctatcagcttgctcattggccatcttcgatcgtcttccatggagaggctcattgccggcctacttggcttcctattgattgcgtcagtaggaagccatgcagctcgtgctccggatcaatactggaagtctgctcttcccgacactcccatgccgacctccctctcccaactcctcaacaccccagccggaggcacgaccgtcaacgtcggctggggcggtgtccacgtcgatgctgggcacggtaagcccgggggtacgacggttgacgtaggcaagggcggcgtcggcgtcaatgttaaccctggcagcagcggcaggaagcccggcggcaccacggtcggcgttggtgggaaagggggagtcggcgttaaggtcaaccctggctatgggaagcccggcggcacgacggttggtgtcgggaagggcggagttggtgttaacgtcaaccctggctacgggaagcccggtggcaccactgttggcgtcgggaagggcggcgtcggcgtgaacgtcaaccctggcaagcccggcggcactacggtcggcgtcggcaagggcggcgttggcgtcgacgtcaatcctggctatggcaagcccggtggcaccacggtcggcgtcggcaagggcggagtgggcgtcaacgttaatcctgccaagccgggcggtaccggcacaaccgttggcgttggcaaaggcggcgtgggcgtcggcgtcaatcccgggtacggcaagcccggcggcaccacggtcggcgttggcaagggcggggtcggcgtccacgtgaacaacccgcgcaagaagcccgtcaacgtcaacgccgggcctttccagtacctgtacgccgcatcagagacgcagctgcacgacgaccccagcgtagcgctcttcttccaggagaaggacctccagcagcccggtaagaaggtgaccgtccagttcgccaacaccgcgaccgccggcgccaagttcctcccgcgaagcgatgccgaggccatcccgttctcctccgagaaggtccccgagatcctgagccgcttctcggtcgacccggactccgtcgaggcggcggagatggcgcagacgctgcgcgactgcgaggcgcccgcggccaagggcgagaagaaggcgtgcgccacgtcgctggagtccatggtggacttcgccaccaccagcctcgggaccagccacgtgagggccgtctcgaccgtcgtggccaaggagggctcgccgaagcaggagtacaccgtgaccggcgtcaagcccgcggccggcaccggccacgacggccgcctcgtggcctgccacgcggagccgtacgcgtacgccgtgttcgcgtgccacctgacgcagcagacgcgggcgtactcggtgtcgatgctcggcagggacggcacggccgtggacgctgtcgcggtgtgccacgccgacacgtccggctggaaccccaagcacatcgccttccaggtgctcaaagtgaagcccggcacggtgccggtctgccacttcctgccgcaggaccacgtcgtctggacccgcagcggctga

SEQ ID NO: 20773 - protein, 542 aa, Sorghum bicolor
  misc_feature: Ceres ANNOT ID no. 8668549
  misc_feature: Up-regulated in shoot tissues in response to salicylic acid treatment
  misc_feature (322)..(541): Pfam ID: BURP Pfam Description: BURP domain
MAATVVVLSQAIIVCIARPHFTGSIDLSISLLIGHLRSSSMERLIAGLLGFLLIASVGSHAARAPDQYWKSALPDTPMPTSLSQLLNTPAGGTTVNVGWGGVHVDAGHGKPGGTTVDVGKGGVGVNVNPGSSGRKPGGTTVGVGGKGGVGVKVNPGYGKPGGTTVGVGKGGVGVNVNPGYGKPGGTTVGVGKGGVGVNVNPGKPGGTTVGVGKGGVGVDVNPGYGKPGGTTVGVGKGGVGVNVNPAKPGGTGTTVGVGKGGVGVGVNPGYGKPGGTTVGVGKGGVGVHVNNPRKKPVNVNAGPFQYLYAASETQLHDDPSVALFFQEKDLQQPGKKVTVQFANTATAGAKFLPRSDAEAIPFSSEKVPEILSRFSVDPDSVEAAEMAQTLRDCEAPAAKGEKKACATSLESMVDFATTSLGTSHVRAVSTVVAKEGSPKQEYTVTGVKPAAGTGHDGRLVACHAEPYAYAVFACHLTQQTRAYSVSMLGRDGTAVDAVAVCHADTSGWNPKHIAFQVLKVKPGTVPVCHFLPQDHVVWTRSG

SEQ ID NO: 20774 - DNA, 777 bp, Sorghum bicolor
  misc_feature: Ceres ANNOT ID no. 8668574
  misc_feature: Up-regulated in root tissues in response to salicylic acid treatment
  misc_feature: Up-regulated in shoot tissues in response to salicylic acid treatment
  misc_feature: Encodes the peptide sequence at SEQ ID NO 20775
atggccgaccacaaggaggagcccgtgctggagtctgtgatggacaagatcaccgagaagttccacggcggggactccacgtcgtcgtctgactcggacgacgagaagaagaagaaggggtcctcgtcggcgtcggcggcggaggccgtgaaggccaagatgtaccgcctcttcggccgcgagaggcccgtccactccgtcctcggcggcggcaagcctgccgatctcgtcctatggaggaacaagaagatctcaggtggggtacttgctggtgccacggccatctggctcctgttcgaggttatggagtaccatctcctcaccttgctgtgccactctctcatcctctcgctagccatcctcttcctgtggtctaatgcctccacgttcatcaacaagtcgccaccaaacatccctgaggtgaaaatccctgaggatgtggctgttaatgttgcgctgcaactgagatatgagatcaacaggggcttcgctaccttgagggagattggacatggccgtgatctgaagaaattcctaattgttatcgcaggtctctggcttctttcagttcttgggagctgctgcaactttctgacactgttctatattgtctttgtggcactttacactataccagttctgtatgagaaatatgaggacaaggttgatgcttttggtgagaaggctatgattgaactgaagaagtattatgccattttcgatgagaagtgcctatcaaagattccaaagggcccccttaaggataagaagtactag

SEQ ID NO: 20775 - protein, 258 aa, Sorghum bicolor
  misc_feature: Ceres ANNOT ID no. 8668574
  misc_feature: Up-regulated in root tissues in response to salicylic acid treatment
  misc_feature: Up-regulated in shoot tissues in response to salicylic acid treatment
  misc_feature (73)..(256): Pfam ID: Reticulon Pfam Description: Reticulon
MADHKEEPVLESVMDKITEKFHGGDSTSSSDSDDEKKKKGSSSASAAEAVKAKMYRLFGRERPVHSVLGGGKPADLVLWRNKKISGGVLAGATAIWLLFEVMEYHLLTLLCHSLILSLAILFLWSNASTFINKSPPNIPEVKIPEDVAVNVALQLRYEINRGFATLREIGHGRDLKKFLIVIAGLWLLSVLGSCCNFLTLFYIVFVALYTIPVLYEKYEDKVDAFGEKAMIELKKYYAIFDEKCLSKIPKGPLKDKKY

SEQ ID NO: 20776 - DNA, 2247 bp, Sorghum bicolor
  misc_feature: Ceres ANNOT ID no. 8668593
  misc_feature: Up-regulated in root tissues in response to salicylic acid treatment
  misc_feature: Encodes the peptide sequence at SEQ ID NO 20777
atgggtgttggagatgaagaacaaatgaagaacaagcaagaagaagctccaagaacaacaatggtgctctcggtttcaaatgggcagaggggaggagggagtcggcctataaaccggaactttagcaccggttcagggcaaaaaccggtgctgaagggttaccctttagcaccggctatatacatatctgtacaaaatccaaaaatcagtcaaccttataaacaatcatccgaagaagaaaccacagaaagactcacctcctacgcggccgccactttcatcatcagcaacgccggcgtcgccgtcacccaccctctcgcggactgcggacagcagaaaccatcacatcaaaccggaaaccacccttccctccagaactcgagaccattctcccctttccccttctccacgcttcgcccctcgccgactattttaaacccacgcttgttcttccccgtcggattcttttgtacccccgcgggagatccacgcatccacagccgagcagtggagctcgatcgcgaggcttctagagagtcggggggagttcaggcttctccaatggcgtcgtcccacatcatcctgcccaaggaggaggaggaggaggagaaggaggcggcggcggtggcggaggccgggttgggcgtgggggtggaggcggaccacgactccccggcgcagcggccgtaccaggagcaggcgccagggaaggcggcgttgccgttctcggcaacgtgcgtccggatctcccgcgactcgtacccgaacctccgcgcgctgcggaacgcgtccaccatggcactccacgatgatgacgccgccttcgtcaaaatcgaggagggtgacttcggatacgtgctcgacgacgtcccgcacctcaccgactacctcccggacctccccacttttcctaatcctttgcaagatcatccggcgtattcaactgtcaagcaatattttgtcaatgcagatgatacagtccctgaaaaggtggttgttcagaagaacagtccgcgaggagttcacttccgtcgtgctggacctcgtcagagggtgtattttgagtcagaagaagtgaaagcttgcattgtaacctgtggaggcctttgccctgggctcaatactgtcatcagagagttggtgtgtggcttgtcccacatgtacaacgttagcaatgtctttggaatacagaatgggtacaaggggttctattcgagcaattatcttcccatgacaccaaagagtgtgaatgatatccacaaacgaggtggtacggttcttggaacatcacgaggtggccatgataccaaaaagatcgttgacaacattcaagatcgtggaattaatcaggtgtacattataggaggagatggaactcagaagggtgcatatgagatttacaaggaaattcggagacgtggtctacatgtagctgttgctggtattcccaagactattgataatgatatagcggttatagacaagtcatttggttttgatactgctgtagaagaagcccagcgtgccatcaatgcagctcatgtggaagcttcaagtgctgaaaatgggatagggttagtgaagcttatgggtcgctatagtgggtttattgccatgtatgctactcttgcaagcagagatgtggactgctgcttgattcctgagtcacccttttatttggaaggggagggtggactatttgagtatatagataggaggttgaaggagaacaaccacatggttattgttgtggcggagggagctggacaggatcttattgctcaaagtatacctgctgcagatcagcaagatgcatctggaaataagctgcttcttgatgttggtctctggttgactcacaagattaaggattattgcaagagcaagaagatggagatgactattaaatacatagatccaacctacatgatccgtgctattccaagcaatgcatcagacaatgtctattgcacactgctcgcacatagtgccattcatggtgcaatggcaggatacagctttacagtcggaatggttaatggcaggcatgcatatataccatttcatagggtgacatctacaaggaacaaggtgaggataactgacaggatgtgggcgaggctgctgtcttcaaccaaccagccgagtttcctgagccagaaggacatcgacgcggcaagagaagccgataaggcggccaatgcgaagaaccaatctgcaccagcgttggcaaatggtgagaaataa

SEQ ID NO: 20777 - protein, 748 aa, Sorghum bicolor
  misc_feature: Ceres ANNOT ID no. 8668593
  misc_feature: Up-regulated in root tissues in response to salicylic acid treatment
  misc_feature (363)..(624): SWISSPROT Homolog: EC 2.7.1.90 Diphosphate--fructose-6-phosphate 1-phosphotransferase
  misc_feature (360)..(613): Pfam ID: PFK Pfam Description: Phosphofructokinase
MGVGDEEQMKNKQEEAPRTTMVLSVSNGQRGGGSRPINRNFSTGSGQKPVLKGYPLAPAIYISVQNPKISQPYKQSSEEETTERLTSYAAATFIISNAGVAVTHPLADCGQQKPSHQTGNHPSLQNSRPFSPFPFSTLRPSPTILNPRLFFPVGFFCTPAGDPRIHSRAVELDREASRESGGVQASPMASSHIILPKEEEEEEKEAAAVAEAGLGVGVEADHDSPAQRPYQEQAPGKAALPFSATCVRISRDSYPNLRALRNASTMALHDDDAAFVKIEEGDFGYVLDDVPHLTDYLPDLPTFPNPLQDHPAYSTVKQYFVNADDTVPEKVVVQKNSPRGVHFRRAGPRQRVYFESEEVKACIVTCGGLCPGLNTVIRELVCGLSHMYNVSNVFGIQNGYKGFYSSNYLPMTPKSVNDIHKRGGTVLGTSRGGHDTKKIVDNIQDRGINQVYIIGGDGTQKGAYEIYKEIRRRGLHVAVAGIPKTIDNDIAVIDKSFGFDTAVEEAQRAINAAHVEASSAENGIGLVKLMGRYSGFIAMYATLASRDVDCCLIPESPFYLEGEGGLFEYIDRRLKENNHMVIVVAEGAGQDLIAQSIPAADQQDASGNKLLLDVGLWLTHKIKDYCKSKKMEMTIKYIDPTYMIRAIPSNASDNVYCTLLAHSAIHGAMAGYSFTVGMVNGRHAYIPFHRVTSTRNKVRITDRMWARLLSSTNQPSFLSQKDIDAAREADKAANAKNQSAPALANGEK

SEQ ID NO: 20778 - DNA, 2985 bp, Sorghum bicolor
  misc_feature: Ceres ANNOT ID no. 8668645
  misc_feature: Down-regulated in shoot tissues in response to salicylic acid treatment
  misc_feature: Encodes the peptide sequence at SEQ ID NO 20779
atggggaacgtggacggcgagcacgagttccatgcaggctgggggcgattcagctcttttatgctccaggtttggcgcttcacggaaaagcctcgtgctcttgatagatttaaatttgaatttgaggacccgaagtattgtgcatttctaacgatttttgcttctttgggcgataaaccaatcctagccaaccggagagctgaggtgatagattggcttggtgggttgctgcctgagttcgacttgcctttggattcttcagacgaggagctgcgggagtaccttattgatggcacggcactatgctacattgcagagaaactcatgcccggcattcaggaggaaatgtggggtggtaatgcatcggatcagaggtcgaatgtgaagaaattcctctattttgttgcggaaatgggtctgccaggcttcagtgtcaaggatctggaggaggggtcagtgtcttctgtggtggagtgtctcttggctctaaaagataatgtaactacaggattgggtcaaaatattacaaacaatgctgctaaaacaccccttagaaggaaactggaacttgaagaatctgatgggcctataatttcggttatgacaccggggaaaagatctggggaggaaagatggaaaggccactgggatcctaagtctcaacaaagaagcattcttcattctggacaaaaggtccatgatgctttccaacttaagcgaggctcctacactgatcttcctcctgccaaagtttcagagatgatgcatccaagaagtttagataatgcccctactcaatcacttcttagagttgttaatggcattctagatgagagcattgagaggaaaagaggagaaataccacaccgtgttgtttatttgcttaggaatgttgttcaagagattgagcaccgcattgctattcaagcggatcacataagaaatcaaaatagcatcatcaagactcgggaagacaagtaccgttcaaaaattaaagcactcgagacattagtaaatggcacaaatgaagaaaatgagatgacagtaaatcgacttgagctagttgaggtagaaaaatcaaaacttgatgagaaaagaaaactaggtgaacaagacatggttcgactgatgcaagaaaaagagaatgcagaaaatacaattgcttcccttcagcaagaaatacagatcttgagtaggatgcatgaacagtaccgtgaaagaaaggaaacagaagccaggcagatggaggaacacatggctatgagacttaaggatgctgagtttcttttaatgcaatcaaaaaagaaagttgaagaaattgaatcagcttcccaactgaaatctcaactttggagcaggaaggcaaacattttgcagagttttatggataatcaaaaattgtccattaaggacataaggatatcatctcagtccattaagcaagaaatgtttacgcttcaaatgaaatggagggatgaaatatctaacattggacatgatttgaatggcttggttgatgctgctgacaattaccacaaggttcttgctgaaaatcagaagctatttaatgaggtacaggaactaaaaggcaatatcagagtctattgtcgtgttagaccatttcttcctggtcaagatggaaaaacaaccgttattgattatattggtgaaaatggtgagattctcatcacaaatcccttcaagcaagggaaggatgtgtgtcgtatgttcaagttcaacaaagtgtttaacacacatgtttctcaagctgaagtattctctgatatccaacctctgatcagatcagttcttgatggatttaatgtgtgcatttttgcctatggtcaaactggttcaggaaagacatacacaatgagtgggccaggcacatcaaaagatgattggggtgttaactatcgagctttaaacgacttgtttgacatctctctaagtagaaggaatgctttctcgtatgaggtgggagtacaaatggttgagatttacaatgagcaagtgcgagatcttctttcaaatgatattgcacaaaaaagatatccttctttacatccagtcaaatcaacattggatgtgctagagttgatgcaaattggacaaacaaatagagcagttgggtcaacagctctaaatgaaaggagcagtcgatctcacagcattctaactgtgcatgttagaggggtagatctgaagaatggatctactactagaggatgtctacatctgattgatcttgctgggagtgaaagagttgagcgatctgaagcaattggagatagattaaaagaagcacaatatattaataaatctctctctgctctcggtgatgtgatttttgctttggcacagaaaaatgctcatgtcccttatcgaaatagcaagctgactcaagttctacaaagctctttaggtggacaagcaaagacattaatgtttgtacaaattaatccagatactgaatcatatttagaaacaataagcacattgaagtttgctgaaagggtttctggagtcgagttaggtgccgcaagaagcaataaagagggtaaagatataaaagagctgctagaacaggtttcatatctaaaagacacaatatcacggaaagatatggaaattgatcaactcctgaaagacaaagtcaaatctccaagttcattaacatatagaaatgacagcaaccaacagatccgacggcaatcgggggctggtggatcatgtgaagccgaatgtgaagataacatatctgatgatggttgctcagtagcaggaactgagtgttctgtaggtggtgcttcagagaaggccccatcaaggatagccaggttgttcctcactaagaatggccagcctgcaaaccccaagccaaaaccaagggagtctgctctgaaaccaccaggtcgcacgacatctacaggaagccaggcgacaggaggagcatcctcagtgaaacccccaaagaggcggtag

SEQ ID NO: 20779 - protein, 994 aa, Sorghum bicolor
  misc_feature: Ceres ANNOT ID no. 8668645
  misc_feature: Down-regulated in shoot tissues in response to salicylic acid treatment
  misc_feature (208)..(533): SWISSPROT Homolog: EC 2.7.11.1 Non-specific serine/threonine protein kinase
  misc_feature (537)..(844): Pfam ID: Kinesin Pfam Description: Kinesin motor domain
  misc_feature (64)..(168): Pfam ID: CH Pfam Description: Calponin homology (CH) domain
MGNVDGEHEFHAGWGRFSSFMLQVWRFTEKPRALDRFKFEFEDPKYCAFLTIFASLGDKPILANRRAEVIDWLGGLLPEFDLPLDSSDEELREYLIDGTALCYIAEKLMPGIQEEMWGGNASDQRSNVKKFLYFVAEMGLPGFSVKDLEEGSVSSVVECLLALKDNVTTGLGQNITNNAAKTPLRRKLELEESDGPIISVMTPGKRSGEERWKGHWDPKSQQRSILHSGQKVHDAFQLKRGSYTDLPPAKVSEMMHPRSLDNAPTQSLLRVVNGILDESIERKRGEIPHRVVYLLRNVVQEIEHRIAIQADHIRNQNSIIKTREDKYRSKIKALETLVNGTNEENEMTVNRLELVEVEKSKLDEKRKLGEQDMVRLMQEKENAENTIASLQQEIQILSRMHEQYRERKETEARQMEEHMAMRLKDAEFLLMQSKKKVEEIESASQLKSQLWSRKANILQSFMDNQKLSIKDIRISSQSIKQEMFTLQMKWRDEISNIGHDLNGLVDAADNYHKVLAENQKLFNEVQELKGNIRVYCRVRPFLPGQDGKTTVIDYIGENGEILITNPFKQGKDVCRMFKFNKVFNTHVSQAEVFSDIQPLIRSVLDGFNVCIFAYGQTGSGKTYTMSGPGTSKDDWGVNYRALNDLFDISLSRRNAFSYEVGVQMVEIYNEQVRDLLSNDIAQKRYPSLHPVKSTLDVLELMQIGQTNRAVGSTALNERSSRSHSILTVHVRGVDLKNGSTTRGCLHLIDLAGSERVERSEAIGDRLKEAQYINKSLSALGDVIFALAQKNAHVPYRNSKLTQVLQSSLGGQAKTLMFVQINPDTESYLETISTLKFAERVSGVELGAARSNKEGKDIKELLEQVSYLKDTISRKDMEIDQLLKDKVKSPSSLTYRNDSNQQIRRQSGAGGSCEAECEDNISDDGCSVAGTECSVGGASEKAPSRIARLFLTKNGQPANPKPKPRESALKPPGRTTSTGSQATGGASSVKPPKRR

SEQ ID NO: 20780 - DNA, 4098 bp, Sorghum bicolor
  misc_feature: Ceres ANNOT ID no. 8668653
  misc_feature: Down-regulated in shoot tissues in response to salicylic acid treatment
  misc_feature: Encodes the peptide sequence at SEQ ID NO 20781
atggaggaggccatgcggacaaccccggatgttgtgctaggaggctacaaggatattgaggctatggagggtcagaaggatagcggaacttgttacggtgaaggtggcaatgttacagtggcagatgagctcggtgggatttctgaagaccccaaccaaccagatgttgctaaggctgatgagccagaggagggtgctgatgtagtggggcaaactattgacactagtgctgctgtggatcttctcacagagggtgctgctgctgtgtcatcctccacactggtggatgatctcatggaggttggcatgcagaccaaagaggttagtgctgctgtggatgatctcatagaggtgggtgctgccctggtatcatctgcagaggatcgcaaagcggtggctgcttgcctggttaatgatgactgcaatatagttttcactggaggtgtgcataggtcggatgaccaaactgatcaggagtttggtggtgactcccttgacgctgatgtggtcgctcccttggtaaatgatgtacaagatgacagtgcaaggatgtatatgaatgttgcagctaatgatcatgtgcatgcccaggatcaggaaagcccacagttagatgtggctacaactctgttaaatgaggtggacacagagcttgtggaagctggaggccatgttgtacaggactgcacaaatatggatatgcagatccaaactggagatgacagtgaggcagaacgtgttggcgctattgctgacactgccacagatgaggagggcaagcacatgggtgaagttaccacaaccagagatgatagtgagaaacatgatggggcagtcggtgttgatgtgcctgatgagagaataaaaatgagtaggggtggactgtctggagatgataatgagcaaaaggaacttgcaacagctgatgaggatcgtgtggaagaggaaggcatgcaggtggatgcagtaaacattactggagacatggttgaggaaggcagaattgctgttgaatacattgcaggtgaagctgtaaatgacgagggtggtattgatgtccttgaagaaaaggctgctcagatagacaaggctggtaatgatatccctgaagaagacggtctccaaatgggggaagctggcttgattggcaatgataatgggctgaaagaggttgtgacagctgagcacgatggagtggaagaaaatgccatactgtcggaggcagctgccacaaataacgatgatgatgaagacaacaaaattgttggtgaagatgttgcagaagctgtcaatgacataactggtgatgatgtccctgaagaagaggctgcacatatggatgacgacgatgacgatgatgacgatgagcctcctcctttagtggcaaagaaaggtggagggcgtcgtaagagaggccgtccatcttccaaggtacaggctgtggtgaaaccatctgtaaagaggaaggatgaggaggaggtctgcttcatttgctttgatggcggtgatcttgtgatttgtgatcggtggcacatttgtagcaactgtcagaaacctgcccgccatatgtgctacacatgcaccttttcattatgcaaggcatgcatgaaagatgcaaagtttagctgtgtcagagaaaataagggcttttgtgatacgtgcatgaacactgtgatgttgatagagaatagagaggaggaggtggattttgatgacaaaagcagctggtggtatttgttcaaggactattggttacatttgaagacaaacttgtcattgacagttgaggaaatatcggcagccaagtctcaaaagagtggagaattacctgatactaatgacgaagaagttaattcagagagctcatcagggcgtcatctagaaaacaatacaccaaaaaagaggggaaggaagcgatctaaacaagctgccatcgaggaggattctgaaggaaaagaggctcatgcgagaaatggtgataaatctgtgatcagtcagtatgacgttcaaccccttttacttgactatatcaaacggaacaatctgcgtgatcctcgtcggaaaagccagataatttgtgattctttgctccaaagtctcttcgcaaaagaacgtgttgggcattttgagatgcttaagcttcttgaatcacattttcccactagtgaggtttcaccaattgatgctgatgaaaatcatggtggtgtagtagaccctgatcctagtcaggatgctgatggtaacagtgaagcttcagttgttatgagttcagaaaaaagaagaaaatcacgtaagtatgacctgagacgtcagcctaatcttgatgactatgcggcaatagataaccataacattggcttgatgtacttacgtcgcaacctaatggaagaattgattggtgatgtcgacacatttgatgagaaagttgttggatcatttgtgagaataagaatacctggtacagggcaaaggcaagacatttatagacttgtacaaattgttgggactggaaaatctgcagaaaaatataaatttgggaaaaggactactgatataacgctagagatattaaacttagacaagcgggaggcagtaactattgacataatctcaaaccaggagttcactgaggaggagtgcaaacgcttgcgtcaaagcataaagtatgggttcattccaagactgacagtgggagaggttcaggagaaggcaagggttctccaaactctaaaagtcaatgattggattgaaagcgaaaagatgcgacttgggcatcttcgtgaccgtgcaatattcacgcttagggaatgtgtagagaagctgaaattgctaagcactcctgaggagcgtgctcgtaggctgaatgaagaacctgaaatacatgctgaccctgcgatggatccatattatgaatctccggaggaacaggagcaggaaattgaaagaagtaaaggagatggtagaaatgctgtacagcgagatccaaaaactaactgggaatctaatcgaaacacatgggctgaatcgagttctcatatggaatcacccctttcacggaggtcgacattttcttctcaaggcgaaattgctggttatacaagtaaatcagagagcccgaacattggtgcacaaacagttaaactggaaggcaccacgcgcagtgctccacaagagtcacctggtgcctcatctggaattttagctactaacataggttcaggggcaaaagctgcatctgaatcagtcattaacgactctgagaagatctggctgtacatggatccttctaataaaatccaaggtcctttctcagtcatacagctgcggaaatggaacagcaatgggtacttccctcctagtttgaagatatggaaagctagtgagaagcaggatgattccattctattgactgatgctttggcagggaagtttgagaaagaccttcctccatgggaaccaccacatgttagtttgtctcaaattaacaaaacctctcttgagcaaagcacaatagctggtgaacaaactccaaaatcagtagttgcaaagtctttctcaagtagtgatcaaagacatgattatagttcaacaaaccttggaacaaccatggtccattcgggcacacaaggttattatgggatgcaaaattctcatgcagcaacagcatacacaagccaacaatctcttactggaagttggaatgctacgtcaagtcagtttggggttgcagtaaatcccgtggcacctacccagcctgccatgggaagctattcgggacaaaatattgttgctgcagaaaatatgggtcatttaactcctggaatggctcctgcaactgcaaatgcagatttgacctcccagaaccaaatattatcttctttaccgcaaacggatgacagattagctgatggctttcaatccaaatcaggagaagatgtttcacatggaagagtgagctcttcagctgaagctatcggacaactgggtgcacagcttggaccaacgcaactgaacactcagcaacttgaagtgataatcaaagcagtgggtgggctgtacctgcacaagtggcgaacacacctggccaatctcagataa

SEQ ID NO: 20781 - protein, 1365 aa, Sorghum bicolor
  misc_feature: Ceres ANNOT ID no. 8668653
  misc_feature: Down-regulated in shoot tissues in response to salicylic acid treatment
  misc_feature (783)..(890): Pfam ID: Plus-3 Pfam Description: Plus-3 domain
  misc_feature (650)..(720): Pfam ID: SWIB Pfam Description: SWIB/MDM2 domain
  misc_feature (1088)..(1143): Pfam ID: GYF Pfam Description: GYF domain
MEEAMRTTPDVVLGGYKDIEAMEGQKDSGTCYGEGGNVTVADELGGISEDPNQPDVAKADEPEEGADVVGQTIDTSAAVDLLTEGAAAVSSSTLVDDLMEVGMQTKEVSAAVDDLIEVGAALVSSAEDRKAVAACLVNDDCNIVFTGGVHRSDDQTDQEFGGDSLDADVVAPLVNDVQDDSARMYMNVAANDHVHAQDQESPQLDVATTLLNEVDTELVEAGGHVVQDCTNMDMQIQTGDDSEAERVGAIADTATDEEGKHMGEVTTTRDDSEKHDGAVGVDVPDERIKMSRGGLSGDDNEQKELATADEDRVEEEGMQVDAVNITGDMVEEGRIAVEYIAGEAVNDEGGIDVLEEKAAQIDKAGNDIPEEDGLQMGEAGLIGNDNGLKEVVTAEHDGVEENAILSEAAATNNDDDEDNKIVGEDVAEAVNDITGDDVPEEEAAHMDDDDDDDDDEPPPLVAKKGGGRRKRGRPSSKVQAVVKPSVKRKDEEEVCFICFDGGDLVICDRWHICSNCQKPARHMCYTCTFSLCKACMKDAKFSCVRENKGFCDTCMNTVMLIENREEEVDFDDKSSWWYLFKDYWLHLKTNLSLTVEEISAAKSQKSGELPDTNDEEVNSESSSGRHLENNTPKKRGRKRSKQAAIEEDSEGKEAHARNGDKSVISQYDVQPLLLDYIKRNNLRDPRRKSQIICDSLLQSLFAKERVGHFEMLKLLESHFPTSEVSPIDADENHGGVVDPDPSQDADGNSEASVVMSSEKRRKSRKYDLRRQPNLDDYAAIDNHNIGLMYLRRNLMEELIGDVDTFDEKVVGSFVRIRIPGTGQRQDIYRLVQIVGTGKSAEKYKFGKRTTDITLEILNLDKREAVTIDIISNQEFTEEECKRLRQSIKYGFIPRLTVGEVQEKARVLQTLKVNDWIESEKMRLGHLRDRAIFTLRECVEKLKLLSTPEERARRLNEEPEIHADPAMDPYYESPEEQEQEIERSKGDGRNAVQRDPKTNWESNRNTWAESSSHMESPLSRRSTFSSQGEIAGYTSKSESPNIGAQTVKLEGTTRSAPQESPGASSGILATNIGSGAKAASESVINDSEKIWLYMDPSNKIQGPFSVIQLRKWNSNGYFPPSLKIWKASEKQDDSILLTDALAGKFEKDLPPWEPPHVSLSQINKTSLEQSTIAGEQTPKSVVAKSFSSSDQRHDYSSTNLGTTMVHSGTQGYYGMQNSHAATAYTSQQSLTGSWNATSSQFGVAVNPVAPTQPAMGSYSGQNIVAAENMGHLTPGMAPATANADLTSQNQILSSLPQTDDRLADGFQSKSGEDVSHGRVSSSAEAIGQLGAQLGPTQLNTQQLEVIIKAVGGLYLHKWRTHLANLR

SEQ ID NO: 20782 - DNA, 1887 bp, Sorghum bicolor
  misc_feature: Ceres ANNOT ID no. 8668797
  misc_feature: Up-regulated in shoot tissues in response to salicylic acid treatment
  misc_feature: Up-regulated in root tissues in response to salicylic acid treatment
  misc_feature: Encodes the peptide sequence at SEQ ID NO 20783
atgcgaacgcagcaggcgtgggggcgcggggcggtggcgcgcttgatgacgccattcaatcgccgcgcggcccacgcctcttctccccacctgctccgcggctgctcgtcctcctcttataccgtcgccctctctcgcctccgacgccacttcacctcttcttcctcctcctctccagcatacagtaccagacagggtacccatacattcatggaggtggttcaagaagtccttaagcatggctcagtagatggtgtccgtgctgtcatacgagctgacaaaaagagctacagccttgtccagctcattgcagcctcttttgatgtccacaacattctgtgcagcaaaaatatgacacacaatggaatacaagattcttcttccgaaggaataaatggaacaggattccttcatggagctcgtgttggcattgtggctaaaccctctcctgaatttgttgctggggtctttggaacctggctttctggtggagttgcagtaccccttgcccttagttatccagaacctgagcttcttcatgtcatgaatgactcggatatttctatggttttaagcaccaaagagcatcatgaagtcatggagaacctttctatcaagcgttctgcttattgttctcttcttccacctatcactagtatatcttcagaaataaatccccaagaaccttcaagcaatgaggcgacttcatcagtctctactttaataactcatatcaacagttcaaagaaaatcaaaggtgatgaccctgctcttatcctttacacaagtggcacaactggtaaaccaaaaggagtagttcacacccacaagggcatactttctcaggttcaaattctatcagaagcgtggggatatcgaagtgaagaccaatttctgcactgtctcccgcttgtacatgtgcatggccttttcaatgctctatttgcgcccctttattcaggatcagtggttgagtttataccaaaattcagtgtaagcgggatatggcagagatggcgagaatcatatcccaacgatggtagtaaaaataaagaggctattacagtatttactggagttccaaccatgtatacacgtctgctgcaagggtatgatagtatggatcctgatcaacagtcggcctcttcttatgctgcaaagcatctgaggttaatgatgtgtggatcatcagctcttccgtccccacttatgaagaggtgggaggaagtgacaggccaccgtcttttggaacgctatggtatgactgagtttgtcatggcattgtctaatccattgcatggtatccgaaaagaaggtacagttggtaaaccccttccacgcgttgaggccaagattattatggaggatggaactgaaactacaactggagttggtgagctctgcattagaagtccatcccttttcaaggagtattggaaaagaccagaggtcacagcagaatccttcattgatggcggattcttcaagacaggtgatacagtaactgtagatgaggaaggatacttcataattttgggacgcacaaatgcagacattatgaaatttggtggttacaagctgtcagctttagaaattgaggcagtactgttagagcatgatgctgtactggaatgcgctgtccttggcttgcctgatgaagcctatggagaggttatatgtgcaataattgtgcctaaagaggatgcaaagaaaacggccgagcaggactcaaagccagtgctaaccttggaagcattgacaagttggtcgaaagataagcttgctccatacaagattccaacaaaactatacctgtgggattcgcttcctcggaatgccatgggaaaggttaacaagaaggagctgaagaaattattaggagcttag

SEQ ID NO: 20783 - protein, 628 aa, Sorghum bicolor
  misc_feature: Ceres ANNOT ID no. 8668797
  misc_feature: Up-regulated in shoot tissues in response to salicylic acid treatment
  misc_feature: Up-regulated in root tissues in response to salicylic acid treatment
  misc_feature (135)..(622): SWISSPROT Homolog: EC 6.2.1.3 Long-chain-fatty-acid--CoA ligase
  misc_feature (119)..(547): Pfam ID: AMP-binding Pfam Description: AMP-binding enzyme
MRTQQAWGRGAVARLMTPFNRRAAHASSPHLLRGCSSSSYTVALSRLRRHFTSSSSSSPAYSTRQGTHTFMEVVQEVLKHGSVDGVRAVIRADKKSYSLVQLIAASFDVHNILCSKNMTHNGIQDSSSEGINGTGFLHGARVGIVAKPSPEFVAGVFGTWLSGGVAVPLALSYPEPELLHVMNDSDISMVLSTKEHHEVMENLSIKRSAYCSLLPPITSISSEINPQEPSSNEATSSVSTLITHINSSKKIKGDDPALILYTSGTTGKPKGVVHTHKGILSQVQILSEAWGYRSEDQFLHCLPLVHVHGLFNALFAPLYSGSVVEFIPKFSVSGIWQRWRESYPNDGSKNKEAITVFTGVPTMYTRLLQGYDSMDPDQQSASSYAAKHLRLMMCGSSALPSPLMKRWEEVTGHRLLERYGMTEFVMALSNPLHGIRKEGTVGKPLPRVEAKIIMEDGTETTTGVGELCIRSPSLFKEYWKRPEVTAESFIDGGFFKTGDTVTVDEEGYFIILGRTNADIMKFGGYKLSALEIEAVLLEHDAVLECAVLGLPDEAYGEVICAIIVPKEDAKKTAEQDSKPVLTLEALTSWSKDKLAPYKIPTKLYLWDSLPRNAMGKVNKKELKKLLGA

SEQ ID NO: 20784 - DNA, 1506 bp, Sorghum bicolor
  misc_feature: Ceres ANNOT ID no. 8668856
  misc_feature: Down-regulated in root tissues in response to salicylic acid treatment
  misc_feature: Encodes the peptide sequence at SEQ ID NO 20785
atgatgcatccgctccgccgattcctcctcctcctcctcctcctcctcgtcggcctcctccccgcggccgtgtggtccctggcaccgccccgattcccgaggcaccagcaccgctcgcggccgggagttaatggggtgggggactacgagtacgagacgcgatacttccggcagcggttggaccacttcagctttcccggggtcgcggacgaggacgaggcggcggcgttcttccagcagcggtacctggtgggccgcggcggtgggtgggccggacccggcggccccatcttcttctactgcggcaacgagggcgacatcgcctggttcgcctccaactccggcctcgtctgggaggccgccccgcgcttcgccgccctcgtcgtcttcgccgagcatcgctactacggagagtccatgccgtttggtagcaaagctaaggcgtacaatgactccaagtccctagcgtatctcacggccgagcaggcgcttgctgacttcgctgtgctcctcactgacctcaagcggaacctatctgcagagggcagccccgtcgtgctctttgggggctcatatggtggaatgctagctgcttggatgagactcaagtatccccatatttctgttggagctctctcatcatcagcaccaatactgcagtttgaggacattgttccttctactattttctatgatctcgtatcggatgattttaggagggaaagtttaagctgctttcttacaataaaagactcctggaaagaattagatgaccaaggaaacgagcaaggtggtcttctgaaactaagcaaaacatttcacctttgccattatctggccatggtggattacccacttccatcagaatttctcatgcctttgccagccaatcctattaaagaagtatgcagaaatatcgacagtcaacctgagggtactagtactctggaacgcatatatgcaggagtaaatgtatactacaattatactggcacagttggctgctttgatctaaatgatgatccccatggaatgggtggatgggattggcaggcttgtaccgagatggtaatgccaatgtcttacagtgaaggcaggagcatgtatccaccatataaatttgactatccttcctatgctgatgggtgcatcaaaagctatggtgtcaggccaaggcctcggtggatcacaacagagtttggtgggcataatatcactacggtcctggaaaagtttggtagtaacatcatattcttcaatgggctccttgacccgtggagtggcggaggtgtcttgaagaacatatctgagagtgtcattgcaattgtggctccattaggagcacaccacatcgatctgcgccccgcaactccagacgacccagattggctggtggccctgagagaatcagagctgaagatcatctctggctggttatcggattactacggggcgggaggggcggtcttccagcctgtagctgccaagggctcctcttcatcctaa

SEQ ID NO: 20785 - protein, 501 aa, Sorghum bicolor
  misc_feature: Ceres ANNOT ID no. 8668856
  misc_feature: Down-regulated in root tissues in response to salicylic acid treatment
  misc_feature (58)..(471): Pfam ID: Peptidase_S28 Pfam Description: Serine carboxypeptidase S28
MMHPLRRFLLLLLLLLVGLLPAAVWSLAPPRFPRHQHRSRPGVNGVGDYEYETRYFRQRLDHFSFPGVADEDEAAAFFQQRYLVGRGGGWAGPGGPIFFYCGNEGDIAWFASNSGLVWEAAPRFAALVVFAEHRYYGESMPFGSKAKAYNDSKSLAYLTAEQALADFAVLLTDLKRNLSAEGSPVVLFGGSYGGMLAAWMRLKYPHISVGALSSSAPILQFEDIVPSTIFYDLVSDDFRRESLSCFLTIKDSWKELDDQGNEQGGLLKLSKTFHLCHYLAMVDYPLPSEFLMPLPANPIKEVCRNIDSQPEGTSTLERIYAGVNVYYNYTGTVGCFDLNDDPHGMGGWDWQACTEMVMPMSYSEGRSMYPPYKFDYPSYADGCIKSYGVRPRPRWITTEFGGHNITTVLEKFGSNIIFFNGLLDPWSGGGVLKNISESVIAIVAPLGAHHIDLRPATPDDPDWLVALRESELKIISGWLSDYYGAGGAVFQPVAAKGSSSS

SEQ ID NO: 20786 - DNA, 1560 bp, Sorghum bicolor
  misc_feature: Ceres ANNOT ID no. 8668875
  misc_feature: Up-regulated in root tissues in response to methyl jasmonate treatment
  misc_feature: Up-regulated in shoot tissues in response to methyl jasmonate treatment
  misc_feature: Down-regulated in shoot tissues in response to salicylic acid treatment
  misc_feature: Encodes the peptide sequence at SEQ ID NO 20787
atggacgcggcggcagccacccccgcccttcgaaggcggccgctctcggtgcacaaggagagcaatggcacggccgccaccggggcggctggggccagggtcgccgccaccggggcggctgaggagctcggggagcccgtggacgactccgcccggctcgtagaggacttctacatcgtcgtcgtcatcgggacctccacccccgtgaacctcgccgccgcacgcgccggcatcgaggcccagctcgcgcgctacccgcacttccgaagcatccaagtgaaggacgacgcgtccagtgaagaagacggccgccggcggtgggtgccgacgacggtgaacctggacgaccacatcatctacccgaagctggacgcggcggcggtggcgcgcgacccggacagggccgtggaggactacgtggcgacgctgtccacgctgcccatggactggtcccgcccgctctgggagttccacgtcctcgacttccccacctccgaggccgccgccaccacggcgatccgcgtgcaccactcgctcggcgacggcatgtcgctgctcacgctcctcatggcgtgcacccggagcgccgccgacccgaccaggctgcccgccatgccgccgctgcccacaaggcgcacgggcgcgatctgggagcggccgcggccgccggcgtccgcgggcgcactggcgttcgcggcgtgggtgtggtccttcgccgtgctggcctggcacaccgtggtcgacgtcgccgccttcttggccacgattctcttcctcagagacccgcacacgctcttcaagcgggtgaaccacggggagcaccagcgcaagcgcctcgttcaccgtggcctcagcctagacgacgtcaagttcgtcaagaatgtcatgaactgcacagtgaacgatgtgctggttggtgtcacttacgctgccttatcgcgatactacttccggaatacaggtgacgctgacgttaaaaaggagatccgtgtgcgatcaattctacttgtcaatttgaggccaacaaccagcctacaggcatgtgttaacatgatagagtccggcaaggaaagtgacgtcaaatgggggaatgaacttggcttcatcatccttccctttcacatcgccttgcacgatgatccgttacaatatgtccgcaaggcgaagaaggttgtggataggaaaaagagttcactggaagtggtgttcactcatctagctgcagaggttattctcaaaatctttggactcaaggcagctagagctaccttccatcgtatgatatctcagacaaccatatcgttctccggcatgattggtccagttgagcaggtggagttttgtggacacccagttgtcttcatcgcccctagtggctatgggcctccagaagccctaaccgtgaacttccaaagttatgttaacactatgatggtaaatctagcagtggatgaggcacaatttccagattctcatgagctgctggatgactttgttgaatccctcaggctaattagagctgcagcttcaagccttggaaagaatcaaagaaatgattaa

SEQ ID NO: 20787 - protein, 519 aa, Sorghum bicolor
  misc_feature: Ceres ANNOT ID no. 8668875
  misc_feature: Up-regulated in root tissues in response to methyl jasmonate treatment
  misc_feature: Up-regulated in shoot tissues in response to methyl jasmonate treatment
  misc_feature: Down-regulated in shoot tissues in response to salicylic acid treatment
MDAAAATPALRRRPLSVHKESNGTAATGAAGARVAATGAAEELGEPVDDSARLVEDFYIVVVIGTSTPVNLAAARAGIEAQLARYPHFRSIQVKDDASSEEDGRRRWVPTTVNLDDHIIYPKLDAAAVARDPDRAVEDYVATLSTLPMDWSRPLWEFHVLDFPTSEAAATTAIRVHHSLGDGMSLLTLLMACTRSAADPTRLPAMPPLPTRRTGAIWERPRPPASAGALAFAAWVWSFAVLAWHTVVDVAAFLATILFLRDPHTLFKRVNHGEHQRKRLVHRGLSLDDVKFVKNVMNCTVNDVLVGVTYAALSRYYFRNTGDADVKKEIRVRSILLVNLRPTTSLQACVNMIESGKESDVKWGNELGFIILPFHIALHDDPLQYVRKAKKVVDRKKSSLEVVFTHLAAEVILKIFGLKAARATFHRMISQTTISFSGMIGPVEQVEFCGHPVVFIAPSGYGPPEALTVNFQSYVNTMMVNLAVDEAQFPDSHELLDDFVESLRLIRAAASSLGKNQRND

SEQ ID NO: 20788 - DNA, 2433 bp, Sorghum bicolor
  misc_feature: Ceres ANNOT ID no. 8668868
  misc_feature: Up-regulated in shoot tissues in response to salicylic acid treatment
  misc_feature: Up-regulated in shoot tissues in response to aminocyclopropane carboxylic treatment
  misc_feature: Encodes the peptide sequence at SEQ ID NO 20789
atgctgggcgtcgagcccgagggcagaggcggcgcgtcctcctccgccgccgcagagaattttgacgctgggcagtatgccttcttcgggaaggagccactggaggggttcgagctcgggggcttggaggaagccggcggcagtgatgccaatggcggtggattcagtgggccagatgaggggctgtaccggctgaactctgttggagatgagattgatgatctgagtaacctgtctgacattgatgatcttgcaagcacctttgctaagttgaaccgaagcattagtggaacccggaatcctggtgttattggggacaggagatccatttcacgaggaagttctttaactgttgactgggctgaggatgtggagttttcaaactggggagatcaagacgtatttgaaaatgaggaattccacgaaagtaaaagatggtggtcatccaattcttcagttcagcaaggggattctaactccagaccactaagtcgaacatcttcctaccctcagcagccactgcagcaccggtcaagtgaacctatcgttttaccaaagacatcttcatttacctcattcccaccacctgttgctgctgctggtggtagatccccttaccctgctcaaggccttacacgtcatgggagcattccatcaattggtgctgggctccaaatgggttctccaggcatgtcactttctgcttctccataccatatggtcggaccatctcatgggctgccatacacaggaggaatgccttatggtgctcttaacctgcctgtaaacaatcctgtgcaaaatgattggtcgaaccatggtaaccctttcactggggaacatcttaatctactgcccaacttattgcacaaacaattatcacttcctaatagcccaatgccatcactcctgttttctcagcatcagcagagattggcacaggtccaatcaccccatcagaattacctcaatataactccacacctgctatatccccatcactctgcagagattacaggcaggtttgattctgttggcagttctcattcatcaagagacaagagatcaaggtcggggaggggaaagcatagccttcgcttctctcaaccaccatctgatactggtagccagaatggtgacagcggaggtataaagtttagatccaagtacatgtcatctgaagagattgaatcaatcttaaggatgcagcattctgcaagtcacagcagtgatccttatgttgttgattactaccatcaagcttgtatggcaaaaagaggcgccacttctaagcaaaagaccaatttctccccaacatcaatgaaagatataccatccaagtctcgatccagcagtgatcagcacacatatcttcaggttgatgctcttggaagagtatctttctcttccatacgtaggcctcggtctcttcttgaggttgaccatccttcatctgctgatggctcccatgatcagaagtctactgtgaggcccctggagaaagaaccaatgcttgcagcaagagtcactgttgaagatgccctttgccttcttcttgaggttgatgacactgaccgtctgttgcagtctagccagtcacaggacaacattttccaactgaagcggagacggcaagtcctcctggaaggtctagcagcatcactgcagtttgttgatcctctcggacccagcaaatctggtcattcatctgggttagccctgaaggacgatgttgtttttcttcgcattgtttctctgcccaaaggacgtaagtttttagcacgttaccttcggcttcttgtccctggcagcgagttgacccggatagtatgcatggcaatttttcgccatttgaggttcttgtttgggggtttgccatcagactctagtgcagcagaaactacagttgctcttgcaaagactctttcatcttgtgtgcatcacatggaacttggtgctcttagtgcctgccttgctgctgttgtctgttcatctgaacagccacccctgcgccctcttggtagttctgctggtgatggggcttctctagttattaaatcagtactggatcgagcaactgagttactgactgatcgccatgctgcagccagctacactgtgccaaaccgtgctctctggcaggcatcgtttgatgctttctttggtcttctaacaaaatactgtgtcagtaagtttgaaagtattcagcagatgtttgtcatgcaggcaccaagctcaggaattggacctgaggcttccaaagctactagtaaggagatgcctgttgagctacttcgtgcaagccttcctcatacaaacgagcagcaacgccagcggcttcttgattttgctcagagatccatgccagtaacaggtttcaatccctcaggtgctagaggtgggcacatcacttcagaatctgttcctggttga

SEQ ID NO: 20789 - protein, 810 aa, Sorghum bicolor
  misc_feature: Ceres ANNOT ID no. 8668868
  misc_feature: Up-regulated in shoot tissues in response to salicylic acid treatment
  misc_feature: Up-regulated in shoot tissues in response to aminocyclopropane carboxylic treatment
MLGVEPEGRGGASSSAAAENFDAGQYAFFGKEPLEGFELGGLEEAGGSDANGGGFSGPDEGLYRLNSVGDEIDDLSNLSDIDDLASTFAKLNRSISGTRNPGVIGDRRSISRGSSLTVDWAEDVEFSNWGDQDVFENEEFHESKRWWSSNSSVQQGDSNSRPLSRTSSYPQQPLQHRSSEPIVLPKTSSFTSFPPPVAAAGGRSPYPAQGLTRHGSIPSIGAGLQMGSPGMSLSASPYHMVGPSHGLPYTGGMPYGALNLPVNNPVQNDWSNHGNPFTGEHLNLLPNLLHKQLSLPNSPMPSLLFSQHQQRLAQVQSPHQNYLNITPHLLYPHHSAEITGRFDSVGSSHSSRDKRSRSGRGKHSLRFSQPPSDTGSQNGDSGGIKFRSKYMSSEEIESILRMQHSASHSSDPYVVDYYHQACMAKRGATSKQKTNFSPTSMKDIPSKSRSSSDQHTYLQVDALGRVSFSSIRRPRSLLEVDHPSSADGSHDQKSTVRPLEKEPMLAARVTVEDALCLLLEVDDTDRLLQSSQSQDNIFQLKRRRQVLLEGLAASLQFVDPLGPSKSGHSSGLALKDDVVFLRIVSLPKGRKFLARYLRLLVPGSELTRIVCMAIFRHLRFLFGGLPSDSSAAETTVALAKTLSSCVHHMELGALSACLAAVVCSSEQPPLRPLGSSAGDGASLVIKSVLDRATELLTDRHAAASYTVPNRALWQASFDAFFGLLTKYCVSKFESIQQMFVMQAPSSGIGPEASKATSKEMPVELLRASLPHTNEQQRQRLLDFAQRSMPVTGFNPSGARGGHITSESVPG

SEQ ID NO: 20790 - DNA, 2610 bp, Sorghum bicolor
  misc_feature: Ceres ANNOT ID no. 8668934
  misc_feature: Down-regulated in shoot tissues in response to aminocyclopropane carboxylic treatment
  misc_feature: Up-regulated in shoot tissues in response to salicylic acid treatment
  misc_feature: Up-regulated in root tissues in response to salicylic acid treatment
  misc_feature: Encodes the peptide sequence at SEQ ID NO 20791
atgagccccctctctgagctggtgtggtctccggatgagggattgagcatcaaaattgcggcgtccagtctaagcacaaggaaggcttctcttcgttggaatgcagatacgttgagcatattaatatcttcacctcaacacagtggttctggtccgggtgtaaagagtggtgataccatatatgataacctagaggtgtcagaaaagatgccatcacaactacgaattcgtagtgatagctcagtgagagtaacgatggatagccccaacagagttacaaatgttgatgccctacaatctacgtctataagatcgcaggagcaagattcaaagtgctgtgaagggatcaatgtcatgaacgaaggggaagaagagttggaaaactgttgcctggataagctggaggacatggaagcgaggaattgtcccacaagatattgcaaggatgcttcccatagttcagcctccagaaaagaagtcatgcctagtatttcagaaaaccaggtttgctgtgcaaccactgtccgcaatgaaagatcttgggcaactaatgcatggcgtgctcggttagtaaaagcagtttgtcagaaagaacctatgttgtcaatgaacacagagaatccaatgttaccttcttccttaggaatttcatgtgatgcagtagaggtctcaggcaaattggtaggttcccaaggcaatagaaatgttcaaagcctgggcagtgacaacaatgtaattagtaatgcaccagaaattccttctcataacaattgccaagatccggttctgcaggaaagccataaggatgagcctgttgttgcgagaggtgagtcagcatctggtgttaatgctgttgcaagatgcgagtcagtgcctggagttaattccagaaaacttgtgaaagacaaagaaaaagttctgtacaatgacagcaattatggtaacaatacaatggagggtgatgacagcaatgagagcatcgagagctgtacaagtacaaaagccccaaagcggaagcatgcacagttttgtgcagctacaatgccttcttctggaaacaaaagatttagaagagaagacaatgaaagttcttgctcaggattattgcaaaaatgtggtacatctttcttcaactggatgtcatcacttacgaatgggttacccatgcttgatggagccactgctgccattccacttgatcagaagttttcagcaagtacaggagagggatctgcagcaccttcccagccacttcaaaacaacagcagcgttcctatgcaatctgttggcttcaattcgctcttccagtccctgtatactcataatgttatgataacttcaagagataattgtcatcaaccagagagcaactatgctgggcatgtgttcaatagactgactctggaattaaatgacagcaattctatgttggacaaacaaattggcatgggtagagaaactcttgacagtggctgtaaaaaaaatcagtgcacagctgcctgctcaaatgatgcaacacaaaataaaggtggtttgagggaaagcttgtgggtaactcggcttttgccaaaagcatccgtggaattgatggaggcaacaccatgcaatgtagaaaatgctgttaatccacaggctgtgggtgacaagttgtgttgtccacctcttcagaattttaacttggagagaggaagcagcgatggtgtaacaagtagtaaatgtccagcaacgcctccagaggaacctaagcaatctgaaacaatggcttctgtttttgcaaagagattggatgcacttagacatgcaaacacatctgcagtaaggctggctatcgcatgtgaccgtggaagtcccaaactgagaaaccacaaaactaactcttttgttgttagttacagcagccatgataaagtagaggcaggacacgaaaatcataaatcatctagcagaaacggaagaatagttttgtggttaggtgacaaaggcaaggaacagttgtgtctaagcaacaaagaatcaagaggaaactttatatctgagcatgagcatcagcatcatggagggaacacagctggaaaatctgcaactcggcctaatttagaactgaacacattggctgaagatactgacagaagccaagtaaaattaaagggaggagtctcagattttatggcgggtccgtcagataacaagcaaatcgtaccttatggcactatgcctaatgatgtctgtgatgaatcaagtgttgtttttggtgccttacataggcttcgtctgtctcgctcagatatcataagatggctgagatcaccgatcatgcacactacgttagatggcttttttgtccgattgcgatttggtaaatgggaggaagcattgggtggcacaggataccatgttgcccgcctgaatggagcactggataggagtcgcctttctgtaaccatcagaaattcaacctgtcaagtagattctcgctttgtatccaaccatgacttccatgaggatgagctgaaggcatggtggtctgctgcaatgaagagtgagtggaagctaccgtcaaaggaagaactgagtgtgaagctaagagaaagagagctacttcgttcgtag

SEQ ID NO: 20791 - protein, 869 aa, Sorghum bicolor
  misc_feature: Ceres ANNOT ID no. 8668934
  misc_feature: Down-regulated in shoot tissues in response to aminocyclopropane carboxylic treatment
  misc_feature: Up-regulated in shoot tissues in response to salicylic acid treatment
  misc_feature: Up-regulated in root tissues in response to salicylic acid treatment
  misc_feature (751)..(847): Pfam ID: Plus-3 Pfam Description: Plus-3 domain
MSPLSELVWSPDEGLSIKIAASSLSTRKASLRWNADTLSILISSPQHSGSGPGVKSGDTIYDNLEVSEKMPSQLRIRSDSSVRVTMDSPNRVTNVDALQSTSIRSQEQDSKCCEGINVMNEGEEELENCCLDKLEDMEARNCPTRYCKDASHSSASRKEVMPSISENQVCCATTVRNERSWATNAWRARLVKAVCQKEPMLSMNTENPMLPSSLGISCDAVEVSGKLVGSQGNRNVQSLGSDNNVISNAPEIPSHNNCQDPVLQESHKDEPVVARGESASGVNAVARCESVPGVNSRKLVKDKEKVLYNDSNYGNNTMEGDDSNESIESCTSTKAPKRKHAQFCAATMPSSGNKRFRREDNESSCSGLLQKCGTSFFNWMSSLTNGLPMLDGATAAIPLDQKFSASTGEGSAAPSQPLQNNSSVPMQSVGFNSLFQSLYTHNVMITSRDNCHQPESNYAGHVFNRLTLELNDSNSMLDKQIGMGRETLDSGCKKNQCTAACSNDATQNKGGLRESLWVTRLLPKASVELMEATPCNVENAVNPQAVGDKLCCPPLQNFNLERGSSDGVTSSKCPATPPEEPKQSETMASVFAKRLDALRHANTSAVRLAIACDRGSPKLRNHKTNSFVVSYSSHDKVEAGHENHKSSSRNGRIVLWLGDKGKEQLCLSNKESRGNFISEHEHQHHGGNTAGKSATRPNLELNTLAEDTDRSQVKLKGGVSDFMAGPSDNKQIVPYGTMPNDVCDESSVVFGALHRLRLSRSDIIRWLRSPIMHTTLDGFFVRLRFGKWEEALGGTGYHVARLNGALDRSRLSVTIRNSTCQVDSRFVSNHDFHEDELKAWWSAAMKSEWKLPSKEELSVKLRERELLRS

SEQ ID NO: 20792 - DNA, 1950 bp, Sorghum bicolor
  misc_feature: Ceres ANNOT ID no. 8668956
  misc_feature: Down-regulated in shoot tissues in response to salicylic acid treatment
  misc_feature: Encodes the peptide sequence at SEQ ID NO 20793
atgcatcactttggtcaaaggcaggcagcaaagaaaggcgaccagaacagggagaggccatgccaaagacgaagaaaaggagtccaccctataaagtggcggaaacgaagccgaatggagggagagaagggaggcgccgggcgcgtacacagcagcagcagcccacacgtaatcctttccctccctttcacacttacccctctcagctcccagctccttcacaaatccgggcctcgaggagggtcttatatacgctgcgccgtggaattagcgtctcttccgaggggctcgccgcgaaaacgatcccgccccaaattttgctacggccacacgagcagcagccgccgcgccaagacgcgcgctcgctcctgctccccgcgtctgcctgggtgtcggggaccggccgccccgctgcggctggctgccccgatgaggccgccggaggtggcggtcgtcgcggtggcggcgctgcttctcgtggcggctgcggccgcggcggagtcggcagcgccgttaccggcggcgctacggctggagcgtgcggtgccgcacaagggggtggcgctggaggaactcaagcggcgggacgccgcgcggcaccgggtttcgaggaggaggctgctcgggggcgtggccggcgtggtagacttccccgtcgagggctccgccaacccgtacatggtcgggctttattttacccgggtgaaattaggaaacccggcgaaggagttcttcgtccagattgacactgggagcgatatactgtgggtaacttgcagtccttgcactggctgcccaacatcaagtggactcaatatccagctagagtctttcagccctgactcttcatcaacatcatccagaataacatgctctgatgatagatgtacagctgctctccaaacaggggaagcagtctgccaaacctcagattcttcaagcagcccttgtgggtacactttcacctatggtgatgggagtggcacatcagggtactatgtgtctgacacgatgttcttcgaaactgtcatgggaaatgagcagactgccaattcgtctgcttctattgttttcggatgtagcaactcacagtcaggagacctgacaaaggcagatagggcagttgatggaatttttgggttcggacagcatcaactgtctgtagtttcacaactgaactctcttggggtgtcccctaaggtgttctctcattgcctgaaaggttcagataatggtggtggcattcttgtgcttggtgaaattgtggagccaggattagtgtatactccacttgttccatcacagcctcattacaacttgaatctggaaagcattgctgtcaatggtcaaaagctgtccattgattcttccttgtttacaacgtcaaatacacaaggaacaatcgtggattcaggaacaacattggcataccttgcagatggagcctacgatccatttgttagtgcgatagctgctgcagtctcgccatctgtacgttctctagtcagcaaaggaagccagtgctttatcacttccagcagtgttgactcatcatttccaaccgtaaccctttattttatgggtggtgttgcgatgacggtgaagccagagaactatcttttgcagcaggcttctgttgacaacaatgttttgtggtgcattggttggcaaaggaaccagggccaagaaataactatactcggagatcttgttttaaaggataagatattcgtgtatgacttggcgaacatgcgcatgggctgggcggactacgattgttcaatgtcggtgaatgtcaccacatcatcagggaagaaccagtacgtgaacactgggcagttcgacgtgaatggctcggcacggcgtgcatcatacaagagcttgataccagctggggtcgtcaccatgcttgtgcatatgctcattttgggcagcggctcacgtagatag

SEQ ID NO: 20793 - protein, 649 aa, Sorghum bicolor
  misc_feature: Ceres ANNOT ID no. 8668956
  misc_feature: Down-regulated in shoot tissues in response to salicylic acid treatment
  misc_feature (344)..(596): SWISSPROT Homolog: EC 3.4.23.12 Nepenthesin
  misc_feature (226)..(262): SWISSPROT Homolog: EC 3.4.23.25 Saccharopepsin
  misc_feature (230)..(591): Pfam ID: Asp Pfam Description: Eukaryotic aspartyl protease
MHHFGQRQAAKKGDQNRERPCQRRRKGVHPIKWRKRSRMEGEKGGAGRVHSSSSPHVILSLPFTLTPLSSQLLHKSGPRGGSYIRCAVELASLPRGSPRKRSRPKFCYGHTSSSRRAKTRARSCSPRLPGCRGPAAPLRLAAPMRPPEVAVVAVAALLLVAAAAAAESAAPLPAALRLERAVPHKGVALEELKRRDAARHRVSRRRLLGGVAGVVDFPVEGSANPYMVGLYFTRVKLGNPAKEFFVQIDTGSDILWVTCSPCTGCPTSSGLNIQLESFSPDSSSTSSRITCSDDRCTAALQTGEAVCQTSDSSSSPCGYTFTYGDGSGTSGYYVSDTMFFETVMGNEQTANSSASIVFGCSNSQSGDLTKADRAVDGIFGFGQHQLSVVSQLNSLGVSPKVFSHCLKGSDNGGGILVLGEIVEPGLVYTPLVPSQPHYNLNLESIAVNGQKLSIDSSLFTTSNTQGTIVDSGTTLAYLADGAYDPFVSAIAAAVSPSVRSLVSKGSQCFITSSSVDSSFPTVTLYFMGGVAMTVKPENYLLQQASVDNNVLWCIGWQRNQGQEITILGDLVLKDKIFVYDLANMRMGWADYDCSMSVNVTTSSGKNQYVNTGQFDVNGSARRASYKSLIPAGVVTMLVHMLILGSGSRR

SEQ ID NO: 20794 - DNA, 3399 bp, Sorghum bicolor
  misc_feature: Ceres ANNOT ID no. 8668966
  misc_feature: Up-regulated in shoot tissues in response to salicylic acid treatment
  misc_feature: Encodes the peptide sequence at SEQ ID NO 20795
atggccactatggttgaagggtgtgttggtcccagtgagcttcacctgaagaaggaacttattgccttgagaaaggcacgttttttgcgtgatcctgaaacatgctcatcctggaggtctccgttaagctctaaatcattcttgacaacttctggtgttataaatcacaatgagataggcagtagtttgtcagaaaagcacacagagccagctgcagcaccgccaaaaagtgaaaagaaaagaaaaaacgtttatctctacaactggagacatcattctaacaaatccagtgaaagtggagtgaagttagatgcggacgacagacaagcctcagcagactgtagtctggaaagcccatgtatttctaatggtatggactctaggagtgacacatgtctggaagttcctgtcagcatatacagtgttcaaggttcaaattcatgcactcctgttaaaagaactgttagaagggtgaggagaagttcattctcaaagaaaggagctatgagaaattcgactgtttcaaagttgctagatctccatgtgaactctggtgagcagtctgaggatactgagaactacaactcagagactcatgagcagcttcagaaagtagggtatttttctcgctctacatcaccactgtttgctgcatcagggtgttttagctcaacaaatccttctaagctgttgagggtgccaagaagagaaggatcttccttctcctgtactccggtctccactagctcctattacaggtacaaagggaggaatcctagtactgtaggctcatgggatggaacaactgctgcttcacttgatgatgatgggctgaaccaaccagaactgttgacaaatcagaggtgtggcattccttgttattggtcaaagaggagtaaacacaagggatctgaaaggagttgttctccttcactttctgatacacttagaagaaaaggcagcagtcttttgtgtgggagtcagacaatacatgggagaaagaaatcatcgggctccaataaatatggatattttaaaaaatcttcccaaggtgtaccgctgttgggtgatagtagtcattttgcttattcatcatttgattcagctagtgatgaagtatcgaccatctttggagaattagatctggaagctttgagccgtttggatggcagaaggtggtcaagctgtaaaagccaggatgggattgcactctctgtgagtggagctgatcatgtagtttcagatcacagaagtttgagccaaaaatatcgaccaaggtcatttctcgaaattgtgggtcaaaactttgttgtacagtcacttagtaatgcaatcgcaagggaaagaatagctccggcatatctgttccatgggcctcgtgggacaggaaaaacatcttctgcaagaatactttcagcagctttaagttgtactgctactggagagaccaagccctgtggagtttgtaccgagtgtagtgactttttcactggaaatggaattaatctgattgaggttgatgctaccaacagaaaaggtataaacagagtaaggcatttgattgaaaatataccagcatctgcaacttcttcacggtacaaagtatttgtcgttgatgaatgccatatggtatcttctaaagtctggtcggcatttatgaagtttcttgatgaaccattacctcgtgttgtcttcatatttataacaatagaccctgaaaaccttccccgttctgttgtatcacgttgtcaaaagtacatgttctccaagatcaaagacattgacatagtatgccggctgaggaaaattgctatgaaggaaaacctcgatgttgaattggctgctctagatttaatagcgctaaattcagatggatcgttgagagatgcagagacaatgctagatcagttgtgtttactagggaagaagataacaccatcacttgtaaatgatctggttggggttgtgtctgaggagaaactccttgacctattggagatagccatgtcatcagacactgccgaaacagtcaaaaggtcgagagagctgatggattctggtgttgatccaatggcattaatgtcacaattagctgggctcataatggacatcattgctgggacctatagattggcggaccctacttgcgtaactgatgctgaattggaaagattacaacaagcgttgaggattctttctgatgctgaaaaacaaataagactttcaagcgagcgttctacatggttcactgctgctttactccagcttggttctggtcataattcagaaataactcaatcaagaagcagcagtaagcaaagtgctaaagcaactagtgaaaccatgatggaagcagtgagagaatcctctgcgagcaggactacatctcatcatttatccacttttcctgattcaaagaaaatagtggatctgaaaacaaccagtgggcactctagtcctcagggccttgcttcattgtcctccaggatgagacccaatgaaaacatgatttatgccgagtgtaggtctgttgatagagcattattggaatctgctcaaacaggtatttcttctgagcaaaaggctatgaactgtggaatctcagataaccttacccgaatttggaggaagtgcatagagaactgccactccaagacgttgcggcagcttctctatgatcatgggaaactagcatctgtcaaagaatgtgaaggtaccattgttgcttttatagcatttgaagacaacgatataaagtttcgagcccaaagatttattagcagcatcagaaattcaatggaaactgtactgaagtgcaatgtggaagtcaggatttgtttaatgcaagaatttcttgctggaggactaaagcatgagacatacccggatgagacagctgaatctgatgtcttgagttgttcaacgaacagtgagcgtcgaaagggtagtctcaatctatcaggtgctggtgcggtgcagtcaagcaatgttcccatgatcatctctgatgaaaattcaggaatgcatagaacaagagggcaggatgtttctgttgaacagttgaagctatcagctcttgatgaacaaaggttagagagtgcatggctccaggctgctgaaaaacccactcctggtatgttaagtcaagctagacctgagagaaatcaaattcttccacaaaatggtggtcagcatcacgggaggtcctcaatggccaccattgttccctcaaagcatgtcgacaaggatctgtctaatgaactgaaagccttaaagatcagtgacagtcatggtccccataaaggtcaaaatgtacagatggagaatggttatgccatttcaccaagccttttgcatagaaataaccatttggcaaattgtgacaatgagagcgtgtaa

SEQ ID NO: 20795 - protein, 1132 aa, Sorghum bicolor
  misc_feature: Ceres ANNOT ID no. 8668966
  misc_feature: Up-regulated in shoot tissues in response to salicylic acid treatment
  misc_feature (416)..(739): SWISSPROT Homolog: EC 2.7.7.7 DNA-directed DNA polymerase
  misc_feature (453)..(643): Pfam ID: AAA Pfam Description: ATPase family associated with various cellular activities (AAA)
MATMVEGCVGPSELHLKKELIALRKARFLRDPETCSSWRSPLSSKSFLTTSGVINHNEIGSSLSEKHTEPAAAPPKSEKKRKNVYLYNWRHHSNKSSESGVKLDADDRQASADCSLESPCISNGMDSRSDTCLEVPVSIYSVQGSNSCTPVKRTVRRVRRSSFSKKGAMRNSTVSKLLDLHVNSGEQSEDTENYNSETHEQLQKVGYFSRSTSPLFAASGCFSSTNPSKLLRVPRREGSSFSCTPVSTSSYYRYKGRNPSTVGSWDGTTAASLDDDGLNQPELLTNQRCGIPCYWSKRSKHKGSERSCSPSLSDTLRRKGSSLLCGSQTIHGRKKSSGSNKYGYFKKSSQGVPLLGDSSHFAYSSFDSASDEVSTIFGELDLEALSRLDGRRWSSCKSQDGIALSVSGADHVVSDHRSLSQKYRPRSFLEIVGQNFVVQSLSNAIARERIAPAYLFHGPRGTGKTSSARILSAALSCTATGETKPCGVCTECSDFFTGNGINLIEVDATNRKGINRVRHLIENIPASATSSRYKVFVVDECHMVSSKVWSAFMKFLDEPLPRVVFIFITIDPENLPRSVVSRCQKYMFSKIKDIDIVCRLRKIAMKENLDVELAALDLIALNSDGSLRDAETMLDQLCLLGKKITPSLVNDLVGVVSEEKLLDLLEIAMSSDTAETVKRSRELMDSGVDPMALMSQLAGLIMDIIAGTYRLADPTCVTDAELERLQQALRILSDAEKQIRLSSERSTWFTAALLQLGSGHNSEITQSRSSSKQSAKATSETMMEAVRESSASRTTSHHLSTFPDSKKIVDLKTTSGHSSPQGLASLSSRMRPNENMIYAECRSVDRALLESAQTGISSEQKAMNCGISDNLTRIWRKCIENCHSKTLRQLLYDHGKLASVKECEGTIVAFIAFEDNDIKFRAQRFISSIRNSMETVLKCNVEVRICLMQEFLAGGLKHETYPDETAESDVLSCSTNSERRKGSLNLSGAGAVQSSNVPMIISDENSGMHRTRGQDVSVEQLKLSALDEQRLESAWLQAAEKPTPGMLSQARPERNQILPQNGGQHHGRSSMATIVPSKHVDKDLSNELKALKISDSHGPHKGQNVQMENGYAISPSLLHRNNHLANCDNESV

SEQ ID NO: 20796 - DNA, 2721 bp, Sorghum bicolor
  misc_feature: Ceres ANNOT ID no. 8668936
  misc_feature: Up-regulated in shoot tissues in response to methyl jasmonate treatment
  misc_feature: Up-regulated in root tissues in response to methyl jasmonate treatment
  misc_feature: Up-regulated in shoot tissues in response to salicylic acid treatment
  misc_feature: Encodes the peptide sequence at SEQ ID NO 20797
atgggtacaaggatgccaatcttaccccgactatcgagcacactgtccacggcgttgcttgagtggatcttgatgctcctgctgttcatcgacgcggtttacagcttcttggtcactagattcgcccgtctctgcagattaccagcgccatgccctttctgctcaaggcttgatcacgtcctgggcaacgagaaaccatgtttctatagagagttgatctgcaaaactcacaagacggagatttcatccttggccttctgcagtctccaccagaagctcgcgggagcccaaaatatgtgtgaagggtgctgtgggaaagtcacccatgatgataaaacagatgagactgtgatggatgccaatgtactttatagcaaacaaagaattgatgatgctttgaattcccctcgtgaaaaagtttgctcgtgctgtgggcagcattttaagcaacggactgtagctttgtcctctagaaagactgcagagctagagcctactggagcattcggctcaccagaaatttacacagagtattctgtagtatgtcaagtggacgagcctttggagcctaaagatatataccaccaaactgactacaggtctaatgagcgagatgatctgctacagatgacatctgactctgagattgaggtcccttgtgccaatgatgtgaaaagttcacaatctcgtgaagccagtgttgtggacgaagacttacaagaagatgcagcttgtgagcaacccgttcttccttcccctgtggtgatcaaggaatctgaaataattgtcaagaaggagcccagtgttgaagacacctgcaatacatctttggcgtgtcctgctgtggatgatcatccaaatagcggaggtgatgtggaccggacggaagaaaaagaaagcctatccagaaaattggcatcccggcatgatcctgtacttgttatagaaaattcaggtttagaagatgctggtatttcacaaattccagttatgccaagtgatgagctaccacaggttcctggtgagattgaaccatctcagagcacaagtgaaggcaacgctgatccatatacatctcagttcacaatactagaggagcactatgctgtttcagaagaaggaaatataaaaggtattctggaacaagttgatgtgccagaaattactggcagatcaagtggtgagtttcatcagagaattgcgtcagcagctgatccacatacaaatgaactggtgctagagaacgctcatcatggtgcttcagaagacgcaaatcagaaagataattgcggggatatccatgtttcacaagttagtgctggttccaaaacatgtggtgaagttaataaaattgaacccactggtgacatgggggcacacaaactgatagtccaagatccttctggtagtgctcccaaagatttaatagataaagattatgtggacgaacctcatatatcagcaactaccgtaagatcaagtggtgaaatacctcaagatcatagtgccaccgaggaatacccaaaaacaagtgacagtgttgttgaaaggagaccatctctaagcactcagattagcatgaatgaagcctatagacttgccattggcaacaagggtagcttgccatcccctaccttgacggatgtaatccttggaaaggactctacttctagcataaacgaagaactgagactactgctatcacagctctcagcttccagggggcttgaggcaccatgggtcgatccaggccctagcccacgtgcatatggacgtggtgatgagttggtggtgcagaacattaccaatagaatttcacttgagaggaatgcttccggtttggagtctctagacggaagcattgtcagtgagatggaaggtgaaagcaccattgaccggttaagacgacagattgatcttgaccggaaatcaatacacctactctgcagagaactggaagaagagaggaacgcctcagccattgctgcaagtcaagctctggctatgatcaccaagttgcaggatgagaaggctgcaatgcagatggaagcttcgcattaccaaaggatgatggaagagcaagctgaatatgacagtgaagcgctagcgaaaactaacgagttactcgctgaaagagaacaacaaatagaggaactggaaattgagctcgaaaactataggagacagtatggaggtggagcaatagaggaacgaggcaatcaagcggcttttaaacaagaaaatagggatacagctatgcttgacgttggtgatcttgaagatcctttgaagcagggcataaattccttggtgagtttggaagaggagagggcatatatagcaagtggtttgagaaaattggagcaaaagctccaattctactccaacaacagtgtttctgttgatttacccagtccagatgttaaggatgacctctctgacaaagtatatgtcatagaagacttctcgttagaccgccaggaaagctcgatagagagcaaagaagctggctcattgacaactagtgggaagattgatctagatgcagtgcaggaagaaatttcaaaattgaacagaagactgaagacactagaaggagatcgcagttttcttgaacatagcatcaactccctcaggaatggcgacgaaggtttgatgtttatacaggaaattgcttgcaatctgagagaactgcgagcaattgctattgacaagaaatag

SEQ ID NO: 20797 - protein, 906 aa, Sorghum bicolor
  misc_feature: Ceres ANNOT ID no. 8668936
  misc_feature: Up-regulated in shoot tissues in response to methyl jasmonate treatment
  misc_feature: Up-regulated in root tissues in response to methyl jasmonate treatment
  misc_feature: Up-regulated in shoot tissues in response to salicylic acid treatment
MGTRMPILPRLSSTLSTALLEWILMLLLFIDAVYSFLVTRFARLCRLPAPCPFCSRLDHVLGNEKPCFYRELICKTHKTEISSLAFCSLHQKLAGAQNMCEGCCGKVTHDDKTDETVMDANVLYSKQRIDDALNSPREKVCSCCGQHFKQRTVALSSRKTAELEPTGAFGSPEIYTEYSVVCQVDEPLEPKDIYHQTDYRSNERDDLLQMTSDSEIEVPCANDVKSSQSREASVVDEDLQEDAACEQPVLPSPVVIKESEIIVKKEPSVEDTCNTSLACPAVDDHPNSGGDVDRTEEKESLSRKLASRHDPVLVIENSGLEDAGISQIPVMPSDELPQVPGEIEPSQSTSEGNADPYTSQFTILEEHYAVSEEGNIKGILEQVDVPEITGRSSGEFHQRIASAADPHTNELVLENAHHGASEDANQKDNCGDIHVSQVSAGSKTCGEVNKIEPTGDMGAHKLIVQDPSGSAPKDLIDKDYVDEPHISATTVRSSGEIPQDHSATEEYPKTSDSVVERRPSLSTQISMNEAYRLAIGNKGSLPSPTLTDVILGKDSTSSINEELRLLLSQLSASRGLEAPWVDPGPSPRAYGRGDELVVQNITNRISLERNASGLESLDGSIVSEMEGESTIDRLRRQIDLDRKSIHLLCRELEEERNASAIAASQALAMITKLQDEKAAMQMEASHYQRMMEEQAEYDSEALAKTNELLAEREQQIEELEIELENYRRQYGGGAIEERGNQAAFKQENRDTAMLDVGDLEDPLKQGINSLVSLEEERAYIASGLRKLEQKLQFYSNNSVSVDLPSPDVKDDLSDKVYVIEDFSLDRQESSIESKEAGSLTTSGKIDLDAVQEEISKLNRRLKTLEGDRSFLEHSINSLRNGDEGLMFIQEIACNLRELRAIAIDKK

SEQ ID NO: 20798 - DNA, 1671 bp, Sorghum bicolor
  misc_feature: Ceres ANNOT ID no. 8669085
  misc_feature: Up-regulated in shoot tissues in response to salicylic acid treatment
  misc_feature: Encodes the peptide sequence at SEQ ID NO 20799
atggcgaaccgcagcaagctcgttgccatcgccctgccgctcgtggcagcagcagcctcgctcgccgtcgtgctcctcctccgctccacgtactcaccggaagacgggtacctcgggcgcgtgggtacgccgtggggcggtaccgtcacggtcctcccattcagccccacggacatgctgcccctcctgccgcggggcgtcgccatggccgcgctccgggcgctccgcggcgtctcggacatcttcccggtgttcgtgggcgccgcgaaggccggcgggccgggctcggcgtccagcagcggggggatggtgagctggaagggggcctgcttctacgagaacgaggcgtggctggtgttccacaacgagaccgggtccaagtacggcggcggcacactccatctcaagacatccaaagcacacagctggacttgcatagatctgtatgtatttgcaacaccgtacagagttacatgggattattactttttggggcgagagcacactcttgatttcgaagaatgggaaagcgaggccgagtatgaatatgtgaaacgtaatggtgtgtccattttcctcatgccatctggaacaattgggacacttcgagcactttgggaggtcttccctctgttcacaaatactgcatggggtgagaatgcgaatcttgcttttctcaagaagcatatgggtgccacctttgaggaacgaccgaaaccttgggtctcagagttaaatcctgatgatatccactctggagatttcttggttttatcaaagattcgtgggcgctggggtggttttgaaacactggagaagtgggttactggtgcttatgcaggccatactgcggtttgccttagggactctgatggaaagctttgggttggggaatctggtaatgaaaatgaacagggagaagatgttattgctatcctgccctgggaggaatggtgggagtttgaagtgacaaaggatgactcaaatcctcagattgcactgcttccattgcatccagatttgcgagcaaaatttaatgagacagcagcttggatttatgcaaaaagcatggatgggaagccttatgggtaccacaatatgatatttagctggattgataccatcagtgataattatccaccaccattagatgctcatgtggttgcttctgttatgactgtatggaccaagcttcaaccagagtatgctggtaatatgtgggaagaagcccttaacaaacggcttggaactaagggtcttcacctttctgaaatcatagtggaatcagagaaacgtgggataacatttgacaagttactaactgttcctgagaatgatagttgggtctatgaagatggccagtcagcatcttgtatagctttcgtccttatgatgtacaaggaggctggactctttgaccctattaccagctctgttgaagttaccgaattcacaataaaagatgcttacaccctcaacttttttgaggacaacgccacccgacttccggaatggtgcaacaaggatgacgacgtgaagctccccttctgccaaatcaagggcaggtaccggatggagctgcctggattcaacaccatggaaccctatgcccacatgaacgaaagatgtccatccctgcctccagattacaataggactaagggttgctag

SEQ ID NO: 20799 - protein, 556 aa, Sorghum bicolor
  misc_feature: Ceres ANNOT ID no. 8669085
  misc_feature: Up-regulated in shoot tissues in response to salicylic acid treatment
MANRSKLVAIALPLVAAAASLAVVLLLRSTYSPEDGYLGRVGTPWGGTVTVLPFSPTDMLPLLPRGVAMAALRALRGVSDIFPVFVGAAKAGGPGSASSSGGMVSWKGACFYENEAWLVFHNETGSKYGGGTLHLKTSKAHSWTCIDLYVFATPYRVTWDYYFLGREHTLDFEEWESEAEYEYVKRNGVSIFLMPSGTIGTLRALWEVFPLFTNTAWGENANLAFLKKHMGATFEERPKPWVSELNPDDIHSGDFLVLSKIRGRWGGFETLEKWVTGAYAGHTAVCLRDSDGKLWVGESGNENEQGEDVIAILPWEEWWEFEVTKDDSNPQIALLPLHPDLRAKFNETAAWIYAKSMDGKPYGYHNMIFSWIDTISDNYPPPLDAHVVASVMTVWTKLQPEYAGNMWEEALNKRLGTKGLHLSEIIVESEKRGITFDKLLTVPENDSWVYEDGQSASCIAFVLMMYKEAGLFDPITSSVEVTEFTIKDAYTLNFFEDNATRLPEWCNKDDDVKLPFCQIKGRYRMELPGFNTMEPYAHMNERCPSLPPDYNRTKGC

SEQ ID NO: 20800 - DNA, 1350 bp, Sorghum bicolor
  misc_feature: Ceres ANNOT ID no. 8669181
  misc_feature: Down-regulated in shoot tissues in response to salicylic acid treatment
  misc_feature: Encodes the peptide sequence at SEQ ID NO 20801
atggccacgcgcaaccacaacaacgccgccgccgccgccgctccgcagctccgccaccaccacaaccgaggcggtgttcccgctctcggaaagagcaaggccgtgcccggccgaactgacgccatgaaccggcgacccgtcctcggcgatattggcaacctcgtcaccgtccgcccagccgaagggaagcctcagcctcaggaacagcaggtcaatcgccccatcacgagaagcttcggtgctcaactcgtgaagaacgcgcaggcgaatgccgccatcaagaatgccgcaatcctgcctgcgaggcatgcgccgaggcaggacaggaaggctcctgctaagctgccgccgcctgaggatatcatagcacttagctccgactctgaacagagcaggacgcagtccgagagcagcgctagctccgtccgctcgaggaggaaggccatcaacaccctttcttctgtgctctcggctcgctcaaaggctgcctgtggaatcgctgataagcctagacaagtgatcgaagacattgacaagttggacgtcaacgatgagctcgcagtcgtggaatacattgaggacatctacacgttctacaagattgctcagcacgagagacggccatgtgactacattgaagcccaggtcgagatcaacgctaagatgagggctatcctggttgattggatacttgaagtacaccacaagttcgaactgatgccagaaactctctacttgaccatgtacatcatcgatcagtacctctcgctgcaaccagtcctgcgaagggagctgcagcttgtcggcgtttcagctatgctgatcgcctgcaagtacgaagagatttgggccccagaggtgaacgacttcatccttatatcagacagtgcatacactagggagcagattctttctatggagaaggggattctgaataggctggagtggaacttgactgtccctacagtatacatgttccttgtccgttttctgaaggcagcaaccttgggtaacaaagttgagaaagagatggagaatatggtcttcttctttgctgaattggcgctgatgcaatatgatttggtgacgcgcctgccttccctggttgcagcttctgctgtctatgcagccaggctcactctcaagaaggctccactttggaccgacaccctcaagcatcacacaggcttcagagagtcagaggcagagctaattgaatgcacgaagatgctggtgagcgcacactcgactgccgctgagagcaagctgagggttgtatacaagaagtattcaagcgagcagttcggaggtgtcgcgcttcgcccacccgcagtggagatctgcaagtaa

SEQ ID NO: 20801 - protein, 449 aa, Sorghum bicolor
  misc_feature: Ceres ANNOT ID no. 8669181
  misc_feature: Down-regulated in shoot tissues in response to salicylic acid treatment
  misc_feature (194)..(319): Pfam ID: Cyclin_N Pfam Description: Cyclin, N-terminal domain
  misc_feature (321)..(447): Pfam ID: Cyclin_C Pfam Description: Cyclin, C-terminal domain
MATRNHNNAAAAAAPQLRHHHNRGGVPALGKSKAVPGRTDAMNRRPVLGDIGNLVTVRPAEGKPQPQEQQVNRPITRSFGAQLVKNAQANAAIKNAAILPARHAPRQDRKAPAKLPPPEDIIALSSDSEQSRTQSESSASSVRSRRKAINTLSSVLSARSKAACGIADKPRQVIEDIDKLDVNDELAVVEYIEDIYTFYKIAQHERRPCDYIEAQVEINAKMRAILVDWILEVHHKFELMPETLYLTMYIIDQYLSLQPVLRRELQLVGVSAMLIACKYEEIWAPEVNDFILISDSAYTREQILSMEKGILNRLEWNLTVPTVYMFLVRFLKAATLGNKVEKEMENMVFFFAELALMQYDLVTRLPSLVAASAVYAARLTLKKAPLWTDTLKHHTGFRESEAELIECTKMLVSAHSTAAESKLRVVYKKYSSEQFGGVALRPPAVEICK

SEQ ID NO: 20802 - DNA, 1302 bp, Sorghum bicolor
  misc_feature: Ceres ANNOT ID no. 8669327
  misc_feature: Down-regulated in shoot tissues in response to salicylic acid treatment
  misc_feature: Encodes the peptide sequence at SEQ ID NO 20803
atggctgcagaaatggaacagccacttcgggaatccatgtccgtggacatcgaagaggaaccacgcactggaaatggatcgatcgttgagaaccccccatctgacctggtgaaatcagaatctgaccgaataaaaactttttatcagacggtcctgtcggctatcatggtgttcgtcacggtggcgctatcaagctacaaggacatgaagcccctttactcgaccacaagccacagcaaagctcgcctcagcagcctcctcgtcgacgagggattattcatattcatgaccttcttgtgtgctgtggtcctaatgatgtctgagttcttcgtgtaccagtatagccggcggggccgtgcctggtgctgggttctcaccatcctcgtcgcagtcaccggcgtgatgctaatcgtggctgacacaatcctcctcatcgtggcgaaccgaagcaacatgttactgtcagttcttctcgggccggtggtgttgcttgtcggtgtggccgtgagcactggagcatggatgctggaggagcccagctcggactcggagcttggaaaaaggtacgacgcggccatgaaggtcacctttgatatggccaccgttggcaccattgtctccttcactcttcaggggggtgtcgcctttagctacctgaagacccctggcactggcagtaataatcatcaggtgaagcgtgacccgccgctggacctcgctgcgtgctacgccacctcgacgctctccctgatcgctatgatggtgtgcgccatgccgctggcgcttctcccagacgacatgctgaaggttctcgtcggagtcgtcgagaggctcaggagtgctgtgctggccgctctggcggtgatggcgctggtcgtctcggtggagttcctggacggcttcgtcgtgctctccttcttcccggaggccgtcacaattgtcctgtgctttgcggtgaagctgttctcggcgtgtcaaacccgagagcagagctcaccgcttgacttcaccttcaccttccggatcgttgctgccgcggggttcacgctaatgaccgggctctatgcggctttcatggggacagatcactatggcttgtacctcaggaccgctatgttcatcctgttacttgcagttctgtcaagcttgagccgtctggcaatcccacttcagcctagagttggaggaggaatcatcgagttcggcactactggtgtcgctctcgcttttcccctgctggcgcttctggctgctattccattggtgctccttgtcttcgtcgaccactacgtcaaccgctag

SEQ ID NO: 20803 - protein, 433 aa, Sorghum bicolor
  misc_feature: Ceres ANNOT ID no. 8669327
  misc_feature: Down-regulated in shoot tissues in response to salicylic acid treatment
MAAEMEQPLRESMSVDIEEEPRTGNGSIVENPPSDLVKSESDRIKTFYQTVLSAIMVFVTVALSSYKDMKPLYSTTSHSKARLSSLLVDEGLFIFMTFLCAVVLMMSEFFVYQYSRRGRAWCWVLTILVAVTGVMLIVADTILLIVANRSNMLLSVLLGPVVLLVGVAVSTGAWMLEEPSSDSELGKRYDAAMKVTFDMATVGTIVSFTLQGGVAFSYLKTPGTGSNNHQVKRDPPLDLAACYATSTLSLIAMMVCAMPLALLPDDMLKVLVGVVERLRSAVLAALAVMALVVSVEFLDGFVVLSFFPEAVTIVLCFAVKLFSACQTREQSSPLDFTFTFRIVAAAGFTLMTGLYAAFMGTDHYGLYLRTAMFILLLAVLSSLSRLAIPLQPRVGGGIIEFGTTGVALAFPLLALLAAIPLVLLVFVDHYVNR

SEQ ID NO: 20804 - DNA, 1641 bp, Sorghum bicolor
  misc_feature: Ceres ANNOT ID no. 8669306
  misc_feature: Down-regulated in shoot tissues in response to aminocyclopropane carboxylic treatment
  misc_feature: Down-regulated in shoot tissues in response to methyl jasmonate treatment
  misc_feature: Encodes the peptide sequence at SEQ ID NO 20805
atgatgggttgcttcactgttctcagatccaagaagaagaaaatcccttttgataatcctcttcttccaagcaagaaatcggttgatgcaagggaaagtacgtcgtctagacttccggaaccagaagttcatgtgccatctttgcaatcagctcctcctagttttaggaacaggactaagatatcccagtcgtcaaataaagtttcaaacagcagagctcgcgtgttgtctgctccgtcaacccttattgtggttgatcagtttggctttccatatgctgaataccgagatcaagacgactccagagataaggaaggttcaacaaaggggcatcgcttttcaaatcctttgccccttcctcttccttcaccggaaggacattcttttaggaactctggtagcttcaaagctagcaacgtaagtgggccattggagatgtccggccctctcccattgcctccaaagaaatgtgatggacttagaatcttttcttacgaggaggttttgtctgcttgccaatggttttcaagtgatcagtgtgtttcagaagcacttggttcaacatcatacaaggcaacatttagggatgaatttattgatacaaagaccactgaagcaacggtagctcgattactcccctccactcagagtttgaaggagtttaaaacacaagcaactacattggcattgcttcagcatcccaatttatgtaaactgattggctattatgcaaaagaagattctaatgaaaggatgttggtctatgaacggcttcatcatgggagcttagataagctactctttggaagaccagatggtcgtttcatggactggtctaaacgtttgaaggttgcccttggtgcggccagaggtcttgctttcttgcatgatgaaggaccctttcaggccatgtacagcgagttctcaactttgaacatccaaatagataaagatttcactgctaagctttcaggatatggttgtgttggcttcaatactgaggagatatctaatgcacctgcgtctgcagcaaacctttcggtggagaccttggagaagggtttactcactcccaagagcaatgtctggagctttggagttgtgttactggagctaataactggaaggaagaaccttgatgccaattcttctaaagaagaacgcaatattgtcaggtggagtaggcctttccttactgatgatagtcgcctatctctgatcatggactcccgtataaaagggcgctttcctactaaggctgctcggatagtagcagacatcattctgaaatgcttgcataatgatccatccgagaggccgaccatgagggatgttgtggaggctctagcaagagtccaggagataaaggttccgtgcagatatcctttgcaagaaccttctgctgcaccaagaaaagtaatgctaaaatctacatccctcaatggaattgtgcctcatcatcctgtcataaccttctctccatcgccgccttcgcataaccagcacttgatttcaccaaggtcatcaacatctgccttgtttcatccaaggacatgctcttctactctggatgatcccggtgtaagctctataaagaaaacacctcctattatgcgtaggtctagcgttgaaggcttttga

SEQ ID NO: 20805 - protein, 546 aa, Sorghum bicolor
  misc_feature: Ceres ANNOT ID no. 8669306
  misc_feature: Down-regulated in shoot tissues in response to aminocyclopropane carboxylic treatment
  misc_feature: Down-regulated in shoot tissues in response to methyl jasmonate treatment
  misc_feature (163)..(450): SWISSPROT Homolog: EC 2.7.11.1 Non-specific serine/threonine protein kinase
  misc_feature (179)..(449): Pfam ID: Pkinase_Tyr Pfam Description: Protein tyrosine kinase
MMGCFTVLRSKKKKIPFDNPLLPSKKSVDARESTSSRLPEPEVHVPSLQSAPPSFRNRTKISQSSNKVSNSRARVLSAPSTLIVVDQFGFPYAEYRDQDDSRDKEGSTKGHRFSNPLPLPLPSPEGHSFRNSGSFKASNVSGPLEMSGPLPLPPKKCDGLRIFSYEEVLSACQWFSSDQCVSEALGSTSYKATFRDEFIDTKTTEATVARLLPSTQSLKEFKTQATTLALLQHPNLCKLIGYYAKEDSNERMLVYERLHHGSLDKLLFGRPDGRFMDWSKRLKVALGAARGLAFLHDEGPFQAMYSEFSTLNIQIDKDFTAKLSGYGCVGFNTEEISNAPASAANLSVETLEKGLLTPKSNVWSFGVVLLELITGRKNLDANSSKEERNIVRWSRPFLTDDSRLSLIMDSRIKGRFPTKAARIVADIILKCLHNDPSERPTMRDVVEALARVQEIKVPCRYPLQEPSAAPRKVMLKSTSLNGIVPHHPVITFSPSPPSHNQHLISPRSSTSALFHPRTCSSTLDDPGVSSIKKTPPIMRRSSVEGF

SEQ ID NO: 20806 - DNA, 2205 bp, Sorghum bicolor
  misc_feature: Ceres ANNOT ID no. 8669356
  misc_feature: Down-regulated in shoot tissues in response to salicylic acid treatment
  misc_feature: Encodes the peptide sequence at SEQ ID NO 20807
atgctgccgcacgcgccatgccgaaccctgggggccttcaggtgcaaaccgcacctccccaccaagccgccgctcctcacctccacccccacctccgcctccacgcgcggccgcctctgcgccaccgccgccgccgccgccacacgccggggcctcctcgtcctcgtcccctcgctagtcgcggcgtccaccgtcctccagtcccttcccctggccgcctccgccgcggcaggcgatgacaagccttccccaccgccgccggcgcaggcgcaagccgcacccgccgctccggcctcgcctccgcctccgcctccagcggaggagccggcgctgtcgagggtctacgacgccacggtcatcggggagccccaggccgtggggaaggacgcgcggcggagggtgtgggagaagctgatggcggcccgggtggtgtacctcggcgaggccgagctcgtccccgaccgcgacgacagggtgctcgagctcgagatcgtcaggaagctcgcggccggatgcgccgaggccgggaggagcatctccctcgcgctcgaggcctttccctgcgacctccaggagcagctcaaccagttcatggatggcagaattgatggcaatagcttgaggctttatacatctcactgggcaccagagcgatggcaggagtatgaacccattttgaattactgccgtgataatggaataaaacttgttgcatgtggaactccacttgaggtggtaagaactgtgcaagcggaaggaattagaagcctttcaaaagctcaaagaaagctttatgctcctccagctggctcaggcttcatttctggttttacatccatctcaggccgatcgttgatagacaaaatttcatcaaatcgtggttccccttttggcccaagctcatatttatcagcacaggcaagagtagttgatgattataccatgtcccagacaataatgaaagaaattactaatggagatccttcagggatgcttgttgttgtaactggtgcgagtcatgttatgtatggatcacgaggaattggtgttcctgctaggatatctaaaaagatgcaaaagaaaaaacaagttgtgatactccttgatcctgagagacaaagtataaggagagaaggtgaaatccctgtagctgatttcttatggtactctgctgccaagccatgcagtcggaattgctttgatcgtgctgaaattgctagagttatgaatgctgctggcaggagacgtgaagctttacctcaggatcttcagaaaggaatagatcttggtgtagtttctcctgagatattgcagaacttttttgaccttgagaaataccctgttatggcggaactgattcaccgtttccaaggtttccgtgaaaggttgctagcagatcccaagtttctgcatagattagctattgaagagggtatatcaataactaccactcttctagcacaatatgaaaaacgaaaaggacgttttttcgaggagatcgactatgttctcactgatacaattaggggttccgttgttgacttctttacagtgtggcttcctgcacctactatttcgctcttatcttttgccgatgatggctctggtgagagtgtggagcttctgaaaggaattttaggatcagtgccagataatgcatttcaaaagggtattgttgggcagaattggaacattaaccagaggtttgcatcggtgcttatgggtggtctaaaacttgcgggcgtcggatttatttctagtattggagctggagttgcttcagatgtcttatatggtgcccgtcagattcttaaaccttctgcaagtatggaagttgcacgcaaaagaactccgatctggaaagcagcaactgtttatagttgcttccttggaacatcggcaaacctgcgatatcaggttatagctggtctgattgagcatcggctaggagaggatctgatgacctactataaccagccacttcttgctagcctggtgtcctttgtttcaaggacagttaactcatactggggaacacagcaatggatcgatcttgcacgagctacaggcgtgcaaagtactaagaaagagctgccttctcctgaggtttcaagcgcaactgaaatgccactgctagaatgtggcacgaccgaagtacagaaggtggacgacagcagtaataaccaatcaaatgacttgacatag

SEQ ID NO: 20807 - protein, 734 aa, Sorghum bicolor
  misc_feature: Ceres ANNOT ID no. 8669356
  misc_feature: Down-regulated in shoot tissues in response to salicylic acid treatment
MLPHAPCRTLGAFRCKPHLPTKPPLLTSTPTSASTRGRLCATAAAAATRRGLLVLVPSLVAASTVLQSLPLAASAAAGDDKPSPPPPAQAQAAPAAPASPPPPPPAEEPALSRVYDATVIGEPQAVGKDARRRVWEKLMAARVVYLGEAELVPDRDDRVLELEIVRKLAAGCAEAGRSISLALEAFPCDLQEQLNQFMDGRIDGNSLRLYTSHWAPERWQEYEPILNYCRDNGIKLVACGTPLEVVRTVQAEGIRSLSKAQRKLYAPPAGSGFISGFTSISGRSLIDKISSNRGSPFGPSSYLSAQARVVDDYTMSQTIMKEITNGDPSGMLVVVTGASHVMYGSRGIGVPARISKKMQKKKQVVILLDPERQSIRREGEIPVADFLWYSAAKPCSRNCFDRAEIARVMNAAGRRREALPQDLQKGIDLGVVSPEILQNFFDLEKYPVMAELIHRFQGFRERLLADPKFLHRLAIEEGISITTTLLAQYEKRKGRFFEEIDYVLTDTIRGSVVDFFTVWLPAPTISLLSFADDGSGESVELLKGILGSVPDNAFQKGIVGQNWNINQRFASVLMGGLKLAGVGFISSIGAGVASDVLYGARQILKPSASMEVARKRTPIWKAATVYSCFLGTSANLRYQVIAGLIEHRLGEDLMTYYNQPLLASLVSFVSRTVNSYWGTQQWIDLARATGVQSTKKELPSPEVSSATEMPLLECGTTEVQKVDDSSNNQSNDLT

SEQ ID NO: 20808 - DNA, 738 bp, Sorghum bicolor
  misc_feature: Ceres ANNOT ID no. 8669403
  misc_feature: Up-regulated in shoot tissues in response to methyl jasmonate treatment
  misc_feature: Up-regulated in shoot tissues in response to salicylic acid treatment
  misc_feature: Encodes the peptide sequence at SEQ ID NO 20809
atgcaggcgctgggcctgggccgcgggtgcatccccctccgcctccatgccagcccctgccgccgcaccgcttccccctctcctccggctccaccccgtccccgcagcgtcacagggctaaaaacctgcatcgccgccgtgcgcgccagcgccgcgcagcccgcgcagatggaacgcaagggggaggttaaggtcgtgaagctgcgggcggtggaggccacgcccgagtccttcgctccgttcgggcaggtcatcaccgcctcccccgacggcgacgagttcggcccccacgacgcccagctcgacctcagcagcggcatcccaaggttctacatcatgcggttgcaggaccggccgctggagttctcgaccatcacccaccacgccagcgtgacccagtgcctgggcgccatcggcggccaggactggtacctcggggtggccaagccgtcgatcgtggatggagcgtccgagcagagtggcccggaggggaggaagctcttacagtctgccgcggggcactgttacctgcctcctgatccagccgaggtctgcgtgttccgggtttcaggctccaagtttctcaagctgaacaaggggacctggcatgccgggcctttgttcaaggcggatgctgttgatttctataatctggagctgagcaacaccaacgttgtcgatcatactacacactatttcaagaaacatgatgggataacatttgtggtggaggactaa

SEQ ID NO: 20809 - protein, 245 aa, Sorghum bicolor
  misc_feature: Ceres ANNOT ID no. 8669403
  misc_feature: Up-regulated in shoot tissues in response to methyl jasmonate treatment
  misc_feature: Up-regulated in shoot tissues in response to salicylic acid treatment
MQALGLGRGCIPLRLHASPCRRTASPSPPAPPRPRSVTGLKTCIAAVRASAAQPAQMERKGEVKVVKLRAVEATPESFAPFGQVITASPDGDEFGPHDAQLDLSSGIPRFYIMRLQDRPLEFSTITHHASVTQCLGAIGGQDWYLGVAKPSIVDGASEQSGPEGRKLLQSAAGHCYLPPDPAEVCVFRVSGSKFLKLNKGTWHAGPLFKADAVDFYNLELSNTNVVDHTTHYFKKHDGITFVVED

SEQ ID NO: 20810 - DNA, 1635 bp, Sorghum bicolor
  misc_feature: Ceres ANNOT ID no. 8669432
  misc_feature: Down-regulated in shoot tissues in response to salicylic acid treatment
  misc_feature: Encodes the peptide sequence at SEQ ID NO 20811
atggcggggtacggggaccggcgatcgccgccgctggaaggcatcaccgtcgtcgacgggggcggcagcagggcgcagtcgccggtgccggtgccgggggcgggggcggggaggctcccgccgccgccaggagggttcgcgcgcgggctcatgaagcagccgtcgcggctggcgtcgggggtgcggcagttcgcgtcgcgggtgtcgatgaaggttcctgagggggtggctgggatgcggccggggaggatgacgcggatgcagtccagcgcgcagatggggctccgcggcctgcgcttcctcgacaagacctccggcggcaaggagggctggaaggccgtcgaacgccgcttcgacgacatgaccaagggcagcggccgactccagaaggagagcttcggcaagtgcatcggcatgggggactccaaggagtttgccggcgagctgttcgtggcgctggcacggaggcggaacctggagccggaggacggcatcaccaaggagcagctcaaggagttctgggaggagatgaccgaccagaacttcgactcgcggctgtgtgacaagaacggcgatgggatgctcacggaagatgaggtcaaagaggttattatactgagcgcgtcagcgaacaagctggccaaattgaagggtcacgccgcgacatatgcgtccctgatcatggaagaactcgacccagacgaccgcggctacattgagatttggcaactggagactttgctccggggcatggtgagcgcgcaggcgcccgagaagctgaagcggacgccgtcgagcctggcgcggacgatgatcccgtcgcggtaccggaacccgctgaagcggcacttgtccaagacggtggacttcatccacgagaactggaagcggatatggctcgtgacactgtggctggttgtcaacctcgctctgttcgtgtacaagttcgagcagtacaagcgccgaactgcgttccaggtgatgggctactgcgtctgcgttgccaagggcgccgccgagatcctcaagctcaacatggccctcatcctgctgcccgtctgccggaatacactgacgacgctcaggtccaccgcgctcagtcatgtcattcccttcgatgacaacatcaacttccacaagatcatggcgctgtcaatcgcgatcgccacagcgatccacacgctcgcacacgtgacctgtgactttccaaggctgatcagctgcccaacggacaaattcatggctaccttggggtccaacttccactacaagcagccgacttacccggacttgctggagagcatacccggggtcaccggaatcctgatgatcatcataatgtccttctccttcacgctggcaacacattccttcaggcggagtgtggtgaagctgccatcgccgctgcaccaccttgccggtttcaatgccttctggtacgcccaccacctgctggtcattgcgtatatcctgctggtggtgcattcctacttcatattcctcaccagggagtggtacaagaagccgacatggatgtacctgattgtccctgtcctcttctatgcctgtgaaagaatcatcaggaaatttcgtgagaacaactaccatgcggaaattgtgaggctagcaacctag

SEQ ID NO: 20811 - protein, 544 aa, Sorghum bicolor
  misc_feature: Ceres ANNOT ID no. 8669432
  misc_feature: Down-regulated in shoot tissues in response to salicylic acid treatment
  misc_feature (124)..(532): SWISSPROT Homolog: EC 1.6.3.1 NAD(P)H oxidase
  misc_feature (83)..(184): Pfam ID: NADPH_Ox Pfam Description: Respiratory burst NADPH oxidase
  misc_feature (336)..(493): Pfam ID: Ferric_reduct Pfam Description: Ferric reductase like transmembrane component
MAGYGDRRSPPLEGITVVDGGGSRAQSPVPVPGAGAGRLPPPPGGFARGLMKQPSRLASGVRQFASRVSMKVPEGVAGMRPGRMTRMQSSAQMGLRGLRFLDKTSGGKEGWKAVERRFDDMTKGSGRLQKESFGKCIGMGDSKEFAGELFVALARRRNLEPEDGITKEQLKEFWEEMTDQNFDSRLCDKNGDGMLTEDEVKEVIILSASANKLAKLKGHAATYASLIMEELDPDDRGYIEIWQLETLLRGMVSAQAPEKLKRTPSSLARTMIPSRYRNPLKRHLSKTVDFIHENWKRIWLVTLWLVVNLALFVYKFEQYKRRTAFQVMGYCVCVAKGAAEILKLNMALILLPVCRNTLTTLRSTALSHVIPFDDNINFHKIMALSIAIATAIHTLAHVTCDFPRLISCPTDKFMATLGSNFHYKQPTYPDLLESIPGVTGILMIIIMSFSFTLATHSFRRSVVKLPSPLHHLAGFNAFWYAHHLLVIAYILLVVHSYFIFLTREWYKKPTWMYLIVPVLFYACERIIRKFRENNYHAEIVRLAT

SEQ ID NO: 20812 - DNA, 1482 bp, Sorghum bicolor
  misc_feature: Ceres ANNOT ID no. 8669650
  misc_feature: Down-regulated in shoot tissues in response to salicylic acid treatment
  misc_feature: Encodes the peptide sequence at SEQ ID NO 20813
atggcgcgcgagcagctggaggagtccatcgtggccgacggcaacggcaaggaggaagaggtcggggtcatgggcatcggcgccgcggacggcgccgacgaccagcacggccgcggcggcggcggcaagctcagcatgacgagcctgctgtggcacggcggctctgtctgggacgcatggttcagctgcgcctccaaccaggtggcgcaggtgctcctcacgctgccgtactccttctcgcagctggggatgctgtccggcatcctgctgcagatcttctacggcttcttgggcagctggaccgcctacctcatcagtgtcctctacgtcgagtaccgctcccgcaaggagaaggaaggcgtcagcttcaagaaccacgtcatccagtggttcgaagtgctggacgggctgctgggcccctactggaaggcggccggtctggccttcaactgcacgttcctgctcttcggctccgtcatccagctgatcgcctgcgcgagcaacatctactacatcaacgaccggctggacaagcggacatggacgtacatcttcggcgcctgctgcgccacaacggtgttcatcccctccttccacaactaccggatctggtccttcctggggctcggcatgaccacctacaccgcgtggtacctcgccatcgccgcgctcatcaacggccaggtcgaaggcgtggagcacaccggcccgaccaagctcgtgctctacttcaccggcgccaccaacatcctctacaccttcggcggccacgccgtcacagtggagatcatgcacgcgatgtggaagcccgccaagttcaagtacatctacctgctggcgacgctgtacgtgttcacgctgacgctgccgtctgctgcggccatgtactgggcgttcggcgacgagctgctgacccactcgaacgccttctcgctgctgcccaagaccgggtggcgcgacgcggcggtgatcctgatgctgatccaccagttcatcacgttcgggttcgcgtgcacgccgctctacttcgtgtgggagaaggtgatcgggatgcacgacaccaagagcatcttcaagcgcgcgctggcgcggctgcccatcgtggtgcccatctggttcctggccatcatcttccccttcttcgggcccatcaactccgccgtcggcgcgctgctcgtcagcttcaccgtctacatcatcccggcgctggcgcacatcctcacctaccgcacggcgtccgcgcgcatgaatgccgcggagaagccaccgttcttcctgccgagctggacggggatgttcgtgctcaacatgttcatcgtggtgtgggtgctggtggtcggcttcgggctcggcggctgggccagcatggtcaacttcatcaggcagatcgacacgttcgggctgttcgccaagtgctaccagtgccccaagccgccggtgccggcggccgcgcagtcaccggcgccgttgccgcaccactag

SEQ ID NO: 20813 - protein, 493 aa, Sorghum bicolor
  misc_feature: Ceres ANNOT ID no. 8669650
  misc_feature: Down-regulated in shoot tissues in response to salicylic acid treatment
  misc_feature (52)..(446): Pfam ID: Aa_trans Pfam Description: Transmembrane amino acid transporter protein
MAREQLEESIVADGNGKEEEVGVMGIGAADGADDQHGRGGGGKLSMTSLLWHGGSVWDAWFSCASNQVAQVLLTLPYSFSQLGMLSGILLQIFYGFLGSWTAYLISVLYVEYRSRKEKEGVSFKNHVIQWFEVLDGLLGPYWKAAGLAFNCTFLLFGSVIQLIACASNIYYINDRLDKRTWTYIFGACCATTVFIPSFHNYRIWSFLGLGMTTYTAWYLAIAALINGQVEGVEHTGPTKLVLYFTGATNILYTFGGHAVTVEIMHAMWKPAKFKYIYLLATLYVFTLTLPSAAAMYWAFGDELLTHSNAFSLLPKTGWRDAAVILMLIHQFITFGFACTPLYFVWEKVIGMHDTKSIFKRALARLPIVVPIWFLAIIFPFFGPINSAVGALLVSFTVYIIPALAHILTYRTASARMNAAEKPPFFLPSWTGMFVLNMFIVVWVLVVGFGLGGWASMVNFIRQIDTFGLFAKCYQCPKPPVPAAAQSPAPLPHH

SEQ ID NO: 20814 - DNA, 1632 bp, Sorghum bicolor
  misc_feature: Ceres ANNOT ID no. 8669813
  misc_feature: Down-regulated in shoot tissues in response to salicylic acid treatment
  misc_feature: Encodes the peptide sequence at SEQ ID NO 20815
atggacgcagcggcagagcccctcctgccgcagccggcgacggccctggaccacctcggccggccggtctcccgccacaccaccggccggtggtccgcagccgtcttcatcatcggggtggagatctcggagcggttcgcgttcgggggcatctcggggaacctgatcacctacctcacgggcccgctcgggcagtccacggcttcggccgccgcggccatcaacgcgtggagcggcgccgcgcttattctgccgctgctcggcgccgccgtcgctgactcatggctcggccgctaccgcactatcatcagcgcctccctcctctacatcctgggactgggtatgctaaccttatcatcaatttttgtgccacaacaaccggcacaatttggagacagcataggttcctccatatcctcgatgggcatccatttagcgttcttctatgtgtcactttacatagtggcatgtgctcaagggggccacaaaccatgtgtccaagcatttggggctgaccaatttgacgagaatgatcctgaagaatgtgcctcaaggagctccttcttcaattggtggtactttggggcatatggagccaatgttattacagtttcaatcttgaattacattcaagataacataagttggcagtttgggtttggtatcccatgcattgccatgtctgtttctcttgcaattttctggcttggtacgaagaagtaccacttctatcctccagtgagtaatgaaggcctatttgaaaatattggtaaatcacttcttgcatggattcgatgctggtgtccaaaatcatctgacgagtctcactttgcaactacatcatcatccaagggagaaaaatacaacagagaaactaaatatttccctgatgatgctgttgcagtgcttaaattgctcccaataggggcaacctgcctgatctatgcagttgtctttgctcaatggatgacactatttactaagcaagcaagtacactagataggtggataggtaccttacaagtaccagctgctacccttcaaagcttgatcagtgtgtcaattgttgtatttgttcctatatatgaccgcatcctcattccactggccaagaaatattcaaagaatacttgtggtatcacaacattgcaacgaattgggattgggttggttatatctgtgatcctgatggttgttgcagcccttgtggagatgagaaggctcagggtagcaagagattatggcctggttgacaaacccagtgtgacaatccctatgagcttctggtgggtggtccctcaattcattctgtctggcttggcagatgtgttcacaatggtcggcttgcaagaatttttctatgatcaagtaccagatggtttacgcagcttggggcttgctctatacttgagcatatttggacttgggagcttcatcagtagcttccttgtgtatacaatcgacaaggtaaccagtagggaaggagacagttggttctctgacaatctaaaccgagggcaccttgattacttctattggcttttagctgtgctcaatgttcttggcttggctgcatacctgtatttttcacaagtgtatactcacaagagaaagggtgttttagcacagtga

SEQ ID NO: 20815 - protein, 543 aa, Sorghum bicolor
  misc_feature: Ceres ANNOT ID no. 8669813
  misc_feature: Down-regulated in shoot tissues in response to salicylic acid treatment
  misc_feature (99)..(473): Pfam ID: PTR2 Pfam Description: POT family
MDAAAEPLLPQPATALDHLGRPVSRHTTGRWSAAVFIIGVEISERFAFGGISGNLITYLTGPLGQSTASAAAAINAWSGAALILPLLGAAVADSWLGRYRTIISASLLYILGLGMLTLSSIFVPQQPAQFGDSIGSSISSMGIHLAFFYVSLYIVACAQGGHKPCVQAFGADQFDENDPEECASRSSFFNWWYFGAYGANVITVSILNYIQDNISWQFGFGIPCIAMSVSLAIFWLGTKKYHFYPPVSNEGLFENIGKSLLAWIRCWCPKSSDESHFATTSSSKGEKYNRETKYFPDDAVAVLKLLPIGATCLIYAVVFAQWMTLFTKQASTLDRWIGTLQVPAATLQSLISVSIVVFVPIYDRILIPLAKKYSKNTCGITTLQRIGIGLVISVILMVVAALVEMRRLRVARDYGLVDKPSVTIPMSFWWVVPQFILSGLADVFTMVGLQEFFYDQVPDGLRSLGLALYLSIFGLGSFISSFLVYTIDKVTSREGDSWFSDNLNRGHLDYFYWLLAVLNVLGLAAYLYFSQVYTHKRKGVLAQ

SEQ ID NO: 20816 - DNA, 1488 bp, Sorghum bicolor
  misc_feature: Ceres ANNOT ID no. 8669853
  misc_feature: Up-regulated in shoot tissues in response to aminocyclopropane carboxylic treatment
  misc_feature: Encodes the peptide sequence at SEQ ID NO 20817
atgggcgccacgccggtgcggtggccgcgtgtgctgaccccggcgcagctcgccggagccatacgccggcagaagaacccgctcgaagctgcccacctgtactgggaagcgcctcgcggctacccaccgtcctgctaccgccacaacgacgacgtccgctccaccctcctcggcgctgcggccggctcccccgtcctcccgtccctcctccgccgggtcctcccatcctccccatccgccgattccctccttgccgcttcgatccccaacctctctcccgcagccgcagtgtccatcttccgctcgtcgctcccctcctccccgtcgccgtcttggtccctctccttctctgccctcctcaggcgcctcgtctcccaagctctactccccgaggctgcccgcctcttcgccgacttcgccgggcgcccggaagtctcagtagcatccgcggatcttactcctctcatcgctggtctctgccacgtgcggcgccctgacctcgcgctgcaggtgctcgacgaaatgccgaacctatgcctcgcaccggagagggatgcctaccgcacaattgtgcctgctctctgtgacgctggcatgcttgatgaggccacacatgtcgtctattccatgctgtggcgggtgtcgcagaggggctgtgacgcagatgttgtggtgtatcgggcattgctggtcgcactctgtgcagctggccggggcgaacaggctgagctggttctggataaggtgctcaggaagggtctgaggtcaccaggcagtcgtcggtctcttcgtgtgccaatgcttgctgtgcttaacctcgaggatgctcgggaatccattgaccaggcgttggctgttcgaggtggccgcactgtatgcagctttgagtccatgattattgacctctatgaagagtgtcggtttgatcaggcggacaaattgctcgaggacatggccaagaagaatttcaagccaacaatctgcatgtatgaggcaaagatagctgctttatgcagggaagggaacgtggatgatgctgtggaagtgatggagaaggagctgccaaagaatgaccttgttccaacagtgacaacatataacttgctcatgaagggtctttgtgacacgatgcaatcaatgagggcactagaatacctcaaaaagatggataagcagcttggttgtgttgctcaaaaggacactttctcaatcttggtccatggtttgtgctcagaaaccaagtttattgatgcttcaaagttaatggagagaatggtgaagggacatcatcggcctgacagaagtgcattcaacagtgttattgaaggtttatgttctgctggcagaatatatgatgcattgctgtggctagaggagatgatcgatcatggagaaacaccaaacatccgtgtttggtcatccttagtctcagtggtttgtatctcccagtttgaagctttaggagctggactactggagaaagcttag

SEQ ID NO: 20817 - protein, 495 aa, Sorghum bicolor
  misc_feature: Ceres ANNOT ID no. 8669853
  misc_feature: Up-regulated in shoot tissues in response to aminocyclopropane carboxylic treatment
  misc_feature (435)..(469): Pfam ID: PPR Pfam Description: PPR repeat
  misc_feature (400)..(434): Pfam ID: PPR Pfam Description: PPR repeat
MGATPVRWPRVLTPAQLAGAIRRQKNPLEAAHLYWEAPRGYPPSCYRHNDDVRSTLLGAAAGSPVLPSLLRRVLPSSPSADSLLAASIPNLSPAAAVSIFRSSLPSSPSPSWSLSFSALLRRLVSQALLPEAARLFADFAGRPEVSVASADLTPLIAGLCHVRRPDLALQVLDEMPNLCLAPERDAYRTIVPALCDAGMLDEATHVVYSMLWRVSQRGCDADVVVYRALLVALCAAGRGEQAELVLDKVLRKGLRSPGSRRSLRVPMLAVLNLEDARESIDQALAVRGGRTVCSFESMIIDLYEECRFDQADKLLEDMAKKNFKPTICMYEAKIAALCREGNVDDAVEVMEKELPKNDLVPTVTTYNLLMKGLCDTMQSMRALEYLKKMDKQLGCVAQKDTFSILVHGLCSETKFIDASKLMERMVKGHHRPDRSAFNSVIEGLCSAGRIYDALLWLEEMIDHGETPNIRVWSSLVSVVCISQFEALGAGLLEKA

SEQ ID NO: 20818 - DNA, 1554 bp, Sorghum bicolor
  misc_feature: Ceres ANNOT ID no. 8669951
  misc_feature: Down-regulated in shoot tissues in response to salicylic acid treatment
  misc_feature: Encodes the peptide sequence at SEQ ID NO 20819
atggcgccggcagtggggctcaagcgctccgccacgcagaccatcactctgccgccgcccgagacgcggctggctgtgcgcgatgtcatgcggtccacgatcccgtcgcagcccgccgaggcgccggcgtccacggagaggccggcgccagccgcggcgctgcaggggttcctgtgcctggaggaggtggacgggaggcggtggagctacgtggtggacggcggggccgccaaggggaggggcaggggcggggccgccgtccccgctggggcctccgttagggccgtgccgctgcagtcgccgcttccgcctgccgaggaaataatggcattcataagatcgtatgttgtgcctgaagggtttccagacagtgttactccttcatatgtaccttacatgacctggagggctctgaaggtattttgtggaacttatgttcaacagtcagcttttactgcacttctttggtggagcgatgggggtgttacaacaagaaccttgctgagttctgttggagtctctcaaagcaaggtgacaccaggtgccattgctatcaactggatcctcaaggacggtgctgggcgagtcggaaaaatgctttttgcacgtcaaggaaagaagtttgactatgacctaaagcagttacggtacactagtgatctgttgctggaaataggagctgggatagaattaactactgctgcattccctcagtttttcttgcctatggcttgcgtagccaatgttgtaaagaatgtcgctgctgttacgtcaacttcaactcgcactccaatctataaggcctatgcgagaggagaaaacattggagatgtcaccgctaaaggcgaatctgttgggaacattgcagatctgcttggtactggtctgagtatctttatctcaaaaaggaatccctcactggtgacttcatttgccttcctatcttgtggatatctcctgagctcatatcaagaggtgagatctgttgtgctgaataccctaaacagggcgaggtttaccgtcgcagtggattctttcattaaaactggtcacattccctccttgaaggaaggaaactcacaggagacgatatttaatccaccttggcggcatgagccagtcgcaataggttcaagatttggagaagcatttcaagagccagcttcatttcttgccataagacctctgtttgaggatgagagatacatggtgacatataacccaacaaaggataaagtatatgctttgctcaaggaccaagcaaaatcagacgacattattaaagctgctttccatgctcatgtgctactgcattttattaatgcatcacatgcacggaggctgaagcagaagcagaagcaggcaaaccctgaccgatcagagcatctgtactctagaaacatggatttcctggcgcacatcgctgaatcttgcaaaattgtttcgtcatcatatggaacattcaagaagaaagcaagggaacagggttggataatgtcagaatctctgctcaaccctggcaaggctcgattatgtgcggcaaaaccacaatga

SEQ ID NO: 20819 - protein, 517 aa, Sorghum bicolor
  misc_feature: Ceres ANNOT ID no. 8669951
  misc_feature: Down-regulated in shoot tissues in response to salicylic acid treatment
MAPAVGLKRSATQTITLPPPETRLAVRDVMRSTIPSQPAEAPASTERPAPAAALQGFLCLEEVDGRRWSYVVDGGAAKGRGRGGAAVPAGASVRAVPLQSPLPPAEEIMAFIRSYVVPEGFPDSVTPSYVPYMTWRALKVFCGTYVQQSAFTALLWWSDGGVTTRTLLSSVGVSQSKVTPGAIAINWILKDGAGRVGKMLFARQGKKFDYDLKQLRYTSDLLLEIGAGIELTTAAFPQFFLPMACVANVVKNVAAVTSTSTRTPIYKAYARGENIGDVTAKGESVGNIADLLGTGLSIFISKRNPSLVTSFAFLSCGYLLSSYQEVRSVVLNTLNRARFTVAVDSFIKTGHIPSLKEGNSQETIFNPPWRHEPVAIGSRFGEAFQEPASFLAIRPLFEDERYMVTYNPTKDKVYALLKDQAKSDDIIKAAFHAHVLLHFINASHARRLKQKQKQANPDRSEHLYSRNMDFLAHIAESCKIVSSSYGTFKKKAREQGWIMSESLLNPGKARLCAAKPQ

SEQ ID NO: 20820 - DNA, 2175 bp, Sorghum bicolor
  misc_feature: Ceres ANNOT ID no. 8670004
  misc_feature: Up-regulated in shoot tissues in response to salicylic acid treatment
  misc_feature: Encodes the peptide sequence at SEQ ID NO 20821
atggagacgcgcggcaagcggctcctcccctttctactggtcctcatcgccgcggcgcgtgcaccacccggagcgcgcctacgacttccggcggtatgtcggcccggcgctggccatggtcaaccccgacctcgtcctgatcacaggagaccttactgtgcttctcatttctcagttcaagtgaaaacccagatgtttcggcacattcgcaaattggaaatgacagccacctatgggaaaagcaaagatttgttaacaatgaaacagaacgaggcagaatgggtggaatatgaaagtacaatgaaggaaatcattgaaagtagcaagcttccaagaaggattttctatgatctgagaggaaatcatgatagctttggtgtaccagcatctggtgacgactatgacttttataataagtatagcatcaatgccaagttaagacggcaggggcgtgtccaaagcattactttggagaatagtggtcggaagcatctgtttgttggctttgatagcacaatggagattggtcttagaggtccaaccaatctatttggacatccaactgacaagcaggtgattgaattggatcaagcgctatcacagtgggatactgactttgacaaggctccagtgacaaaaattgcatttgggcacttccctttgtctttctcagcattaacagagtcaggaaaaagtatcaaggatgtttttctaaaacaatcattggcagcatacttgtgtgggcatcttcatacaaggttcgggaaaaacttgaaacgatactaccatcggcaagtccaggaaccatcattatcagagcattactaccaacttaacatgcaccaaggagatgcaatccatagtaataaggaaaactgttctgaagaagcagctcatattgaagagttctgggaatgggagatgggtgattggagaaagagcagaagtatgagggtactagcaattgatgatggatatgtctcctatactgatatagatttcagattaggctcaaagagcataatcatactacctacctttccacttgattcaagattcatgcagagagcctctggttttcgtgatttcaaatgtcatgtcccgggggcatcgtcttttgataccgtgagagctcttgttttctctaaacatgagatagtatctgtttctataaaaatatatgactcaaggccaggaactcttgaagtagtctttgactctgaaatgaaaagggtggattccaatgaaactcgaggaaatatgtatttgataccatggaactggagggcatttgaagattcctctcccagccgatattggctccaaattgaagtgatggatataacaggtgacacaagtgtcagccagttgaggccattctctgttaacggcttgtctgcaagagtgaactggacatggaaagagttttttgtgatgggtatccagtgggcttcaatatatcatcctgcactgtggtgtgccttttctctaattttttcgttgcttcttgttccacaagttttagcagtggtattcaaagatcagttcacatataaatgtctatgcacatatggtaggcagaggacactgttgaaatctctagttggtggtttcatctgttcttttgttgaactcgccagggtgattcttgtatggttattgctcctgctatatgctgtctatttagtttttataccttggttatttggtcaccctgttactgaagatggtagcctgacattcatgacatataaaggttggattctaaaaggacccaatagtagcaacaaagtagtccatgctgggattccagatgtcatggtcattgttctacctcacctttgttttgtgttactacccactattgtgattttagctgccatggctgctgagagagctgcatatcgagagcattatctttctcgatcaggaaagaagaaagatgattactaccaaaagagcaggagacagatagaacatgaaaacttttggaatggtcgctggattagaaaatttctgtgtgttctttgcgtggtggttctatggaaacattggaagctttgcagagcgcttgtgaaggcttatgctatgaactctttgctccatgcgccagtacttttcttcttcattcctttactcatggtgtttgccatctacaagacatggtccatttag

SEQ ID NO: 20821 - protein, 724 aa, Sorghum bicolor
  misc_feature: Ceres ANNOT ID no. 8670004
  misc_feature: Up-regulated in shoot tissues in response to salicylic acid treatment
METRGKRLLPFLLVLIAAARAPPGARLRLPAVCRPGAGHGQPRPRPDHRRPYCASHFSVQVKTQMFRHIRKLEMTATYGKSKDLLTMKQNEAEWVEYESTMKEIIESSKLPRRIFYDLRGNHDSFGVPASGDDYDFYNKYSINAKLRRQGRVQSITLENSGRKHLFVGFDSTMEIGLRGPTNLFGHPTDKQVIELDQALSQWDTDFDKAPVTKIAFGHFPLSFSALTESGKSIKDVFLKQSLAAYLCGHLHTRFGKNLKRYYHRQVQEPSLSEHYYQLNMHQGDAIHSNKENCSEEAAHIEEFWEWEMGDWRKSRSMRVLAIDDGYVSYTDIDFRLGSKSIIILPTFPLDSRFMQRASGFRDFKCHVPGASSFDTVRALVFSKHEIVSVSIKIYDSRPGTLEVVFDSEMKRVDSNETRGNMYLIPWNWRAFEDSSPSRYWLQIEVMDITGDTSVSQLRPFSVNGLSARVNWTWKEFFVMGIQWASIYHPALWCAFSLIFSLLLVPQVLAVVFKDQFTYKCLCTYGRQRTLLKSLVGGFICSFVELARVILVWLLLLLYAVYLVFIPWLFGHPVTEDGSLTFMTYKGWILKGPNSSNKVVHAGIPDVMVIVLPHLCFVLLPTIVILAAMAAERAAYREHYLSRSGKKKDDYYQKSRRQIEHENFWNGRWIRKFLCVLCVVVLWKHWKLCRALVKAYAMNSLLHAPVLFFFIPLLMVFAIYKTWSI

SEQ ID NO: 20822 - DNA, 891 bp, Sorghum bicolor
  misc_feature: Ceres ANNOT ID no. 8670206
  misc_feature: Down-regulated in root tissues in response to methyl jasmonate treatment
  misc_feature: Up-regulated in shoot tissues in response to aminocyclopropane carboxylic treatment
  misc_feature: Up-regulated in shoot tissues in response to methyl jasmonate treatment
  misc_feature: Down-regulated in root tissues in response to aminocyclopropane carboxylic treatment
  misc_feature: Up-regulated in root tissues in response to salicylic acid treatment
  misc_feature: Up-regulated in shoot tissues in response to salicylic acid treatment
  misc_feature: Encodes the peptide sequence at SEQ ID NO 20823
atggccgtgtacatccgactcgatgacgccgtccgcgcgcgcctccgcggggacgccgcggggtgcaccatcaccagcagcggcagcgaccacgacgcgtccgcctgcctctccgagctcgtccaggcgttcctcgagacgggcgccggcgcggccgaggaaggcgtgcccggcccggcgcccaaggagtacgacgaatctggcgaggaagacgcgcccgggcgggcggccgccgccgcggcgtccgtgagggcactgctcgacccacccgcggaggaggacgtgttccggatcaggctggccgccgcggtggcgacggccatggaggtggaggccgcgctgcgggcgcacggcgcgtcgttccggcgcgcggtggttcggcggctgcgtggcgcagggtacgacgctggcgtgtgcaagtcgcggtgggaggcgtccggcggcatcactgccgggacgtacgagtacgtcgacgtggtcgcgccgctggcggcggacgggcggaagcgggccaggtacattgtggacgccgacttccgtgcggggctggaggtggcccgcgccacgcccgagtatgcggccgtcgtcgccgaggtgccggcgtcggcggtggtcgcaagggaggagtccgtcggccgcgccgtgcgcgtcgcgtccgacgccgcgcgccgctcgctccgcgcccacggcctccacgtcccgccctggcgcaagacgcggtacatgctcgccaagtggctcggcccctacaagcgctccaccgccacctcgctgccggcggcgaacgccggagcaatgccgatgaccggcggggccgggatggacatcaagtgccgcgccgtcgggttctttgcgcctccggccaccgcgccggcggccaggatcaagtag

SEQ ID NO: 20823 - protein, 296 aa, Sorghum bicolor
  misc_feature: Ceres ANNOT ID no. 8670206
  misc_feature: Down-regulated in root tissues in response to methyl jasmonate treatment
  misc_feature: Up-regulated in shoot tissues in response to aminocyclopropane carboxylic treatment
  misc_feature: Up-regulated in shoot tissues in response to methyl jasmonate treatment
  misc_feature: Down-regulated in root tissues in response to aminocyclopropane carboxylic treatment
  misc_feature: Up-regulated in root tissues in response to salicylic acid treatment
  misc_feature: Up-regulated in shoot tissues in response to salicylic acid treatment
MAVYIRLDDAVRARLRGDAAGCTITSSGSDHDASACLSELVQAFLETGAGAAEEGVPGPAPKEYDESGEEDAPGRAAAAAASVRALLDPPAEEDVFRIRLAAAVATAMEVEAALRAHGASFRRAVVRRLRGAGYDAGVCKSRWEASGGITAGTYEYVDVVAPLAADGRKRARYIVDADFRAGLEVARATPEYAAVVAEVPASAVVAREESVGRAVRVASDAARRSLRAHGLHVPPWRKTRYMLAKWLGPYKRSTATSLPAANAGAMPMTGGAGMDIKCRAVGFFAPPATAPAARIK

SEQ ID NO: 20824 - DNA, 1422 bp, Sorghum bicolor
  misc_feature: Ceres ANNOT ID no. 8670359
  misc_feature: Up-regulated in root tissues in response to methyl jasmonate treatment
  misc_feature: Encodes the peptide sequence at SEQ ID NO 20825
atggctagcatcccaatggtagatggaaaaactggtggcaagcgcaaacagacaatctccaatgtcatacgaaagcacgtctatatggtagtactcacgaaacagaggagcatgaaggtgaggagatcggaccctgtactagtgcacgccactggtgatgatgcggccacccaagaatactacttcctctccaacctggatcagaacgtcgccgggctcatgaagacagtccacgtcttcagcgtgccacgtgagacgcgcatcgtcgacgacgtggcagcgctgctcagggactccctgagcagggtgctgtctcactactaccccttggagggccggctagccgtacgcgaggacgggagactcgccgtccgtcggaacgacgaccgccgccgcggtgtcccattcgttgaggcggtgtccgattacgagctccaccaggtggtcggcgatctcgcggcggcggccccgggtgctgaattccttggtggtgacctcgtctacgtcgataacgacatgcagaacgagaacgccctggaggcgccattgctgaccgtgcaggtgaccacgttcaagtgcggcggtggcttcgtcctcggcctcgccatgaaccactgcttggcagacggccagtccgccgccgagttcatctgctcctgggcggagaccgcgcgtggtgtcgccctgtcaacgccgccgtacctcgaccgcacggtgcagcgcgcccggccgatcccgacgatcgacttccggcatgacgagttcacagagatcgaggacgtctctggcctcgccggaatattcgacgacgagccgttcgtgtaccgctccttcaccttcgacgccgccaagctcggcaggctgaagcaagccgcgagcgacgaaaccaagagctccatcttcgtcgcgctcacggcgttcgtctgggtaacaaggacgcgagccctgcggatgctcccggagcagaagagcaagctgctgttcgccgtggacggccgcctgcgcgtcgatccgccattgccgccggggttctggggcaacgccatcacctttgcctgctgcatctccacggccagtgatctcctcagcaaaccactgtccgtggctgcccgttccatcagagatgccatcgtgcgcaccgacgatgcgttcatccgttccgccgttgactacatcgagttgaacagcggtgctcgcccgtcgctaacagcgacgacactggtcactgcttggaatcgcctcgggtttcgcgcggccaactttggatggggtgaagcaatctactctgggccggcggagctgccgcagaaggaggtggcaatgtttctgcgcggcatgcgtgacagccagagcatagtgctggttattgggatgcctgtgtcatgtatgcaggcattccaagaaacggtagatctggtgtga

SEQ ID NO: 20825 - protein, 473 aa, Sorghum bicolor
  misc_feature: Ceres ANNOT ID no. 8670359
  misc_feature: Up-regulated in root tissues in response to methyl jasmonate treatment
  misc_feature (63)..(467): SWISSPROT Homolog: EC 2.3.1.162 Taxadien-5-alpha-ol O-acetyltransferase
  misc_feature (38)..(473): Pfam ID: Transferase Pfam Description: Transferase family
MASIPMVDGKTGGKRKQTISNVIRKHVYMVVLTKQRSMKVRRSDPVLVHATGDDAATQEYYFLSNLDQNVAGLMKTVHVFSVPRETRIVDDVAALLRDSLSRVLSHYYPLEGRLAVREDGRLAVRRNDDRRRGVPFVEAVSDYELHQVVGDLAAAAPGAEFLGGDLVYVDNDMQNENALEAPLLTVQVTTFKCGGGFVLGLAMNHCLADGQSAAEFICSWAETARGVALSTPPYLDRTVQRARPIPTIDFRHDEFTEIEDVSGLAGIFDDEPFVYRSFTFDAAKLGRLKQAASDETKSSIFVALTAFVWVTRTRALRMLPEQKSKLLFAVDGRLRVDPPLPPGFWGNAITFACCISTASDLLSKPLSVAARSIRDAIVRTDDAFIRSAVDYIELNSGARPSLTATTLVTAWNRLGFRAANFGWGEAIYSGPAELPQKEVAMFLRGMRDSQSIVLVIGMPVSCMQAFQETVDLV

SEQ ID NO: 20826 - DNA, 1149 bp, Sorghum bicolor
  misc_feature: Ceres ANNOT ID no. 8670367
  misc_feature: Down-regulated in root tissues in response to aminocyclopropane carboxylic treatment
  misc_feature: Down-regulated in shoot tissues in response to salicylic acid treatment
  misc_feature: Encodes the peptide sequence at SEQ ID NO 20827
atggcggaaccagggtgtgatcctgatctcggcgtgccgccggctaagcggagcgaagttgatcctatcgtcccgactgagcacccttggaacctgcctgcactgttctatgtgccccagtgttccggcagcgcagatgagggtgctgtggtgataccccgggaggcaaatctgccaatcgacacagaaactaggatggttgtggctcaggtctcccaggcagtggtcgccgtcgcctccatcgatgctgatggtgaccagatgtggaaaggttcaggatttgttgctgattttgatgaagctagtatgattgggacagtcttttcatcagcaaaaatagctagacgtgagccttgctttccaggcattgaaaagataaaagtatatctatttgatggtacctgttatgatgccactgtagcagcatgtgactatcactggaatttattagttctatctgtttcatttgaccgtgttgtcaaacctatgaaattggtggagatcagtgaaaatagaaattcaagggatcctcaactagaaacatgtagtattctgcctcattcaagtcatgaaaacctctatcctggagataccattattggactcggtcgatggccagaagagccctttgcgcttcgagcgcatcgtggagtttacagcactgatcgttggactgctttccgcaaactttgccaagaaatgcagatagcaacatttttaaacacatatggtgcaattggaggtccagcgataaacagaaatggaagggttgttggaatgctttttcaaagtctgacttgtactcctttcctaccatctaacatcattttaagatggtgggaacatttcaaaaatacagggaagtattgtcgtccaactataagggttttgggtgtgaatttgcataatgcccagtcttcaccttgggtgaaagtccccgtgtctttgcatgaagggttggatggtattcttgttgagctgttgttcgaaatcttggcggaaaatattggaaaagcggtggagctgactgttgtaaaggccgaggatggcagtacgaaatcaatacatcttcccgtggaagaggctgaggaggagaactttcacaagttgttaccatacccctactcacccaccgatacaccagtttaa

SEQ ID NO: 20827 - protein, 382 aa, Sorghum bicolor
  misc_feature: Ceres ANNOT ID no. 8670367
  misc_feature: Down-regulated in root tissues in response to aminocyclopropane carboxylic treatment
  misc_feature: Down-regulated in shoot tissues in response to salicylic acid treatment
MAEPGCDPDLGVPPAKRSEVDPIVPTEHPWNLPALFYVPQCSGSADEGAVVIPREANLPIDTETRMVVAQVSQAVVAVASIDADGDQMWKGSGFVADFDEASMIGTVFSSAKIARREPCFPGIEKIKVYLFDGTCYDATVAACDYHWNLLVLSVSFDRVVKPMKLVEISENRNSRDPQLETCSILPHSSHENLYPGDTIIGLGRWPEEPFALRAHRGVYSTDRWTAFRKLCQEMQIATFLNTYGAIGGPAINRNGRVVGMLFQSLTCTPFLPSNIILRWWEHFKNTGKYCRPTIRVLGVNLHNAQSSPWVKVPVSLHEGLDGILVELLFEILAENIGKAVELTVVKAEDGSTKSIHLPVEEAEEENFHKLLPYPYSPTDTPV

SEQ ID NO: 20828 - DNA, 1467 bp, Sorghum bicolor
  misc_feature: Ceres ANNOT ID no. 8670382
  misc_feature: Up-regulated in root tissues in response to salicylic acid treatment
  misc_feature: Encodes the peptide sequence at SEQ ID NO 20829
atggcttcttccgggaccacagcccctggcgttccgccctccacaagcgccccacccggcgccgacgcggtcgtgacaacctctgccctgatcactgctaccacgtcgccgccggctgcgtcctccacaccgccagccccaatgctggccatcccttccgacgcgcttacggccttcaccagcgccatccagggcttccagaaccagatggccctcatgagcttccagatgggtgatctggccacgcgtgtgtcggtcctggacggtcgggatctgcctacagccgcgcagttcccacagctgccgatgtcaagcgcgggtcatcttccctcgccgcaggcaccgtccttaccgctgggcgtgcatccatctgccccggttcccatccagcagccatggatgccgccccctccatcgattatgtcttatgctctagcatcgacgatggggctggtgcacacgatggcaagcaccccggcggccacgacaacagttgctccagcaccctccaccagcgctgttgtcttccccggtgtatcaaccatccagcatccattcaccgatgggatcttctataggggtgccagcttccagcagttccgagatgagggcgagatgctgcagcagaccgagcagccgatggcgacggagctgacaggtaagatgcttcgctgccaggtgtcggcggcagtgcagctgcaagctgctgtgcgtggcctccttgcacgtcggcgggtgcagaagatgcgcgatctgccgctaattcagccctgcacctatttgcagctccaccatgtggaggactgcgatctcatccgctgcgtcggggattttcggaatgtggttccgcccacgggcagcgtgtatgctgtttttcccgcaggtggtggactcaaagtcttcggcgtcggcagttggaagccctatgctcttctatgtgcggtgcagaccaacagccgtccagcaaggagaaggcatggtgtcatcggtgggagggcactgcctagcgccgccagattccgccaccgaccaccgcgagggcgccttcgctggtccatgttgcgaccacttcctggaggccacacacaagcacatctttcatccagatggtctccaagggatccaggtggatggtgtccgccttatgtgcaggggttaaaattatttctagttgataataataaaacaagccgagatgtaaaagacttgtttgtaggtgttatatttgtgtcttgcggagtcgttcttagtgtcgtcgttaagttgcagctcgaggacgagctgcatgtccaggtggggtgtagtgttagaagagtcaaggacctattgggccttagcccattagagttaattagtcgcttgcttaggggtcaaagacagctagagacaaaagaaagtagagaacaaacactagaggggacactgaaacacagaggacgagcaggcccggacccttgtttggtttag

SEQ ID NO: 20829 - protein, 488 aa, Sorghum bicolor
  misc_feature: Ceres ANNOT ID no. 8670382
  misc_feature: Up-regulated in root tissues in response to salicylic acid treatment
  misc_feature (227)..(247): Pfam ID: IQ Pfam Description: IQ calmodulin-binding motif
MASSGTTAPGVPPSTSAPPGADAVVTTSALITATTSPPAASSTPPAPMLAIPSDALTAFTSAIQGFQNQMALMSFQMGDLATRVSVLDGRDLPTAAQFPQLPMSSAGHLPSPQAPSLPLGVHPSAPVPIQQPWMPPPPSIMSYALASTMGLVHTMASTPAATTTVAPAPSTSAVVFPGVSTIQHPFTDGIFYRGASFQQFRDEGEMLQQTEQPMATELTGKMLRCQVSAAVQLQAAVRGLLARRRVQKMRDLPLIQPCTYLQLHHVEDCDLIRCVGDFRNVVPPTGSVYAVFPAGGGLKVFGVGSWKPYALLCAVQTNSRPARRRHGVIGGRALPSAARFRHRPPRGRLRWSMLRPLPGGHTQAHLSSRWSPRDPGGWCPPYVQGLKLFLVDNNKTSRDVKDLFVGVIFVSCGVVLSVVVKLQLEDELHVQVGCSVRRVKDLLGLSPLELISRLLRGQRQLETKESREQTLEGTLKHRGRAGPDPCLV

SEQ ID NO: 20830 - DNA, 762 bp, Sorghum bicolor
  misc_feature: Ceres ANNOT ID no. 8670552
  misc_feature: Up-regulated in shoot tissues in response to methyl jasmonate treatment
  misc_feature: Down-regulated in root tissues in response to aminocyclopropane carboxylic treatment
  misc_feature: Up-regulated in root tissues in response to methyl jasmonate treatment
  misc_feature: Up-regulated in root tissues in response to salicylic acid treatment
  misc_feature: Encodes the peptide sequence at SEQ ID NO 20831
atggcgtcgggctccggcggcggcgggagcgacttctccgtgttcgtggtgggctccgacttcgcgaccgacgccggcgccgcgctcctcgcacccgccgaccgcgaggtgtggcacgactgcctccccgacctcgccgaggcggacgcctgcttcttcgacctcgaggagcgccaggtcgtgcgtgtccagggcaccgatcgggccggccgaaccgtcgtccgcatcgtcggcaagttcttcccggcttcagtagttgatggtgaacgtctgaagaagtatgtgttctacaaactccgcactgaattacctgtgggtccattctgcatcttgtacatgcacagtactgtacagtctgatgataacaaccctgggatgtcaatcttgaggacaatttatgaggagcttccacctgaatacaaggaaaggcttcaagttttttacttcttgcatcctgggcttcgctccaggcttaccatcgccacccttggcaggctatttttaagtggagggttgtattggaaaatcaagtacattagtcgactggagtatctctggggggacataaaaaagggagaggttgaaattccagagtttgttattgaacatgataaggttcttgagcaccggccactgactgattatggcatagaaccagatcccctacatcttgctgatgtacctgctgtgggatactcgcttggaagatacgaagataaatggactccagaagatcgtcggtattcaaggaactacatgtga

SEQ ID NO: 20831 - protein, 253 aa, Sorghum bicolor
  misc_feature: Ceres ANNOT ID no. 8670552
  misc_feature: Up-regulated in shoot tissues in response to methyl jasmonate treatment
  misc_feature: Down-regulated in root tissues in response to aminocyclopropane carboxylic treatment
  misc_feature: Up-regulated in root tissues in response to methyl jasmonate treatment
  misc_feature: Up-regulated in root tissues in response to salicylic acid treatment
MASGSGGGGSDFSVFVVGSDFATDAGAALLAPADREVWHDCLPDLAEADACFFDLEERQVVRVQGTDRAGRTVVRIVGKFFPASVVDGERLKKYVFYKLRTELPVGPFCILYMHSTVQSDDNNPGMSILRTIYEELPPEYKERLQVFYFLHPGLRSRLTIATLGRLFLSGGLYWKIKYISRLEYLWGDIKKGEVEIPEFVIEHDKVLEHRPLTDYGIEPDPLHLADVPAVGYSLGRYEDKWTPEDRRYSRNYM

SEQ ID NO: 20832 - DNA, 1260 bp, Sorghum bicolor
  misc_feature: Ceres ANNOT ID no. 8670681
  misc_feature: Up-regulated in shoot tissues in response to methyl jasmonate treatment
  misc_feature: Up-regulated in root tissues in response to methyl jasmonate treatment
  misc_feature: Up-regulated in shoot tissues in response to salicylic acid treatment
  misc_feature: Up-regulated in root tissues in response to salicylic acid treatment
  misc_feature: Encodes the peptide sequence at SEQ ID NO 20833
atggccggcgccggtgcacccgcagctccccaggccgccgaccgcttcgacgtcatcgtggtgggcgctggcatcatgggcagctgcacggcgcacgcggcggcgtcccggggctcccgcgtcctgctgctggagcgcttcgacctgctccatccgctgggatcctcgcacggcgactcccgcatcatccgcgacgcctacgagcagccgcgctacgtccgcatggtgtgcctcgcccgccgcctctgggccgccgccgaggccgagtcgggctaccgcgtgctcaccccgacgccgcacctctccatgggcccgcgctccagcgcctccctcgccgccgccctcgccaacatcggcgccgaggaggtactggccgacgacctcggcggcaggtggggcggcgccttcgccttcaccgtcccggacccgtccgacgagtgggtcaccgcgctcagcgaccacggcggcgtgctcagcgccaccaaggccgtggccatgttccagtcgctcgccgtcgcgaaaggcgccgcggtcagggacaacaccgaggtcgtcggcatcgaaaagggaccgggacccgagggcggcgtcgtggtgaggacccgcgacggccaggcgttccgcggcgccaagtgcgtcgtcacggtgggcgcgtgggcggccaagctgctcggctccatctccggcggcgtggacctccccatcaagccgctgcacacgctccacctctactggcgcgtgaagcccggccaggagcagagcctctcggcgagcgccgggttcccgaccttctccagctacggcgacccgcccgtgtacggcacgccgtcgctggaggtcccggggctcatcaagatcagctgcgacggtggcccgccgtgcgacccggacgcgcgcgactggctggccggagacccggaggtcacggaccgggtggccaggtggatccaggaggccatgccgggccacgtcgacgcctccggcgggccggtcatccggcagtcgtgcatgtgctccatgacgcccgacttcgacttcgtcatggacttcctcggcggggagctcgggcgggacgtggtggtcggtgtcgggttctcggggcatggattcaagatgggcccggccgtggggaagatcctggcggagatggccattgatggcgactccccgacggcggcagaggccgacctcgacctcggcttcttccggatcggccgcttcgatgggaacccagtgggaaatgccaacaaggatcagtag

SEQ ID NO: 20833 - protein, 419 aa, Sorghum bicolor
  misc_feature: Ceres ANNOT ID no. 8670681
  misc_feature: Up-regulated in shoot tissues in response to methyl jasmonate treatment
  misc_feature: Up-regulated in root tissues in response to methyl jasmonate treatment
  misc_feature: Up-regulated in shoot tissues in response to salicylic acid treatment
  misc_feature: Up-regulated in root tissues in response to salicylic acid treatment
  misc_feature (16)..(387): SWISSPROT Homolog: EC 1.5.3.1 Sarcosine oxidase
  misc_feature (17)..(383): Pfam ID: DAO Pfam Description: FAD dependent oxidoreductase
MAGAGAPAAPQAADRFDVIVVGAGIMGSCTAHAAASRGSRVLLLERFDLLHPLGSSHGDSRIIRDAYEQPRYVRMVCLARRLWAAAEAESGYRVLTPTPHLSMGPRSSASLAAALANIGAEEVLADDLGGRWGGAFAFTVPDPSDEWVTALSDHGGVLSATKAVAMFQSLAVAKGAAVRDNTEVVGIEKGPGPEGGVVVRTRDGQAFRGAKCVVTVGAWAAKLLGSISGGVDLPIKPLHTLHLYWRVKPGQEQSLSASAGFPTFSSYGDPPVYGTPSLEVPGLIKISCDGGPPCDPDARDWLAGDPEVTDRVARWIQEAMPGHVDASGGPVIRQSCMCSMTPDFDFVMDFLGGELGRDVVVGVGFSGHGFKMGPAVGKILAEMAIDGDSPTAAEADLDLGFFRIGRFDGNPVGNANKDQ

SEQ ID NO: 20834 - DNA, 990 bp, Sorghum bicolor
  misc_feature: Ceres ANNOT ID no. 8670722
  misc_feature: Up-regulated in root tissues in response to methyl jasmonate treatment
  misc_feature: Up-regulated in shoot tissues in response to methyl jasmonate treatment
  misc_feature: Up-regulated in shoot tissues in response to salicylic acid treatment
  misc_feature: Encodes the peptide sequence at SEQ ID NO 20835
atggaacaagccaaggagggaagcgccacagatagctcgtccgaagccatttcatctcaaagccacagtacccatcttctctccaaacttccaacaagagagggttggacacagccactggtgctctacaagaacttctggatccgtccgccaatggctattaacatcatgcacctccagaacagttttaaagctcgccaagacgatatcatcattgcatccaaccctaagtgtggcaccacatggttgaaggcgctcgccttcacaataaccaatcgctccaggtatgagtttggaaatcaccctcttctctttcgtcatccccaggaggtgattccatttatcgagatccctcttggcgtggagctgacttatgtggacacgctctcttccccaagagttctcgccacccatatgcccttttcattgctcccaaactccataactacttgtggttgtcggattgtgtacatctgccgagggccaaaggatgcctttgtgtctcgatggcattttgagaataagattagtagagaatatagcatcaatgtggaagatgctcttgacatgttctgtgaaggtttctcaccctatggtcctttttgggagcactgcctcgagtactggagggagagcatcgcaagtcctgacaaggttctttttctcaagtatgaggatatgacatcagaaccagtgaagtatgtcaaaaggatcgcatcgttccttggcgtcccattcagtattaaggaacaagaagatggggtgcctgaggaggttgtgagattatgcagcttcgagaagctcagcggcttgcatgccaatcaggcagcaggagacatcgctcggcatggcaacatggtcattgacaagtcggtgttctttagaaaaggaatcgtgggggattgggtgaatcacattagtgaagagatggggagaaagatagattccgttatagaagagaaactcaagggatctggccttgtgttttaa

SEQ ID NO: 20835 - protein, 329 aa, Sorghum bicolor
  misc_feature: Ceres ANNOT ID no. 8670722
  misc_feature: Up-regulated in root tissues in response to methyl jasmonate treatment
  misc_feature: Up-regulated in shoot tissues in response to methyl jasmonate treatment
  misc_feature: Up-regulated in shoot tissues in response to salicylic acid treatment
  misc_feature (54)..(329): SWISSPROT Homolog: EC 2.8.2.4 Estrone sulfotransferase
  misc_feature (67)..(326): Pfam ID: Sulfotransfer_1 Pfam Description: Sulfotransferase domain
MEQAKEGSATDSSSEAISSQSHSTHLLSKLPTREGWTQPLVLYKNFWIRPPMAINIMHLQNSFKARQDDIIIASNPKCGTTWLKALAFTITNRSRYEFGNHPLLFRHPQEVIPFIEIPLGVELTYVDTLSSPRVLATHMPFSLLPNSITTCGCRIVYICRGPKDAFVSRWHFENKISREYSINVEDALDMFCEGFSPYGPFWEHCLEYWRESIASPDKVLFLKYEDMTSEPVKYVKRIASFLGVPFSIKEQEDGVPEEVVRLCSFEKLSGLHANQAAGDIARHGNMVIDKSVFFRKGIVGDWVNHISEEMGRKIDSVIEEKLKGSGLVF

SEQ ID NO: 20836 - DNA, 1725 bp, Sorghum bicolor
  misc_feature: Ceres ANNOT ID no. 8670793
  misc_feature: Up-regulated in shoot tissues in response to methyl jasmonate treatment
  misc_feature: Up-regulated in shoot tissues in response to salicylic acid treatment
  misc_feature: Encodes the peptide sequence at SEQ ID NO 20837
atggcggcgcttccccccctccgccgcctcctggccctccgcggccaccgccgcctcctctccaccaccactcccgccgcctcatccagcaacccccctaccccagaggccgtgctctacgacatccacagcctctccaaggacccctcccaagcgctcgccgtcttccgccgctccgccgccgccggccagcccgtcagctccgcggcatacaacctcacgctccgcaccctcgcatcccacccctcctccgcccagcgccatttctggcccttcctccgggagatgcaagaggctggccactccgtcgaccagggcacctacctcgccgccctcgcctccttcaagaaggccagcctcaccgccgactacgcctccctcaccgcgcactacaacaagttccggaagggggccaactccgccgccgccgccgccgccgccgccgccgcggaggctgtccgggaccacgacgccgcgggcctcgatagcaggctcgctgacatcggtctccttccgctcacggaaaccaccgtcatcacggtgctccgggagctgagggagtatccgatcaaggctctcgccttcttcagatgggctgagcagcagcaggggtacacgcacagctcggtggcctacaatgccatggcaagggtgctcggccgggaggagtcggtgccagagttttgggacttgatccaggaaattaaggctgccgggatgcacgttgatatcgacacttacctcaagctgtccaggaacttccagaagcggcacatggtcagggaggctgtggagctgtatgagctcatgatggatggccctttcaagccatcccagcaggatggacccatcatcatcaggcgcatctcgctggggcggtcaccggaccttgagcttgtcaaccgggttgtcaacaagtttgaagccgtctggggcgtcaagaccaaagagttgcttgacggggtccatagggcacttaccagtaatgggaagttcgacgaggctgcagagattgtgcaaacaatgagggaccaaggccaccagccggacaatgttacatatagccagttggtatatggtctttgcaaggctggcaagctggaggatgctcgcaaggtgctcgatgaaatggaggccgaagggtgtgtcccagatttgaagacttggaccctgttgatccaagggtactgttcagctggggatgtggacagagctgtgcagtacttcactgagatgatcgagaagggcttggacgcggatgccgatttgctggatgtgatattgaaaggtctgtgtagccatgaaaaggttgaagaggcttactctttgtttgttgagatggtggataaggctgagttgaggccttttcaaggcacttgccagcgtctaattggtgacttgctgagggtaaacaaacttgaggaggcactggcccttctgaagacaatgaaaacctgcaagttcccagctttcgtggacccattccatccttacattgccaagcatgggacggttgaagatgcaaggaactttttcaaggccttgacagtgaaaacttctccagcacctgctgtctacgtggatgttctcaagttgttctttgctgagggaagatactctgaagctcaagagttactgtacaaatgccctaaccacatccgcaagcacccccatgtcaccaaactgtttgaatcaataaaagttgagagtgcctctgcctcttga

SEQ ID NO: 20837 - protein, 574 aa, Sorghum bicolor
  misc_feature: Ceres ANNOT ID no. 8670793
  misc_feature: Up-regulated in shoot tissues in response to methyl jasmonate treatment
  misc_feature: Up-regulated in shoot tissues in response to salicylic acid treatment
  misc_feature (352)..(386): Pfam ID: PPR Pfam Description: PPR repeat
  misc_feature (387)..(421): Pfam ID: PPR Pfam Description: PPR repeat
MAALPPLRRLLALRGHRRLLSTTTPAASSSNPPTPEAVLYDIHSLSKDPSQALAVFRRSAAAGQPVSSAAYNLTLRTLASHPSSAQRHFWPFLREMQEAGHSVDQGTYLAALASFKKASLTADYASLTAHYNKFRKGANSAAAAAAAAAAEAVRDHDAAGLDSRLADIGLLPLTETTVITVLRELREYPIKALAFFRWAEQQQGYTHSSVAYNAMARVLGREESVPEFWDLIQEIKAAGMHVDIDTYLKLSRNFQKRHMVREAVELYELMMDGPFKPSQQDGPIIIRRISLGRSPDLELVNRVVNKFEAVWGVKTKELLDGVHRALTSNGKFDEAAEIVQTMRDQGHQPDNVTYSQLVYGLCKAGKLEDARKVLDEMEAEGCVPDLKTWTLLIQGYCSAGDVDRAVQYFTEMIEKGLDADADLLDVILKGLCSHEKVEEAYSLFVEMVDKAELRPFQGTCQRLIGDLLRVNKLEEALALLKTMKTCKFPAFVDPFHPYIAKHGTVEDARNFFKALTVKTSPAPAVYVDVLKLFFAEGRYSEAQELLYKCPNHIRKHPHVTKLFESIKVESASAS

SEQ ID NO: 20838 - DNA, 1137 bp, Sorghum bicolor
  misc_feature: Ceres ANNOT ID no. 8670797
  misc_feature: Up-regulated in shoot tissues in response to methyl jasmonate treatment
  misc_feature: Down-regulated in shoot tissues in response to aminocyclopropane carboxylic treatment
  misc_feature: Up-regulated in root tissues in response to methyl jasmonate treatment
  misc_feature: Encodes the peptide sequence at SEQ ID NO 20839
atggccgccgccggcattgttgtcgtcctctgcatcggcctgttgtcgtcgtgcgttggccttggccttgcgcgcggagacttctccatcgtgggctactcggaggaggacctgtcgtcgcacgagagcctagcggagctgttcgagcggtggctgtcccgccaccgcaagggggcgtacgcgagcctggaagagaagctccggcggttcgaggtgttcaaggacaacctgcaccacatcgacgagaccaaccgcaaggtgagcagctactggctggggctcaacgagttcgccgacctcacgcacgacgagttcaaggccacctacctcggcctaagccccagcggcggcggcggcgatgtcgtccatatgcatcatgatgatgatgacgaggagccggaggaggagggctcgtcgtcgtcgtcgtccttccggttccggtacgagggcgttgacgcggcgcgcctccccaagtccgtggactggcggagcaagggcgcggtgaccggggtgaagaaccaggggcagtgcggcagctgctgggccttctccacggtggcggccgtggagggcatcaaccagatcgtgacgggcaacctgacggcgctgtcggagcaggagctcgtcgactgcgacacggacggcaacaacggctgcaacgggggcctcatggactacgccttctcctacatcgcacacaacggcggcctccacacggaggaggcgtatccgtacctcatggaggaaggcacctgcagcagaggatcctccgccgccgtggtcaccatctccgggtacgaggacgtgcccaggaacaacgagcaggcgctgctcaaagcgctggcgcaccagcccgtcagcgtcgccatcgaggcctccggcaggaacttgcagttctacagcggcggcgtcttcgatgggccctgcggcacgcagctggaccacggcgtggcggccgtcggctacgggacggcgggcaaggacaatggccatgtggtggcggactacatcatcgtcaagaactcgtggggacccagctggggtgagaaggggtacatccgcatgaggagaggcaccggcaagcgccaaggactctgcggcatcaacaagatgccctcctacccaaccaagaactaa

SEQ ID NO: 20839 - protein, 378 aa, Sorghum bicolor
  misc_feature: Ceres ANNOT ID no. 8670797
  misc_feature: Up-regulated in shoot tissues in response to methyl jasmonate treatment
  misc_feature: Down-regulated in shoot tissues in response to aminocyclopropane carboxylic treatment
  misc_feature: Up-regulated in root tissues in response to methyl jasmonate treatment
  misc_feature (146)..(377): SWISSPROT Homolog: EC 3.4.22.6 Chymopapain
  misc_feature (156)..(376): Pfam ID: Peptidase_C1 Pfam Description: Papain family cysteine protease
  misc_feature (48)..(105): Pfam ID: Inhibitor_I29 Pfam Description: Cathepsin propeptide inhibitor domain (I29)
MAAAGIVVVLCIGLLSSCVGLGLARGDFSIVGYSEEDLSSHESLAELFERWLSRHRKGAYASLEEKLRRFEVFKDNLHHIDETNRKVSSYWLGLNEFADLTHDEFKATYLGLSPSGGGGDVVHMHHDDDDEEPEEEGSSSSSSFRFRYEGVDAARLPKSVDWRSKGAVTGVKNQGQCGSCWAFSTVAAVEGINQIVTGNLTALSEQELVDCDTDGNNGCNGGLMDYAFSYIAHNGGLHTEEAYPYLMEEGTCSRGSSAAVVTISGYEDVPRNNEQALLKALAHQPVSVAIEASGRNLQFYSGGVFDGPCGTQLDHGVAAVGYGTAGKDNGHVVADYIIVKNSWGPSWGEKGYIRMRRGTGKRQGLCGINKMPSYPTKN

SEQ ID NO: 20840 - DNA, 1566 bp, Sorghum bicolor
  misc_feature: Ceres ANNOT ID no. 8670847
  misc_feature: Up-regulated in root tissues in response to salicylic acid treatment
  misc_feature: Encodes the peptide sequence at SEQ ID NO 20841
atggaggagaaatttgcgaggctttcttgtataccatttcatgaagttgtgggacgacaaaacaatgccaccaatcaacacggcgcatatatgggctcgaaatcggtagacgaggtgctcgatgccgccgccgccgccggagtccattactccgcactccgtctggacggcctcaacacccaggtttccgccgcctcgtacgaggaacaaccaacgacgtctggcctggagaatggccaccaggagccctttgttattggtgttgctgggggtgcatcgtcaggcaaaagtaccgtgtgcaagatgatcattgatcagctccgtgaccagcgtgttgtggttgttacgcaggagtccttttattatggattgacggatgaagaattagtccatgtccatgattataactttgatcacccagatgcatttcatacagagctacttctctcttgtatgcaaaacttgaaacgtggcaaagctgtcgacatccctaattacaacttcaagacatacaagagtgtcccaaatgcaaggaaggttaatccatcggatgttattattttggaaggaattctagtttttcatgactcgcgcctcagggatttgatgaacatgaagatcttcgttgatacagatgctgacgtacggttaacaaggaggatccgtcgtgataccattgacaagggtagagatatcaaagctgtgttagatcagtactcaaaatttgttaagcctgcttttgaagacttcatcctcccaacaaagaagtatgctgatattatcatcccacgaggtggagacaatgatgtggcaattgacctaattgttcagcatattcggactaaacttggacaacatgatctttgtaaaatacaccccaatttgtatgtaattcagactacttatcagatacgaggcatgcacacaataataagggatgctgccacagcaacacatgatttcatattttatgctgatcggttgattcgattggttgtcgaacatggtcttggtcatcttcctttccaggaaaagcaggtcatcactccgactggatctgtttacactggtgtggagttctccaaaaggttgtgtggtatctcagtgatcaggagtggcgaaagcatggagaatgcactacgggcatgctgtaaaggtataaagattgggaagattcttattcatcgggaaggagacaatggacaacagctcatctatcaaaatttaccaaaagatattgcaaataggcatgttctgctgttggaccccatattgggaacaggaaattcagcagttcaagccatctcccttttattgaagaagggtgtacaggaagcaaatattatatttcttaatcttatttcagcgccccaaggagtgcatgtggtgagcaagagattccctagagtgaagatcgttacttcggagattgagtttggtctaaatgatgatttccgtgtcgtacctgggatgggcgaatttggagacagatactttggaacagatgattatcagtcattgacgccattcttctgtgacgataaaaatcgtgtcaggagggtttag

SEQ ID NO: 20841 - protein, 521 aa, Sorghum bicolor
  misc_feature: Ceres ANNOT ID no. 8670847
  misc_feature: Up-regulated in root tissues in response to salicylic acid treatment
  misc_feature (77)..(502): SWISSPROT Homolog: EC 2.7.1.48 Uridine kinase
  misc_feature (85)..(271): Pfam ID: PRK Pfam Description: Phosphoribulokinase / Uridine kinase family
  misc_feature (316)..(463): Pfam ID: Pribosyltran Pfam Description: Phosphoribosyl transferase domain
MEEKFARLSCIPFHEVVGRQNNATNQHGAYMGSKSVDEVLDAAAAAGVHYSALRLDGLNTQVSAASYEEQPTTSGLENGHQEPFVIGVAGGASSGKSTVCKMIIDQLRDQRVVVVTQESFYYGLTDEELVHVHDYNFDHPDAFHTELLLSCMQNLKRGKAVDIPNYNFKTYKSVPNARKVNPSDVIILEGILVFHDSRLRDLMNMKIFVDTDADVRLTRRIRRDTIDKGRDIKAVLDQYSKFVKPAFEDFILPTKKYADIIIPRGGDNDVAIDLIVQHIRTKLGQHDLCKIHPNLYVIQTTYQIRGMHTIIRDAATATHDFIFYADRLIRLVVEHGLGHLPFQEKQVITPTGSVYTGVEFSKRLCGISVIRSGESMENALRACCKGIKIGKILIHREGDNGQQLIYQNLPKDIANRHVLLLDPILGTGNSAVQAISLLLKKGVQEANIIFLNLISAPQGVHVVSKRFPRVKIVTSEIEFGLNDDFRVVPGMGEFGDRYFGTDDYQSLTPFFCDDKNRVRRV

SEQ ID NO: 20842 - DNA, 5499 bp, Sorghum bicolor
  misc_feature: Ceres ANNOT ID no. 8670864
  misc_feature: Down-regulated in root tissues in response to methyl jasmonate treatment
  misc_feature: Encodes the peptide sequence at SEQ ID NO 20843
atggaaacacgcagcagcagtcgcaagcgcgcagcggccgccgcctcctcgtccgcctccaagcgcccccgccgcaactcctcctcctcctcctcctcagcgccgccgccgatggaaccctcgccctcctcccgccgccgctcccgcgccgccgccgccgccgacaagggcaaggaccccgacccctcctcctccgaccacccttctcccccggtccccgacgaagacgccgatgtgcccttcccccagtccttcacctccgccagcaccgccctccagggccttctccgcaggctcggcgccggcctcgacgacctcctcccctcctcctcctcagcgccctcctccgccacgtccggtcacctcaagaggatcctcgccggcctccaggcgcacggcgacgagtcgcgccagctccagtccctcatgcagctctgcgagatgctctccatcggcaccgaggactcgcttgccgccttcccagtcgacgccttcgtcccaatcctcgtcgggatgctcggccgcgaggacgagcctgccaccgctggtgccagcccagacgtcatgctgctcgctgcgcgggcactcgccaacctcgttgatgtgctcccctcctcctgctctgcggtcgtgcactacggggccatacagtgcttctgtgctcgactgctcaccatagagtacatggacctcgccgagcagtctctacaagcccttaagaagatctctctggagcacccaaccgcctgtttgcgagctggtgcgctaatggccgttctatcgtaccttgacttcttctccactggggttcagagggtagccttgtctactgctgcaaatatttgcaggaagctgccgtccgatgcttctgagtttgtcatggaagctgtccccttgctcacaaatctcctaaatcaccatgattccaaggtactggagcatgcttctgtttgtttgacacgcattgctgaagcttttgcccattaccccgacaaacttgatgaactctgcaatcatggattagttgctcaagctgctagcttgatagctgttggcaactcctctggccaggcgtcactgagtacatccacatatacaggcttaatccgtcttctctcaatatgtgcgagtggatccctgctggcagttaaaacactacttcttcttgggatcagcggcactcttaaagacattctttctggctctgctttgatttctggagcatcagtctcccctgctgtaacaaggcctgctgatcagatgtttgagattgtgagccttgctgatgatttacttccgcatatgcctgccagaatcattaagttaccaacatactaccatgcatataaaggctcttcaacaaagaaatctgcttccatcaaacaagagggggctggttcaacaggaaatgaaaggtctggccgtgagaggctattgcgtgagcaacctgagctcctacaacagttcggtatggatttgttacccacaatgacacaggtgtatggttctagtgtaaatgcaccaatacgtcacaagtgtttatcgatcattgggaagttaatgtactacagctccgctgagacaatccagtctctccttggcacaacaaacatatccagcttccttgcaggcattcttgcatggaaagatcctcaagtgttgattcctgctcttcagatagcagaaataatgatggaaaagcttccagaggcattttccaagctgtttgtgagggaaggtgtcgttcatgccgtggagtcacttatatgttcggaatcctccaacacaatgccttctcaggtgccacctcaggataaagataatgattctgccatgccatcacgtcctagacgtcaacgccggcgtgggggtgctgtggcagcagaaaatagttcattagatgaatcaaatagttccaaccttggggttacatgctcaacaacaatcacttcagaagctccaaataccagccttcgtttggcagttagcgatcatgcaaagtctttcaaagataaatacttcccggcagacactgattcaagtgatattggggttactgatgaccttcttaaactgagggcactctgtgcaaagttgaatactgtatctgagaatgtcaaaacaaaagccaaagggaaatcaaaagctataagcgctaattttttggacatctcaattgatgtcgaagaacaattagacaaaataatatctgaaattctctctgagcttagcaaagttaatggtgtttccacatttgaattcattagaagtggtgttgtcacagcattgcttgactatttgtcctgtgggacatttgggaaggaaaaggtatctgaaggaaacctacctcagcttcgtcagcaggtccttaggcgatacaagtccttcatatcggttgccctttctattgatcatgaacgggatgaaactcccatggcactgttggttcagaaactgcaaagtgcattgtcttcgctggaacgtttccctgttgtgctcagccagtctagtaggattggtattggagggtcccgtttgacttcaggtcttagtgctctggctcaacccttcaagcttcgtctgtcccgagctcaaggcgaaaaatcacttcgggattattcatcaaatattgtgcttatcgatccatttgccagtctagcagctgttgaagaattcctttggcccagagttcaacgcggtgaggttccgtcgaagcctataattccatctggtaataattctgaatctggggttcctggcaccacagctggtgcgtcattaacagctgcaatggctcaatctggtcggcgtccaacaacaagatcaaagtcgtctgctgcaggggttggtacatctaagaaggattctcatgatgaaagcactagtactgccaaagggaaaggcaaagctattgtaaagccaaactcagatgaatcaaaaggacctaatacaaggaatgctgcccgccaaaaatctgcttcagagaaagattcggaaatgaagcgagctcagggccacagtagttctgaggatgaagagcttgacacatctcctgttgagattgatgatgctttgatgattgatgatgatgacatttcagatgatgacgacgacgacgacgacgacgatgatcatgaggttctccaagaagggtctcttccaatctgttctcaagatggtgtgcatgatgtgaaactgagtgatgctgatgagtgtaacattggctcagccagttttagccaggcgcagccatcatctggttctggtgctagaaacacttctagcagggtaccggattctactgaatttcgaagtacaagcacattcggttcaagaggtgcaatgtcatttgttgctgcgacaatggctgggctggcttctgttggtggtcgcagtgttagaggtggccgagatcggcgtggtctgtcacttggaggtagcatgaatgatcacaataaacttatattcactgctggtgggaagcagcttagcaaacatttgactgtatatcaagctatccaacgtcaacttatgctcgacgaggatgatgaagaaaggtttaatggatctgatataccgaacgatggaaaccgtttctggggtgatgtgttcacaataacgtaccagaaggctgataaccaagttgagaagggatgccaagggacttccacctcattaaacataaaatcagattcatacaggtccatctctgaagcacaaggtgtttctcttcttgatagcatcttacaaggagaacttccttgtgatcttgagagaacaaactcaacatacaacattttagcattattgcgtgtactggaggggcttaatcagttatcctctcgtttaagactacagggagcatctgatgattttgctgagggaaaaatcactaccttggatgagctatatagaactggagccaaggtaccttctgaagtgtttgtcaatagcaaattgacaccaaagcttgctcggcaaatgcaggacgttctcgcactatgtagtggcagtttaccttcttggtgttatcaaatgaccaaggcctgcccatttctgtttccttttgagacaaggaggcagtacttctattccacagcctttgggttgtcgcgagcattgaatcgacttcagcaacagcagagtgacaatcacagctctggtggtgaaagagaggtccggtttggcaggttacaacgtcagaaagttcgtgtttcccgtaaccgtattctagattctgctgctaaagttatggagatgttctccagtcagagggctgttcttgaggtggaatactttggcgaagttggaactgggctggggcctactttggagttttatactctcttaagccatgaactacaaagtgctcaactgggattatggagatctagttcatatgattcaggattgcacattgataggaaggatgtgattagtttagatcctgaagatgactcatcaggaaaaggacccaacacagatctaccaggtgatggcaggcatttgatacaagctcctcttggattgttccctcgaccttggccacctaaagttgatgcttcagaaggtagcagattgttcaaagttttggagcatttccgcttaataggtcaagtgatggcaaaagtcctgcaagatggcagacttttagatttgcctttatcaacagcattttataagcttatacttggacaggaacttgatttgtttgacatagtctcatttgattctgagtttgggaagacattgcaagaactgcgagttcttgttgaacgaaagcagttccttgaatccacttgtggcaagaatcagctacaagttgcagatttgcgtttccatggtgcttctattgaagatttgtgtttagattttactcttccaggttatcctgattatgtgctcaaagagggggaaggaagcacaattgttaatatttacaatttagaagagtatattactttggtagtggatgctacagttaagtcagggataaagcgacaggttgaggcatttagatcagggtttaatcaggtgtttgacatgtcatccctccacatattttcacctcaagaacttgactatctaatatgtggccgacaagaaatttgggagttggaatcgctggtggataacataaaatttgatcatggatacactgctaaaagtcctgcgatcgttaatctacttgagattttgtcggaattcacccctgagcagcagcatgcgttctgccagtttgtaactggtgctcctcgtcttccacccggtggattggcagcccttaatcctaagcttactatagttaggaagcacccttcaagtgctgtgaatacttcaaattcaactggggcgacagagtcagctgatgatgatttacctagtgtgatgacatgcgccaattatctgaagcttcccccgtactccacaaaagaaatcatgcgcaagaagttgctttatgcgatcctggaaggccgaggatcgtttgatctttcataa

SEQ ID NO: 20843 - protein, 1832 aa, Sorghum bicolor
  misc_feature: Ceres ANNOT ID no. 8670864
  misc_feature: Down-regulated in root tissues in response to methyl jasmonate treatment
  misc_feature (1448)..(1832): Pfam ID: HECT Pfam Description: HECT-domain (ubiquitin-transferase)
METRSSSRKRAAAAASSSASKRPRRNSSSSSSSAPPPMEPSPSSRRRSRAAAAADKGKDPDPSSSDHPSPPVPDEDADVPFPQSFTSASTALQGLLRRLGAGLDDLLPSSSSAPSSATSGHLKRILAGLQAHGDESRQLQSLMQLCEMLSIGTEDSLAAFPVDAFVPILVGMLGREDEPATAGASPDVMLLAARALANLVDVLPSSCSAVVHYGAIQCFCARLLTIEYMDLAEQSLQALKKISLEHPTACLRAGALMAVLSYLDFFSTGVQRVALSTAANICRKLPSDASEFVMEAVPLLTNLLNHHDSKVLEHASVCLTRIAEAFAHYPDKLDELCNHGLVAQAASLIAVGNSSGQASLSTSTYTGLIRLLSICASGSLLAVKTLLLLGISGTLKDILSGSALISGASVSPAVTRPADQMFEIVSLADDLLPHMPARIIKLPTYYHAYKGSSTKKSASIKQEGAGSTGNERSGRERLLREQPELLQQFGMDLLPTMTQVYGSSVNAPIRHKCLSIIGKLMYYSSAETIQSLLGTTNISSFLAGILAWKDPQVLIPALQIAEIMMEKLPEAFSKLFVREGVVHAVESLICSESSNTMPSQVPPQDKDNDSAMPSRPRRQRRRGGAVAAENSSLDESNSSNLGVTCSTTITSEAPNTSLRLAVSDHAKSFKDKYFPADTDSSDIGVTDDLLKLRALCAKLNTVSENVKTKAKGKSKAISANFLDISIDVEEQLDKIISEILSELSKVNGVSTFEFIRSGVVTALLDYLSCGTFGKEKVSEGNLPQLRQQVLRRYKSFISVALSIDHERDETPMALLVQKLQSALSSLERFPVVLSQSSRIGIGGSRLTSGLSALAQPFKLRLSRAQGEKSLRDYSSNIVLIDPFASLAAVEEFLWPRVQRGEVPSKPIIPSGNNSESGVPGTTAGASLTAAMAQSGRRPTTRSKSSAAGVGTSKKDSHDESTSTAKGKGKAIVKPNSDESKGPNTRNAARQKSASEKDSEMKRAQGHSSSEDEELDTSPVEIDDALMIDDDDISDDDDDDDDDDDHEVLQEGSLPICSQDGVHDVKLSDADECNIGSASFSQAQPSSGSGARNTSSRVPDSTEFRSTSTFGSRGAMSFVAATMAGLASVGGRSVRGGRDRRGLSLGGSMNDHNKLIFTAGGKQLSKHLTVYQAIQRQLMLDEDDEERFNGSDIPNDGNRFWGDVFTITYQKADNQVEKGCQGTSTSLNIKSDSYRSISEAQGVSLLDSILQGELPCDLERTNSTYNILALLRVLEGLNQLSSRLRLQGASDDFAEGKITTLDELYRTGAKVPSEVFVNSKLTPKLARQMQDVLALCSGSLPSWCYQMTKACPFLFPFETRRQYFYSTAFGLSRALNRLQQQQSDNHSSGGEREVRFGRLQRQKVRVSRNRILDSAAKVMEMFSSQRAVLEVEYFGEVGTGLGPTLEFYTLLSHELQSAQLGLWRSSSYDSGLHIDRKDVISLDPEDDSSGKGPNTDLPGDGRHLIQAPLGLFPRPWPPKVDASEGSRLFKVLEHFRLIGQVMAKVLQDGRLLDLPLSTAFYKLILGQELDLFDIVSFDSEFGKTLQELRVLVERKQFLESTCGKNQLQVADLRFHGASIEDLCLDFTLPGYPDYVLKEGEGSTIVNIYNLEEYITLVVDATVKSGIKRQVEAFRSGFNQVFDMSSLHIFSPQELDYLICGRQEIWELESLVDNIKFDHGYTAKSPAIVNLLEILSEFTPEQQHAFCQFVTGAPRLPPGGLAALNPKLTIVRKHPSSAVNTSNSTGATESADDDLPSVMTCANYLKLPPYSTKEIMRKKLLYAILEGRGSFDLS

SEQ ID NO: 20844 - DNA, 3897 bp, Sorghum bicolor
  misc_feature: Ceres ANNOT ID no. 8670899
  misc_feature: Up-regulated in shoot tissues in response to salicylic acid treatment
  misc_feature: Encodes the peptide sequence at SEQ ID NO 20845
atggactcctcctcccccttctcccctgacgaccagaccgacgccgacttcttcgacaagctcgtcgacgacgacgacgaccccgccccgccgcccgccaccgacttgcctcggcccgtctccgccaccagcctcaacgctgcagacgacccacccgccccggagccgcagcctccggtgccggcgcctcccgaggggtcaggcaagggcggagccggcgtccacaccgcggtcaagcaggtgcagtgggcctccttcggaggtggcgcggacgacggtcctgatccgttcgctgatctctcgggaggcgccggcgacgacgacggcttcctcgggagcacggccgggacccagacggcctcgggtcaggacttcttcgctgggaccaactcctcctccgatcagcagaatgtcaatggtcagcacgatcagggaggtggcaccagcactgcagtggacccagcagatcccaagtcttgggaggccatgtaccctgggtggaagtacgacgaggcatcgcagcagtggtaccagcttgatggcagtgtaaattcaaccgggaatgcagctcaggtgctggagaatagcaatcagaatgcgcagcagcagctcaacacgtcttacctgcacaattcgtcgcatgcggggctcgagacaattgctgaggagggcactgccgcagccggtgctgtctcaagttggggccaaggggccgcctcagagtacccacccaacatgctcttctacgcagaataccctggttggtactttgacaccaacactcagcagtggcactcgcttgagtcgtaccagcaggctgctatgcaggctggaacagctagcacgggtcagactgttgttgcaaacgatgttgttgctgcgaattcctcctcgctgacaggctataatgctgcacaaactgaggatgttgctgcccacaatcaggtgacccatcacaattcattctcaaatagttacagtacaagtttcaaggcatttgaaccctcttcatctcaacatgctggttacaagggttcccaacctaactacacgggatttgacagttctgcaaaccaccatggttatggtgatgccaatggtgttgtgagtactcaaggctttgtcccaatgcaaaccacgtaccaaggccagaaacaagtaaatgcaacctcgcaagggcacctgtcaaatagttattttggtactgaaaactccatgaactttaatcagcaacaatttctgggtgcaaatgcgtcaaacttgcaattcgatcactccccacatgaaggcaggtcatcggctggtcgaccaccgcatgcccttgttacttttgggtttggagggaagctcatagttttgaaagaaactagctccatgcccgcaagctttaacactggaaatcagttcaagggtaactctagtagcacagtttcagttcttaatctgtcggaggtggtcattgatagagttgatccttcaagcatcactaatggtagtgcacttagttatttccatgctctgtgccatcaacctgttcctggccctctggttggtggaagtgctgcatcaaaggatgtaaataagtggcttgatgaaatgattgcatggtacgagtcttcctctagtgaattccagaaaggtgatactcgcaagttgcttatttcattgttgaagatactatctcagcactatggaaaactccgttcaccttttgcgtctgacccattgcaagaggagacaaatggtccagaaatggcagtaactaagctattttcatcgtgtaagagaagcactgctcatatgggagattatggatccattgttccgtgcatgaaaaatattgcttcagaaagtcagatgcaggctgttgcacaagaggtgcaaagtcttctagtttctgggagaagaaaagaggcccttcagtgtgcccagagaggtcaactttggggacctgcaatcatactggcattgcagcttggtgatcagttttatgtggatacagtgaagaaaatggctcacttccattttgtatctgggtcccctctgcgaacgctatgccttctcattgctggacaacctgcagatcctggtcctaatggtatgttggatgattgggaggagaatttggctataattactgcaaacagaacgaaaggtgacgatctagtaatcacccatcttggtgattgcctctggaaagaaaaatatgaggttgcagctgcccattcatgctatttagttgctgaactaaatattgattcatactcggaaagtgcaaggttatgcctcattggtgcagaccacttgaagtgtcctcgaacatttgccagccctgaagccattcagaggacagaggtttatgaatacgcgaaggtgcttggtaattctcagtatattctactaccctttcagccatataagctgatatatgcatacatgcttgtggatgtggggaaggtttctgattctttgaggtattgccaagcatctatgaaggtgctgaaagcctctggtggtgcccctgaattggaggtgtggaaacaattattttcttcactggaggagaggatacgcactcaccagcagggtggatatggaacaaatcttgccccagcaaaactagttgggaagatttttacctcgcttgataaatctatatcccacatgatgggtacaccatctgcaccacttccaccattaccacatggatctgttagtgatagagagagccactctatgcctgcagcagcaaaatttggaaatagccaatcggcaatggccatgtcatcgttaatggcatctgcttcaatgcagtcaatgactgagatagcagagaatagtggtggcactggcaggacaattgcacagaacagaagtgtttctgagccggagttcggtagaacatcaaaacagggtgctggatcagatggcacacagagtagtgcatcaggatctggtagttctcgatttggttggctagtgcagaagactatggatttagtgtcgaaatcccaccgccaggcaaaattaggggatcagaacaaattttactatgatgaaaagttgaagcggtgggtggaagaaggtgctgctgttcctgccgaggagcctcctcttcctccacctccaacaaaaccatctttccagaatggtatgccagaccataagttgaatggccccgtgagtgtaaaccatgctcccaatggagtcacagaatggaaatcctcaaattcttcggatcaaggaggtctgggtatgcctccaattccacctagccaaaaccagttttctgctcgtggacggatgggtgtccggtccagatatgttgacacattcaataaatcgggtgcgtctggagcagtgccatcatataacaaaccagctgctccatctgtgacaccaccagctggtgccaagttcttcatgccgactgcagcacctgctgctgcagatcagatggtgccacaccaagcggcagagatacacagtgaaaccatccatcaggatgagcggtcagcctcaccaccagcagaaacatcaatttcttcaaccccaccacccacacaattttcatcacccccaccgcacttgcaattttcatcaccaatgcaatcaacaattcatcggcaatctagtatggagaatatctccaccccttacctgggttctggggtatcatcattaagcagcagcagctcattctcaaaatcacgagccgcatcctggagtgggacatactctgagcagtatagtgcttttgcgggcactcaatcacctgacagacagacgatgccttcaccactcatgcctggcaaaccatcacacagtcgttccaacagcaactcatcactgcagctcaatggattggcagaggatcttcatgaggttgagctctaa

SEQ ID NO: 20845 - protein, 1298 aa, Sorghum bicolor
  misc_feature: Ceres ANNOT ID no. 8670899
  misc_feature: Up-regulated in shoot tissues in response to salicylic acid treatment
MDSSSPFSPDDQTDADFFDKLVDDDDDPAPPPATDLPRPVSATSLNAADDPPAPEPQPPVPAPPEGSGKGGAGVHTAVKQVQWASFGGGADDGPDPFADLSGGAGDDDGFLGSTAGTQTASGQDFFAGTNSSSDQQNVNGQHDQGGGTSTAVDPADPKSWEAMYPGWKYDEASQQWYQLDGSVNSTGNAAQVLENSNQNAQQQLNTSYLHNSSHAGLETIAEEGTAAAGAVSSWGQGAASEYPPNMLFYAEYPGWYFDTNTQQWHSLESYQQAAMQAGTASTGQTVVANDVVAANSSSLTGYNAAQTEDVAAHNQVTHHNSFSNSYSTSFKAFEPSSSQHAGYKGSQPNYTGFDSSANHHGYGDANGVVSTQGFVPMQTTYQGQKQVNATSQGHLSNSYFGTENSMNFNQQQFLGANASNLQFDHSPHEGRSSAGRPPHALVTFGFGGKLIVLKETSSMPASFNTGNQFKGNSSSTVSVLNLSEVVIDRVDPSSITNGSALSYFHALCHQPVPGPLVGGSAASKDVNKWLDEMIAWYESSSSEFQKGDTRKLLISLLKILSQHYGKLRSPFASDPLQEETNGPEMAVTKLFSSCKRSTAHMGDYGSIVPCMKNIASESQMQAVAQEVQSLLVSGRRKEALQCAQRGQLWGPAIILALQLGDQFYVDTVKKMAHFHFVSGSPLRTLCLLIAGQPADPGPNGMLDDWEENLAIITANRTKGDDLVITHLGDCLWKEKYEVAAAHSCYLVAELNIDSYSESARLCLIGADHLKCPRTFASPEAIQRTEVYEYAKVLGNSQYILLPFQPYKLIYAYMLVDVGKVSDSLRYCQASMKVLKASGGAPELEVWKQLFSSLEERIRTHQQGGYGTNLAPAKLVGKIFTSLDKSISHMMGTPSAPLPPLPHGSVSDRESHSMPAAAKFGNSQSAMAMSSLMASASMQSMTEIAENSGGTGRTIAQNRSVSEPEFGRTSKQGAGSDGTQSSASGSGSSRFGWLVQKTMDLVSKSHRQAKLGDQNKFYYDEKLKRWVEEGAAVPAEEPPLPPPPTKPSFQNGMPDHKLNGPVSVNHAPNGVTEWKSSNSSDQGGLGMPPIPPSQNQFSARGRMGVRSRYVDTFNKSGASGAVPSYNKPAAPSVTPPAGAKFFMPTAAPAAADQMVPHQAAEIHSETIHQDERSASPPAETSISSTPPPTQFSSPPPHLQFSSPMQSTIHRQSSMENISTPYLGSGVSSLSSSSSFSKSRAASWSGTYSEQYSAFAGTQSPDRQTMPSPLMPGKPSHSRSNSNSSLQLNGLAEDLHEVEL

SEQ ID NO: 20846 - DNA, 1449 bp, Sorghum bicolor
  misc_feature: Ceres ANNOT ID no. 8671011
  misc_feature: Down-regulated in shoot tissues in response to methyl jasmonate treatment
  misc_feature: Up-regulated in root tissues in response to methyl jasmonate treatment
  misc_feature: Up-regulated in shoot tissues in response to aminocyclopropane carboxylic treatment
  misc_feature: Up-regulated in root tissues in response to aminocyclopropane carboxylic treatment
  misc_feature: Up-regulated in shoot tissues in response to salicylic acid treatment
  misc_feature: Down-regulated in root tissues in response to salicylic acid treatment
  misc_feature: Down-regulated in root tissues in response to methyl jasmonate treatment
  misc_feature: Down-regulated in shoot tissues in response to salicylic acid treatment
  misc_feature: Down-regulated in shoot tissues in response to aminocyclopropane carboxylic treatment
  misc_feature: Down-regulated in root tissues in response to aminocyclopropane carboxylic treatment
  misc_feature: Encodes the peptide sequence at SEQ ID NO 20847
atgcaattccgtccgtcgagcacccactacacgactgtgactacaactaacgccagagctctgacggtgggcccgcgcgggccgatcctgctggaggactaccacctgatcgagaaggtggcgcacttcgcccgggagcgcatcccggagcgcgtcgtccacgcgcgcggcgcctccgccaagggcttcttcgagtgcacccacgacgtggcgtcgctgacctgcgccgacttcctccgctccccgggcgtccggacccccgtcatcgtccgcttctccacggtgatccacgagcgcggctcgccggagacgatccgcgacccgcgcgggttcgccgtcaagttctacaccagggagggcaactgggacctcctgggcaacaacttccccgtcttcttcatccgcgacgggatcaagttccccgacgtgatccacgcgttcaagcccaacccgagatcgcatgtgcaggagtactggcgcgtgttcgattttttgtcgcatctccccgagagcctccacaccttcttcttcctcttcgacgacgtcggcgtgccgacggactaccgccacatggaaggcttcggcgtcaacacctacaccttcgtcaacgccgccggcaagtcccactacgtcaagttccactggaagccgacgtgcggcgtccggagcatcctcaccgacgaggaagcggcgttggtcggcgggaggaaccacagccacgccacgcaggacctctacgactccatcgccgccggcagcttcccggagtggaagctgttcgtgcaggtgatggacccggacacggaggaccagtacgatttcgacccgctcgacgacaccaagacatggccggaggatctgctgccactccagcccgtggggaggctggtgctggacaagaacgtggacaatttcttcaacgagaacgagcagctggcgttcggaccggggctggtggtgccggggatctactactccgacgacaagatgctgcagtgccgggtgttcgcgtacgccgacacgcagcgctacaggctggggcccaactacctgatgctcccggtgaacgcgccgcgatgcgcgcaccataacaaccactacgacggcgccatgaacttcatgcaccgggacgaggaggtggactactacccgtccaggcacgcgccgctccggcaggcgccgccggtgccgatcccggcgaggccggtggtggggaagaggcagaaggagaccatacggaagccgaatgatttcaagcagcctggggagaggtaccggagctgggacgccgatcggcaggagaggtttgtgcggcggtttgctgactcgctggggcatccaaaggttagccaggagctcaggtccatctggatcgacctcctctcaaagtgcgacgcatcgctggggatgaagattgccacacggctcaacatgaagccaaacatgtga

SEQ ID NO: 20847 - protein, 482 aa, Sorghum bicolor
  misc_feature: Ceres ANNOT ID no. 8671011
  misc_feature: Down-regulated in shoot tissues in response to methyl jasmonate treatment
  misc_feature: Up-regulated in root tissues in response to methyl jasmonate treatment
  misc_feature: Up-regulated in shoot tissues in response to aminocyclopropane carboxylic treatment
  misc_feature: Up-regulated in root tissues in response to aminocyclopropane carboxylic treatment
  misc_feature: Up-regulated in shoot tissues in response to salicylic acid treatment
  misc_feature: Down-regulated in root tissues in response to salicylic acid treatment
  misc_feature: Down-regulated in root tissues in response to methyl jasmonate treatment
  misc_feature: Down-regulated in shoot tissues in response to salicylic acid treatment
  misc_feature: Down-regulated in shoot tissues in response to aminocyclopropane carboxylic treatment
  misc_feature: Down-regulated in root tissues in response to aminocyclopropane carboxylic treatment
  misc_feature (2)..(482): SWISSPROT Homolog: EC 1.11.1.6 Catalase
  misc_feature (15)..(391): Pfam ID: Catalase Pfam Description: Catalase
MQFRPSSTHYTTVTTTNARALTVGPRGPILLEDYHLIEKVAHFARERIPERVVHARGASAKGFFECTHDVASLTCADFLRSPGVRTPVIVRFSTVIHERGSPETIRDPRGFAVKFYTREGNWDLLGNNFPVFFIRDGIKFPDVIHAFKPNPRSHVQEYWRVFDFLSHLPESLHTFFFLFDDVGVPTDYRHMEGFGVNTYTFVNAAGKSHYVKFHWKPTCGVRSILTDEEAALVGGRNHSHATQDLYDSIAAGSFPEWKLFVQVMDPDTEDQYDFDPLDDTKTWPEDLLPLQPVGRLVLDKNVDNFFNENEQLAFGPGLVVPGIYYSDDKMLQCRVFAYADTQRYRLGPNYLMLPVNAPRCAHHNNHYDGAMNFMHRDEEVDYYPSRHAPLRQAPPVPIPARPVVGKRQKETIRKPNDFKQPGERYRSWDADRQERFVRRFADSLGHPKVSQELRSIWIDLLSKCDASLGMKIATRLNMKPNM

SEQ ID NO: 20848 - DNA, 1779 bp, Sorghum bicolor
  misc_feature: Ceres ANNOT ID no. 8671067
  misc_feature: Up-regulated in root tissues in response to methyl jasmonate treatment
  misc_feature: Up-regulated in shoot tissues in response to methyl jasmonate treatment
  misc_feature: Up-regulated in shoot tissues in response to salicylic acid treatment
  misc_feature: Up-regulated in root tissues in response to salicylic acid treatment
  misc_feature: Encodes the peptide sequence at SEQ ID NO 20849
atggaaggcaccgtgctgtgcgcggccaaccacgcgccgctcacgcccatcagcttcctcgagcgcaccgcgctcgtctaccccgaccgccccgccgtcgtcgccgccggccacgccgccgcgcagccgccgcctcgcacctggcgggagacccgggaccgctgcctccgcctcgccgccgcgctcgcggggctcggcgtcgcgcgccgcgacgtggttgcggtgttcgcgcagaacattccggccttctgcgagctccacttcggcattcccatggccggcgccgtcatctgcgcgctcaactcgcgcctcgacgccggcatggcgtccgtgctgctgcagcactcggaggccaaggtcgtctttgtcgacgccgcgctgctcggcgtcgcgcgagaagcgctccgcctcatctcccagcaggccgccgccgccagagcaagctgcagggtgcccaccgtggtgctaatcaacgaggtcctcgacgagccgctgtcggcggcaacaggagacaacaaaatcccaggcgtcgatcggtgctacgagtacgaggccctcctcagcagcagcagcagctgcaatccagaggagttcttgatccggtggccggtcgacgagaacgagcccatcgcgctcaactacacgtcggggacgacgtcgcggcccaagggcgtggtgtacacccaccgcggggcgtacctgaacacgctggcgtccgtgctgctcaacgacatgacggcgctgccggtctacctgtggacggtgcccatgttccactgcaacgggtggtgcctggtgtggggcgtggcggcgcagggcggcaccaacgtgtgcctccgcaaggtcacctccgccgccatcttcgccgccgtcgcggcgcacagggtcacgcacatgggcggcgcgccgaccgtgctgaacatggtggtcaacgccacggcggaggagaggcggcctctgaaagcgggcgggaagccggtgacggtgatgacgggcggcgcgccgccgccaccacaggtgctgttccggatggaggagctggggttcctggtgatccactcgtacgggctgacggagacgtacggtccggccacggtgtgcacgtggcggccggagtgggacgcgctgccggcagcggagcgcgcggcgatcaagtcccggcaggggctccaccacctgggtctagaggtggacgtgaaggacccggcgacgatggcgagcgtgcccgccgacgggcgcaccatgggggaagtcatgttccgtggcaacacggtgatgagcgggtactacaaggacgcggcggcgacggcggaggccatggcgggcgggtggctacgttccggagacctcgcggtgcggcacgccggcgacgggtacgtgaagatcctggaccggtccaaggacatcatcatctcgggcggggagaacatcagcaccatcgaggtggaggcggcgctgttcgcgcacccggccgtggcggaggccgccgtggtcgggcggcccgacgagtactggggcgagacgccgtgcgcgttcgtgacgctcaaggagggcaaggacgtgggcgcggaggaggtcatggcgttctgccgcgcccggctgccccggtacatggcgccacggacggtggtgttcgtggccgagctgcctaagacggcgacggggaaggtgcagaagttcgcgctccgggaacaggccaaggccatgggcagcatctccgggtccagctccaagaagccgggagggtcaggggtagcagggacgaggagcaagctctga

SEQ ID NO: 20849 - protein, 592 aa, Sorghum bicolor
  misc_feature: Ceres ANNOT ID no. 8671067
  misc_feature: Up-regulated in root tissues in response to methyl jasmonate treatment
  misc_feature: Up-regulated in shoot tissues in response to methyl jasmonate treatment
  misc_feature: Up-regulated in shoot tissues in response to salicylic acid treatment
  misc_feature: Up-regulated in root tissues in response to salicylic acid treatment
  misc_feature (181)..(565): SWISSPROT Homolog: EC 6.2.1.3 Long-chain-fatty-acid--CoA ligase
  misc_feature (47)..(497): Pfam ID: AMP-binding Pfam Description: AMP-binding enzyme
MEGTVLCAANHAPLTPISFLERTALVYPDRPAVVAAGHAAAQPPPRTWRETRDRCLRLAAALAGLGVARRDVVAVFAQNIPAFCELHFGIPMAGAVICALNSRLDAGMASVLLQHSEAKVVFVDAALLGVAREALRLISQQAAAARASCRVPTVVLINEVLDEPLSAATGDNKIPGVDRCYEYEALLSSSSSCNPEEFLIRWPVDENEPIALNYTSGTTSRPKGVVYTHRGAYLNTLASVLLNDMTALPVYLWTVPMFHCNGWCLVWGVAAQGGTNVCLRKVTSAAIFAAVAAHRVTHMGGAPTVLNMVVNATAEERRPLKAGGKPVTVMTGGAPPPPQVLFRMEELGFLVIHSYGLTETYGPATVCTWRPEWDALPAAERAAIKSRQGLHHLGLEVDVKDPATMASVPADGRTMGEVMFRGNTVMSGYYKDAAATAEAMAGGWLRSGDLAVRHAGDGYVKILDRSKDIIISGGENISTIEVEAALFAHPAVAEAAVVGRPDEYWGETPCAFVTLKEGKDVGAEEVMAFCRARLPRYMAPRTVVFVAELPKTATGKVQKFALREQAKAMGSISGSSSKKPGGSGVAGTRSKL

SEQ ID NO: 20850 - DNA, 1623 bp, Sorghum bicolor
  misc_feature: Ceres ANNOT ID no. 8671126
  misc_feature: Down-regulated in root tissues in response to methyl jasmonate treatment
  misc_feature: Encodes the peptide sequence at SEQ ID NO 20851
atggttgctgcacctgcgcgcatcatcttctccttctcctctgtggagcctcttctcattgcagcttcgccggcagcagctagaaacagccggcaaggccgccaccgtggccaattcatccgccctttggcggcatccaacactctgctgggcaatgattttgatctccaggagggcctgacggacgtccaaaagattcttcatcaacgtcaaaagagcaaccgggagatgatggtcaccatcgataacctcaagcgcctctgcgtcgaccactacttcgaagaagagatcgagagcgccatgagtgcttgcatgaatctcgtccacagcaatgatctcttcgatgcaacccttgcattcaggctcctgagagaggcaggctatgatgtttcagcaaaagatgatgttttatggaggttcactgacaacagcggcgaattcaagcttcctcttagcaaggacatccgagggctcctaagcctgcatgacatgtctcacatgaacattggaggagaggcattgctcgacaaggcaaaagagttctcaagcaagcaccttgcatctgccattaggtacctggagccaagccttgcagagtatgtgaggcagtccctggaccacccttaccacctgagcgtgatgccgtacaaagctaggcatcacctcacctacctgcagagcctgcccaccagagacacggcggtggagaaactagcaattgcagagtttcagctcaacaaattgctgcatcagaaagaaatgcaagagattaaaagatggtggatggacctaggattggctcaagaaatacctgtggtgcgggaccaggtgctgaaatggtacatgtggtccatgacagccctccaaggatattctttctccagatatcgggttgagatgacaaagataatctcgcttgtctatgttgtggacgacatatttgaccttgttggcacactagaggagtggaatactgcggctgctgattcactccctagttacatgagatcatgctacaaggctctttacaccattacaaatgagattgcagatatggctgaaaaggagcatggattgaacccagctaataatcttagaaaagcatggacggtgttgtttgatggatttatggttgaggcaaaatggctagcaaaccatcaggttcctactgcagaggattacctgagaaatggtgttgtcacgtcaggagtgccgcttacatttgtacacatattcattatgctagggtgtgatcaaaatagtgaagcactcattgaccacatgccctctgtcatctcttgcccagccaagattctccgactttgggatgacatgggcagtgcagaggatgaatctcaggaaggattcgatggatcgtataaaaatttctacctcatggagaaccctagatgcagccctactgatgcggaagcacatatgcgtagcttgatcgcaagggagtgggaggagctcaatagggagtgtttatgcacgaggaccttctcctctaacttcacacaggtctgcttgaacatcgcgagaatggtcagtgtcatgtactcgtacaacaaggaacaaaggcttcttgtccttgaggactatgcaagaatgttgatactttga

SEQ ID NO: 20851 - protein, 540 aa, Sorghum bicolor
  misc_feature: Ceres ANNOT ID no. 8671126
  misc_feature: Down-regulated in root tissues in response to methyl jasmonate treatment
  misc_feature (54)..(520): SWISSPROT Homolog: EC 4.2.3.11 Sabinene-hydrate synthase
  misc_feature (234)..(492): Pfam ID: Terpene_synth_C Pfam Description: Terpene synthase family, metal binding domain
  misc_feature (50)..(229): Pfam ID: Terpene_synth Pfam Description: Terpene synthase, N-terminal domain
MVAAPARIIFSFSSVEPLLIAASPAAARNSRQGRHRGQFIRPLAASNTLLGNDFDLQEGLTDVQKILHQRQKSNREMMVTIDNLKRLCVDHYFEEEIESAMSACMNLVHSNDLFDATLAFRLLREAGYDVSAKDDVLWRFTDNSGEFKLPLSKDIRGLLSLHDMSHMNIGGEALLDKAKEFSSKHLASAIRYLEPSLAEYVRQSLDHPYHLSVMPYKARHHLTYLQSLPTRDTAVEKLAIAEFQLNKLLHQKEMQEIKRWWMDLGLAQEIPVVRDQVLKWYMWSMTALQGYSFSRYRVEMTKIISLVYVVDDIFDLVGTLEEWNTAAADSLPSYMRSCYKALYTITNEIADMAEKEHGLNPANNLRKAWTVLFDGFMVEAKWLANHQVPTAEDYLRNGVVTSGVPLTFVHIFIMLGCDQNSEALIDHMPSVISCPAKILRLWDDMGSAEDESQEGFDGSYKNFYLMENPRCSPTDAEAHMRSLIAREWEELNRECLCTRTFSSNFTQVCLNIARMVSVMYSYNKEQRLLVLEDYARMLIL

SEQ ID NO: 20852 - DNA, 2289 bp, Sorghum bicolor
  misc_feature: Ceres ANNOT ID no. 8671134
  misc_feature: Down-regulated in shoot tissues in response to salicylic acid treatment
  misc_feature: Encodes the peptide sequence at SEQ ID NO 20853
atggagggcgtccacagcctcctggcccggcccaactccgcgccgttcgccttctcccagccgcccctccgcaggcaccacaggccgccaccgcctggcccctccgcctgccgcgccgccagccgctgggccgaccgcctcttcgccgacttccacctcctccctaccgccaccgccgccgccgacccgccggccgcggccccctcctcgtccccgttcgtcccgctcttccccgacgccgccgaccgcgccttgcccctcccggtcgacttctacaagattctcggtgcggagccacatttcctaggcgatggcattcggagggcatttgagtcgcggatagccaagccacctcagtacggctacagcacggaagctctcgttgggcgtcggcagatgctgcagattgcgcatgatactctcacaaaccagagctcccgtactgagtacgaccgtgcgctttctgaggatcgtgatgcggcactcaccatggatgttgcctgggataaggtaccaggtgtgctgtgtgtgcttcaggaggctggggaggcacaactggtgttagcaactggagagcagctgcttcaggaccgtccacctaagcggttcaagcaggatttggtgctagcaatggcattggcttatgtggacctatcaagggacgctatggcagcaagccctccagatgtaatctgttgttgtgaggtgctcgagagggcacttaagctcctgcaggaggatggtgcaagcaatcttgcacctgaactgcttgcacagattgatgaaactttggaggagattacacctcgctgtgtattggagcttcttgctcttcctactgatgaaaaacataaaaataaacgccaagaaggtctgcaaggtgcaagaaacatattgtggagtgttggccaaggtggtatcgctactgttggaggaggattttctcgtgaggccttcatgaatgaggcttttttgcagatgacatcagccgagcagatggatttcttctctaaaacaccgaatagcataccacctgaatggtttgaaatctatagtgtggcacttgcccatattgctcaagcaattgcaagtaaaaggccacaattcatcatgatggcagatgacctctttgaacaacttcagaagttcaatataggttctcaatatccttatgaaaatgagatgaaccttgcattagaacgggcactctgctcgttactggtgggagatatcagcaactgcagaatgtggcttggaattgataatgagtcctcgccatatagggaccccaaaattattgagtttgtggtgaataactctagtatcgatgaagagaatgatcttcttccagggctgtgcaagcttttggagacttggcttgtctccgaggtattcccaaggagcagagatactcgagggatgcagttcagactgggagactattatgacgacccaaaagttttaagctacttagaaaggatggaaggtggtggagcttctcatttggccgcagctgctgctatagcgaaacttggtgcccaagctactgccgcgcttggtacggtaaaatcaagtgctcttcaagctttcagcaaggttttcccattgatagaacagctagacagatcaggcaaggataccccaggtgatgatcttgagaaatctcttgaaaaacttgcccaagaaagtgttgctggagatgctatccatgattccaaaaatgccgctttgaagattatctctgctggtgcactgtttgcactatttgcagtaataggtctgaagtgcttgcctcgtaagaagtcacttcctgctcttaagagcgaatatgggtctgtggcagttgctgactctgttgatggtctgggagcagatgaagagccactagaaattcctagaatggatgcaaagttggctgaagatattgttcgcaagtggcaaagtatcaagtccaaggctttggggccagaacacactgtcacggcattgcaagagatcctcgatggcaacatgctgaaggtatggatggaccgagccacagagattgagcgtcacggttggttctgggaatacacactctccgacgtgacgatcgacagtatcaccgtctccatggacggtcgacgggcaactgtggaggcgacgattgaggagatgggccaacttaccgacgtagcagacccaaagaacaacgacgcctacgacacaaagtacaccgctcggtacgagatgagctactccaagtccggagggtggaggatcaccgaaggagcagtcctcaagtcgtag

SEQ ID NO: 20853 - protein, 762 aa, Sorghum bicolor
  misc_feature: Ceres ANNOT ID no. 8671134
  misc_feature: Down-regulated in shoot tissues in response to salicylic acid treatment
MEGVHSLLARPNSAPFAFSQPPLRRHHRPPPPGPSACRAASRWADRLFADFHLLPTATAAADPPAAAPSSSPFVPLFPDAADRALPLPVDFYKILGAEPHFLGDGIRRAFESRIAKPPQYGYSTEALVGRRQMLQIAHDTLTNQSSRTEYDRALSEDRDAALTMDVAWDKVPGVLCVLQEAGEAQLVLATGEQLLQDRPPKRFKQDLVLAMALAYVDLSRDAMAASPPDVICCCEVLERALKLLQEDGASNLAPELLAQIDETLEEITPRCVLELLALPTDEKHKNKRQEGLQGARNILWSVGQGGIATVGGGFSREAFMNEAFLQMTSAEQMDFFSKTPNSIPPEWFEIYSVALAHIAQAIASKRPQFIMMADDLFEQLQKFNIGSQYPYENEMNLALERALCSLLVGDISNCRMWLGIDNESSPYRDPKIIEFVVNNSSIDEENDLLPGLCKLLETWLVSEVFPRSRDTRGMQFRLGDYYDDPKVLSYLERMEGGGASHLAAAAAIAKLGAQATAALGTVKSSALQAFSKVFPLIEQLDRSGKDTPGDDLEKSLEKLAQESVAGDAIHDSKNAALKIISAGALFALFAVIGLKCLPRKKSLPALKSEYGSVAVADSVDGLGADEEPLEIPRMDAKLAEDIVRKWQSIKSKALGPEHTVTALQEILDGNMLKVWMDRATEIERHGWFWEYTLSDVTIDSITVSMDGRRATVEATIEEMGQLTDVADPKNNDAYDTKYTARYEMSYSKSGGWRITEGAVLKS

SEQ ID NO: 20854 - DNA, 1227 bp, Sorghum bicolor
  misc_feature: Ceres ANNOT ID no. 8671279
  misc_feature: Up-regulated in shoot tissues in response to salicylic acid treatment
  misc_feature: Encodes the peptide sequence at SEQ ID NO 20855
atgttggagggcagattgctggctcgcgcgccagatttgctatgccgccgcggatggggattattgtttcatacttcagcttcaaccatagtgagctacatcgtcaagcttgcgctcgtcgcttgcctggctttgggagcactgttacagttactgctatccatttccacagccatcgacgtgtatcgccgccgccagaaatccgacaacgtctggaagctgacaagcttccgtcgtctgaattttgacgtggaagacgtgctcaaaaacatggacggtcttgatttgattggcgtgggtgggtcaggaaaggtgcaccgcatccaactcaggcacagggatcgccagtaccggatcttggccgtgaaggagctcacgaggaagacgaggaaccagcaggctgaagatcagatgatacacttgttcgacgcggaggtgaaggtactgggcagtatccgccaccgcaacatcattaccctgctctgctgcatcaccgtcagcatctgcaccaacctgctggtgtacgagtacatggagaacgggagcttggaccagtggctgcacaagcccaggggacggctggactggccgtctagggttggcatcgccaccgacgccgcgagaggcctcagctacatgcacgacctggccatcatccaccgcgacgtcaagtccagcaacatcctgctcgaccgcgactttgaggccaagattggcgatttcggacttgcccgggttcttgccaagcctggtgaatcggagccggcgtctgtcataatgggaacacccggtcatattgctccagagtacctccgtgatgcagaggtgagtgagaaggtggatgtctacagttttggtgtggtgctgctggagctcgtcacagggaagcaaccacatgatgctggtacaaagccaggcgttggtctagcgaaatgggcatctcaacaacacaggaacagaattcgatgggatcacatcatcgacaaggatattcagaatccagcgtacgaggatgacatgaaggccgtgtttatgctcgggctccgttgcacaagtgaggacccactcaacaggcctgcgatgaataaggtcctcgagcagctcgagcagctcctttcgtgtgacccaagcagggttaaacatcgcgggtcgtttcttgcgaaggtttacaggaaaattcaagacaaaatcttcagacaaggtcaatcagcggtatccatccagtaa

SEQ ID NO: 20855 - protein, 408 aa, Sorghum bicolor
  misc_feature: Ceres ANNOT ID no. 8671279
  misc_feature: Up-regulated in shoot tissues in response to salicylic acid treatment
  misc_feature (73)..(376): SWISSPROT Homolog: EC 2.7.11.1 Non-specific serine/threonine protein kinase
  misc_feature (91)..(368): Pfam ID: Pkinase Pfam Description: Protein kinase domain
MLEGRLLARAPDLLCRRGWGLLFHTSASTIVSYIVKLALVACLALGALLQLLLSISTAIDVYRRRQKSDNVWKLTSFRRLNFDVEDVLKNMDGLDLIGVGGSGKVHRIQLRHRDRQYRILAVKELTRKTRNQQAEDQMIHLFDAEVKVLGSIRHRNIITLLCCITVSICTNLLVYEYMENGSLDQWLHKPRGRLDWPSRVGIATDAARGLSYMHDLAIIHRDVKSSNILLDRDFEAKIGDFGLARVLAKPGESEPASVIMGTPGHIAPEYLRDAEVSEKVDVYSFGVVLLELVTGKQPHDAGTKPGVGLAKWASQQHRNRIRWDHIIDKDIQNPAYEDDMKAVFMLGLRCTSEDPLNRPAMNKVLEQLEQLLSCDPSRVKHRGSFLAKVYRKIQDKIFRQGQSAVSIQ

SEQ ID NO: 20856 - DNA, 3345 bp, Sorghum bicolor
  misc_feature: Ceres ANNOT ID no. 8671308
  misc_feature: Up-regulated in shoot tissues in response to salicylic acid treatment
  misc_feature: Encodes the peptide sequence at SEQ ID NO 20857
atgtcctcctccccttccgccgccaacctgctcgcgctcctccgccgcaacgccgcctccccggccgtcgcgctccgactcttcctccacctttcctccgcggcctgccctcctccgccgcgctccacgtcgttcctcgcccgcctcgtcgccgaacaccccgccgccgacgcgctcctcccgctcctccaccgccacatcctctccttccctgatccctccccccacctcctcgcgctcctctcctgctccgacgtcctcccgctgcgcctcgccatccccgccttccgctccctccgcgcgctcacgtccgcgccgccgccgaccacccccgtctacaaccgcctcattctcgccgcgctccgcgagtcccgcctcgaccttgtcgaggcgctctacaaggacctgctcctctccggcgcccagccggacgtcttcactcgcaacctcctgctccaggcgctctgtgacgccggccgcatggagctcgcccagagggtgtttgacgcaatgcccgccaggaatgagttcagttttgggatcctggcgcgagggtactgccgtgcggggaggagcattgatgctcttaaggtactcgacggaatgccgagcatgaacctggtggtttgcaacacggtggtcgcagggttctgcaaggagggcctggtggaggaggctgagaggctggtggaaaggatgcgtgtgcaagggctggcaccaaacgttgtcacgttcaatgcaaggatctctgcactctgcaaggctgggcgggtgctggacgcttacaggatattccaggacatgcaggaggattggcagcatgggttgccgaggcctgatcaggtgacttttgacgtaatgttgagtgggttctgtgatgctgggtttgttgatgaggcacgggttctggtggatattatgaggtgtggtggtttcctgaggagggttgagagctacaaccgctggttatcagggttggtgaggaatgggagggtcggcgaagcgcaggagcttcttagagagatggcacatgaaggaatccaacctaatagctacacgtacaatattattgtctctgggttgtgcaaggagggcaaggcgtttgatgcgaggagagtagagaatttcattaggagcggtgtgatgtccccagatgttgtgacttacactagtttgctccatgcctattgctcaaagggcaacattgctgctgccaacaggattcttgatgagatggcacagaaagggtgcgcaccaaattcatttacttacaatgttctgctgcagagtctgtggagagctggtaggaccacagaggcagagcggttgttagagagaatgaatgagaaaggatacagtttggatacagcaggctgcaatatcattattgatggattatgcaggaatagtagattagatgttgctatggatattgttgatgggatgtgggaagaaggaagtggagctcttggccgactggggaattcattccttagtgtagttagtgattcttccatcagccaaagatgtcttcctgatcagatcacatattctattttgattagtgcattgtgcaaagaaggccggtttgatgaagccaagaagaaattacttgagatgatagtgaaagatatttcccctgattcagttatatatgacacttttattcacgggtattgtaagcatggaaagacctctttggctattaaggttctgagggacatggaaaagaaaggttgcaacccaagcacaaggacatacaacttgttgattcggggatttgaagaaaaacataaatcagaagaaatcatgaaactgatgagtgaaatgaaggagaaaggaatttctcctaatgtgatgacctacaatagcttgataaagtctttttgtcaacaagggatggttaacaaggccatgcctcttttggatgaaatgctacaaaatgaattagttcctaatataacttcttttgacttgttgatcaaggcttattgcaagattacagatttcccttcagcgcagatggtttttgatgctgctttgagaacatgtgggcagaaggaagtgctgtattgcttaatgtgcactgaactcacaacgtatggtaaatggattgaagccaagaacattctagaaatggcacttgaaatgagggtctctatccagagtttcccatataagcagataatttctgggctctgtgaagttggggaggtggatcatgcacatagccttctcaagttgttaatagctaaacgacatttgtttgatccagcagcattcatgccagtgatagatgcattaggtgataggggaaagaaacaggatgttgatatgctgtcagcaaaaatgatggaaatggccgaccgtaatgatggtcttggaactgattctggtaagattacccctggaagctgtaagcatgagcatgacaggaatggtgaaagtgattggcgtactcttttgcacagagatgacagtgcccgcacgattatgaaaattacaaagagagttcggacaggatggggtcaaagaggcaatgtatatgagcataagcagcaacagaatgatggcttttatgttgttgaaaacactggagaagcctcaagaaggcaaaggacgacggggaacacgagctcggcagatttgggcatggaaattgctgggctccctcctgacatccttgtggaggtgacggctaacatcgcgacaaggtcttcgactcccctcgatgacatcgtcaacctcaggcgatcgtgtaagctgttccgcgatgcgacggcggcgaggaaggtcgggcggtgcatggccgttcagagagagtggaggctgcactggtgggacaagacgaggttcctgtccgtgcttcggcggtgcgcggcgagcggcaaccctgaggcatcctacatcctcggactggagttgttctgcaaccggaggagaaaagccagcgcgctccggcacctccgctgcgccatggagcatggccacgccgcggcagcctacatgatcgggatgatcatgttgcaccagtcgcgctcgccgggcggcaccgagcaggcgctggaatgcctggaccgcttgtctgcgtctgcgtccgccggcacctggacaaggcgcagggtcgcctccgttcgcagggaggccttgtcggtcatgcgaaggctgacgatgcgtcggtggaggatggccgagcctcccacgccctgctcgaatccgtggtgcggcaaggcagagacggggtcggtggaggcctgggacgacggcgacgacgaggagaggaggttttgtagccggacgtgttggtggaaacacgagtattgtaagttcattcagaagatttga

SEQ ID NO: 20857 - protein, 1114 aa, Sorghum bicolor
  misc_feature: Ceres ANNOT ID no. 8671308
  misc_feature: Up-regulated in shoot tissues in response to salicylic acid treatment
  misc_feature (515)..(549): Pfam ID: PPR Pfam Description: PPR repeat
  misc_feature (387)..(421): Pfam ID: PPR Pfam Description: PPR repeat
  misc_feature (208)..(242): Pfam ID: PPR Pfam Description: PPR repeat
  misc_feature (550)..(584): Pfam ID: PPR Pfam Description: PPR repeat
  misc_feature (620)..(654): Pfam ID: PPR Pfam Description: PPR repeat
  misc_feature (585)..(619): Pfam ID: PPR Pfam Description: PPR repeat
  misc_feature (317)..(351): Pfam ID: PPR Pfam Description: PPR repeat
  misc_feature (422)..(456): Pfam ID: PPR Pfam Description: PPR repeat
  misc_feature (282)..(316): Pfam ID: PPR Pfam Description: PPR repeat
  misc_feature (243)..(277): Pfam ID: PPR Pfam Description: PPR repeat
  misc_feature (352)..(386): Pfam ID: PPR Pfam Description: PPR repeat
MSSSPSAANLLALLRRNAASPAVALRLFLHLSSAACPPPPRSTSFLARLVAEHPAADALLPLLHRHILSFPDPSPHLLALLSCSDVLPLRLAIPAFRSLRALTSAPPPTTPVYNRLILAALRESRLDLVEALYKDLLLSGAQPDVFTRNLLLQALCDAGRMELAQRVFDAMPARNEFSFGILARGYCRAGRSIDALKVLDGMPSMNLVVCNTVVAGFCKEGLVEEAERLVERMRVQGLAPNVVTFNARISALCKAGRVLDAYRIFQDMQEDWQHGLPRPDQVTFDVMLSGFCDAGFVDEARVLVDIMRCGGFLRRVESYNRWLSGLVRNGRVGEAQELLREMAHEGIQPNSYTYNIIVSGLCKEGKAFDARRVENFIRSGVMSPDVVTYTSLLHAYCSKGNIAAANRILDEMAQKGCAPNSFTYNVLLQSLWRAGRTTEAERLLERMNEKGYSLDTAGCNIIIDGLCRNSRLDVAMDIVDGMWEEGSGALGRLGNSFLSVVSDSSISQRCLPDQITYSILISALCKEGRFDEAKKKLLEMIVKDISPDSVIYDTFIHGYCKHGKTSLAIKVLRDMEKKGCNPSTRTYNLLIRGFEEKHKSEEIMKLMSEMKEKGISPNVMTYNSLIKSFCQQGMVNKAMPLLDEMLQNELVPNITSFDLLIKAYCKITDFPSAQMVFDAALRTCGQKEVLYCLMCTELTTYGKWIEAKNILEMALEMRVSIQSFPYKQIISGLCEVGEVDHAHSLLKLLIAKRHLFDPAAFMPVIDALGDRGKKQDVDMLSAKMMEMADRNDGLGTDSGKITPGSCKHEHDRNGESDWRTLLHRDDSARTIMKITKRVRTGWGQRGNVYEHKQQQNDGFYVVENTGEASRRQRTTGNTSSADLGMEIAGLPPDILVEVTANIATRSSTPLDDIVNLRRSCKLFRDATAARKVGRCMAVQREWRLHWWDKTRFLSVLRRCAASGNPEASYILGLELFCNRRRKASALRHLRCAMEHGHAAAAYMIGMIMLHQSRSPGGTEQALECLDRLSASASAGTWTRRRVASVRREALSVMRRLTMRRWRMAEPPTPCSNPWCGKAETGSVEAWDDGDDEERRFCSRTCWWKHEYCKFIQKI

SEQ ID NO: 20858 - DNA, 1629 bp, Sorghum bicolor
  misc_feature: Ceres ANNOT ID no. 8671309
  misc_feature: Up-regulated in shoot tissues in response to salicylic acid treatment
  misc_feature: Encodes the peptide sequence at SEQ ID NO 20859
atggaccccgcggggccgcgcgtgggcacggatcccaccggatcgggagccgcgccgccgcgcgaggaattggacgggagaggaagaggaggagcgtgcagcggcgccgcagcggtggaggggagcgcgtcgcggctggcgggcgctggattaggagatccgagggctggaattctggaatctttggttcaagctgaagcatatttgcacacatataccatggatgttcctcagttgactgctgaaggtgccacacaatgtggagatagagtgtctttattgccccagactggggcacttcagtcagtaactccttgtctgaccttgggccgcgattccaatgcaacatcaatggagaagttgcatggtaatgagtccttgccatttggtaaggagaacatcagaaaagatctccaacctaaacctgatccagaacatgttgataataggatgagtgttgcacgtcttgggttggaccttaacacagcagatagttctgatgcagcagagcttaaccctttcttcccttacaagaagctggggcagttgaaagtcagtggtccatcagaatgtggcagcactactggtgctacagaagaaagcgagtcgcacagaaagtggagagaaatgaagcagaatggctttctttcttcgtctcatggaaatgcaatggtgcctaggccacgtggtcgaccccccaaaaggaaaagggatgatgaattcaaaaagagcacttctacacagcatggccaggctaataagtctatgaaggttgctgctcctagtggcctattatctgggctaaaccctggaatcattaaccatgtgagaaatagcaagcaggtgtactccataataaaggctatggtacactctgagaggcttcagaatgagaaccagcctgcctttactagtcaaacaggtgaaagagggagagatgttagtgagagaattcaggatcagaaatatggtagtggtttcatgaagtgccattcgttgatgaaagataataatgtggtgtttcaccaaacactgcctaccacattgcatttccttccacaggatggtgatagtctcaaactgcaactctcatcagcagtcactatgtcttcagataggacctgcagtacgtcggctgatgatccagcatctaatcatgattacatgactgtactgtcagtaaaagctttaaaacgcagcaggaagagagtcagaaatgctcttcgcacggaactgccatacctaatgtcgacagaatttccatctaatcaagagaatgaatcatcgattgcaaatacttctgaggctggatgtactgaaaaagcagtttcagaagcgcatgtggcacgatggaggtctctgtttgtccagatggacagaacacttcaggaggaagggaaacaactggagaaccggttgaagcaagtgcaagaaatgcaattgaattgtgataaaggcctcaaacacatgacctgtgaagctcctctgctaggacccatggctgaactatggaagctgaacaacccagataattctgagagtgagtgggcggtgcaagccgctgctgcatcaatctactcgacctgcaacatggtcatgagagcggagaacaacgtgccttgcttctga

SEQ ID NO: 20859 - protein, 542 aa, Sorghum bicolor
  misc_feature: Ceres ANNOT ID no. 8671309
  misc_feature: Up-regulated in shoot tissues in response to salicylic acid treatment
MDPAGPRVGTDPTGSGAAPPREELDGRGRGGACSGAAAVEGSASRLAGAGLGDPRAGILESLVQAEAYLHTYTMDVPQLTAEGATQCGDRVSLLPQTGALQSVTPCLTLGRDSNATSMEKLHGNESLPFGKENIRKDLQPKPDPEHVDNRMSVARLGLDLNTADSSDAAELNPFFPYKKLGQLKVSGPSECGSTTGATEESESHRKWREMKQNGFLSSSHGNAMVPRPRGRPPKRKRDDEFKKSTSTQHGQANKSMKVAAPSGLLSGLNPGIINHVRNSKQVYSIIKAMVHSERLQNENQPAFTSQTGERGRDVSERIQDQKYGSGFMKCHSLMKDNNVVFHQTLPTTLHFLPQDGDSLKLQLSSAVTMSSDRTCSTSADDPASNHDYMTVLSVKALKRSRKRVRNALRTELPYLMSTEFPSNQENESSIANTSEAGCTEKAVSEAHVARWRSLFVQMDRTLQEEGKQLENRLKQVQEMQLNCDKGLKHMTCEAPLLGPMAELWKLNNPDNSESEWAVQAAAASIYSTCNMVMRAENNVPCF

SEQ ID NO: 20860 - DNA, 2655 bp, Sorghum bicolor
  misc_feature: Ceres ANNOT ID no. 8671310
  misc_feature: Down-regulated in shoot tissues in response to salicylic acid treatment
  misc_feature: Encodes the peptide sequence at SEQ ID NO 20861
atggcgggaggctccggcggcggaggttttctgggcgacgtgaacgacccgtggctgaagccgcggctgctccgcgcggtggtcaccgagcgccttccgcagcctggcggcgccgctgagctctcgccgacggaggtcgcctccatcttagaggcggtccgcacccacggcctgctcacggaggctctcccgggccgcggcacgcctccggcgaacccgaagctcgccgaggcgtggcgcgccgccgtcgacgcctgggtcgagcgtgtcgtggcgctggtggagagcgactcgacatacagttgttggttgggtacttccttgctgggtgtgactttccaagagtgcagaaatgagcgatttgcagaattgcactccatttggtttgagaagattctgggtaatttgcaggaatcgtccagctctcaacatgttattgttatttcctgtacttccatgtctgatttatttgtaagattggctaagtttttgaacttaaagaaagagggatcatcctttgctggaagggttgttgaaccggtgctgcggcttttaaacgaaaatgctctagtagctgacgaagcaattgatttgctgaggacggttattaaattgtacccatcctctgtaaaccggcactacagtaaggttgaatctgctattgcagcaaagattatgagtacaggaatcaatgtaaaaccatctgagaaatttgcgagaaccttagcattgttaccttctgtccgagtgtccgaggacagttggtcactgatgattcggaggatattgattgtgataaacaatcttttgaatgatgctttcattgggcttgaagaagaaaagaaaggccatgatattatgctgctgctagttccacctggagctgatcctctaccaacattgggagatgaagtaatgcctggaggcaatgtgcatgtcatgaagaaatttcgtgtcttcactgttcctaccatttcagctcttacacattgctgcagtgtgatgctgactagttattatccagttcaggtcaatgttccaattcatgctttgatggctttgatgcgaagagtgctgttagttgatggatcattgcataataagttgttcccttctacaacttcattgcatcaagagcttatttgttttgagcttccatcgctacattcaagtttcttggatttgctcaatgcaactattaaaggaatgcgaagccaactcttacctcatggtgctagtatcatacgccttataacagagtacttcaaaatagcaaaactgcctactttgaggacaaaagcttatagcattctgcagctgttgctgacctccatgggtgctgggacatctctgcacctgcttgaggcaatagtcagcaatgcaattgctgatctgaatgatgatggtggaagtgacatgactgtaatcaacacaaatccatcacaattgacaaatgaatcatcatcgaaaatttattcgaagaagaggaagctagaaccacagatgcaaaactcaaccatatcaggttcagagaaagtagcagtcagcccaaggaaaagaaaaggttcttccataccaattgcatcaaagggagtggcccctgaaagtataggagatcttagagtatcaactccactttctgtcaaaatagctgcacttgaaacattggaaattcttctgaatgtgggaggttcattgcggatggatcgctggaggtcagaagtggatgtgctcttaattaatgtggctagaagtgcttgcaacatgggaggaagttatgagcaaaagccctccacatttggggagccaagcatatcagaccttcaacttgcttcgtttaagggcctgctggcatcttttctttcttctcctcatgcccgtcctccttacttagccaaaggaattgaactcttcagaaaagggaagctagagataggcactaagcttgcagagttttgttcacgtgctttgcttgctttggatgtccttgtccaccctcgagccctttctctagaaagaacagttccttcacagggaaatacagtttttggtgctggaacataccagatttcacgattcggggatcagcctcaagcaatggaggttgaagacatgtacgatgattggctgacatccaacaacgatgaaccagcagaggttccagtgaacgatagtgctgcaggagtaagtacagatgtcatgctggtggaggttggaaagcagctcaattccaaagcagaagatcctaaagttgacccacccagaatcacagatgcagcacaagatgcaccaacatccaccaagagtgatgtcaagatggttgatgcagctgcagacgaaactgcaaagccaaacacagtggagaatccatcgatctccaatgttggtgcctctccagagtgcacaacaaattttgattcacgtaagcatgagcaggttagtcctcatgagaacaaaagcccagcagctgtccatctgccatccagcagcatgctgggaacttcaggtgaaccttctgctactccaggtgttggttcgagccaccatccccgttcaaccagcttcgtggaattgtttggttcggagtctggaattgagtcagaatctgaagactcgttgccagatattgtcgacggggaccctgattctgactag

SEQ ID NO: 20861 - protein, 884 aa, Sorghum bicolor
  misc_feature: Ceres ANNOT ID no. 8671310
  misc_feature: Down-regulated in shoot tissues in response to salicylic acid treatment
MAGGSGGGGFLGDVNDPWLKPRLLRAVVTERLPQPGGAAELSPTEVASILEAVRTHGLLTEALPGRGTPPANPKLAEAWRAAVDAWVERVVALVESDSTYSCWLGTSLLGVTFQECRNERFAELHSIWFEKILGNLQESSSSQHVIVISCTSMSDLFVRLAKFLNLKKEGSSFAGRVVEPVLRLLNENALVADEAIDLLRTVIKLYPSSVNRHYSKVESAIAAKIMSTGINVKPSEKFARTLALLPSVRVSEDSWSLMIRRILIVINNLLNDAFIGLEEEKKGHDIMLLLVPPGADPLPTLGDEVMPGGNVHVMKKFRVFTVPTISALTHCCSVMLTSYYPVQVNVPIHALMALMRRVLLVDGSLHNKLFPSTTSLHQELICFELPSLHSSFLDLLNATIKGMRSQLLPHGASIIRLITEYFKIAKLPTLRTKAYSILQLLLTSMGAGTSLHLLEAIVSNAIADLNDDGGSDMTVINTNPSQLTNESSSKIYSKKRKLEPQMQNSTISGSEKVAVSPRKRKGSSIPIASKGVAPESIGDLRVSTPLSVKIAALETLEILLNVGGSLRMDRWRSEVDVLLINVARSACNMGGSYEQKPSTFGEPSISDLQLASFKGLLASFLSSPHARPPYLAKGIELFRKGKLEIGTKLAEFCSRALLALDVLVHPRALSLERTVPSQGNTVFGAGTYQISRFGDQPQAMEVEDMYDDWLTSNNDEPAEVPVNDSAAGVSTDVMLVEVGKQLNSKAEDPKVDPPRITDAAQDAPTSTKSDVKMVDAAADETAKPNTVENPSISNVGASPECTTNFDSRKHEQVSPHENKSPAAVHLPSSSMLGTSGEPSATPGVGSSHHPRSTSFVELFGSESGIESESEDSLPDIVDGDPDSD

SEQ ID NO: 20862 - DNA, 1692 bp, Sorghum bicolor
  misc_feature: Ceres ANNOT ID no. 8671389
  misc_feature: Down-regulated in shoot tissues in response to salicylic acid treatment
  misc_feature: Encodes the peptide sequence at SEQ ID NO 20863
atggagagcagcatccgcctcgccgacaccctccggccgtcgtctctcccggcaccggcgtccgcccacctccgccgccgccacctctacctccaccgcctcccccgcacctcctcctcctcctccctcttcttctccccgtcgcaccatcatcgcctctgccccacgcctcggcatgacctcctgcagcctctcgccgccgccgcctccggcgccgcgaagctcgtgcccgcctccccggcgccagctgattctagccccgagccaaagccctcgggcgcgaagctcgtgccgctcgtcatctccctcgcggtcggcctcgccgtgcggttcctggcgccgcggcccgccgaggtgagcccgcgggcgtggcagctgctctccatcttcctctccaccatcgcggggctcgtgctgggcccgctccccgtcggcgcctgggctttcctcggcctcacggccgccgtcgccacgcacacgctccccttcgccgccgccttcgccgccttcaccaacgagatcatctggctcatcgtcatctccttcttcttcgcgcgcggcttcgtcaagacgggcctcggcgaccgcgtcgccacctacttcgtcaagtggctcggcaagagcacgctggggctgtcctacgggctcgccctcggcgaggcctgcatagcgccggccatgcccagcaccgccgccagggcagggggcattttcctgcccatcatcaagtcactctccctctcggctgggagcaagcccaaccatccgtcttcacggaagctcggaacatatctggtcatgtcgcaattccaggcagctagtagctcaagtgctttgttcctgactgctggggcacaaaatctgttgtgcttgaatctagcagaaaagtttggtgttattatcgcaaatccatgggtaacatggtttaaagctgctagtttgccagctattgtttctctcctagcaacgccatacttgctatacaaaatctttccccctgaaataaaggacacccctgaggccccggcattggctgcagagaagcagaagcagatgggtccggtgactaaaaatgaatgggctatgattggcacaatgattcttgcagtcgcgctatggatttttggggatgctattggtgtgtctagtgttgtggctgcaatgcttgggctctccattcttctcctgcttggtgtgctggactgggctgatatcttgaatgagaaatccgcatgggatacattggcttggttttcagttctggttgggatggcagcacaactcacaagcctggggattgtttcttggatgtcaagctgtattgctaacctgcttcagtctttctcattgagttggcctgcagcattttgtgttcttcaggcctcctaccttgtgatccattatctattcgcaagtcaaactgggcatgttggagccttgtactctgcattcctggctatgcatgtagcagcaggcgttcctagtgtgctttcagcacttgctttggcgttcaacacagatttgtttgggggaataactcactacagtagtgggcaggcagcggtatactttggagctgggtatcttgaccttcctgatgttttcaggattggttttatatcaaccttgattaacacattgatctggggaggtattgggaccttttggtggaaatttttagggctctactga

SEQ ID NO: 20863 - protein, 563 aa, Sorghum bicolor
  misc_feature: Ceres ANNOT ID no. 8671389
  misc_feature: Down-regulated in shoot tissues in response to salicylic acid treatment
  misc_feature (93)..(563): Pfam ID: Na_sulph_symp Pfam Description: Sodium:sulfate symporter transmembrane region
MESSIRLADTLRPSSLPAPASAHLRRRHLYLHRLPRTSSSSSLFFSPSHHHRLCPTPRHDLLQPLAAAASGAAKLVPASPAPADSSPEPKPSGAKLVPLVISLAVGLAVRFLAPRPAEVSPRAWQLLSIFLSTIAGLVLGPLPVGAWAFLGLTAAVATHTLPFAAAFAAFTNEIIWLIVISFFFARGFVKTGLGDRVATYFVKWLGKSTLGLSYGLALGEACIAPAMPSTAARAGGIFLPIIKSLSLSAGSKPNHPSSRKLGTYLVMSQFQAASSSSALFLTAGAQNLLCLNLAEKFGVIIANPWVTWFKAASLPAIVSLLATPYLLYKIFPPEIKDTPEAPALAAEKQKQMGPVTKNEWAMIGTMILAVALWIFGDAIGVSSVVAAMLGLSILLLLGVLDWADILNEKSAWDTLAWFSVLVGMAAQLTSLGIVSWMSSCIANLLQSFSLSWPAAFCVLQASYLVIHYLFASQTGHVGALYSAFLAMHVAAGVPSVLSALALAFNTDLFGGITHYSSGQAAVYFGAGYLDLPDVFRIGFISTLINTLIWGGIGTFWWKFLGLY

SEQ ID NO: 20864 - DNA, 2304 bp, Sorghum bicolor
  misc_feature: Ceres ANNOT ID no. 8671425
  misc_feature: Down-regulated in shoot tissues in response to salicylic acid treatment
  misc_feature: Encodes the peptide sequence at SEQ ID NO 20865
atgacaatgcgcgcccgccttgcccgcctaggcgagcattttgcaaggcgctgggggtcgctaggcgacgccttaagaactatgcgctgtacctcattttatcatttttctggtaaagcagatgaactgtctttgcacagaaagcttggctgctctgattttactttggcttgtttacttgattttccaaaatctcctgaaggggacgttatgtcaccttgttttcccagtccagcagaagtgatcaatctagtaaggaggtttagtagtttgattatgtgtggaagaaattttgagtgtgcacagactttcttgggatacacaattaatctatcagctgttctcatccgacatggtcagtatgaagctgctaagaatctgctgggaattctggaaacatacttgaacaatggagaagtatcccatactggtcaagatgcagatactgcatgtgcagcataccttcatctcaatggattttgccttctgatgcttgcacatgatgaagcaaatattattttgagagaatccaaggttcatgatgctatccgatgctttttcagggctgcgtccgggtatgaagctccaaaggttttgcagaacttttcattggaaacagggtttcaagtttctggggaatctagatctatttctttgtggagacttaactactatgagtgggcaatgcaaatttttgagcaacactccatgagtgagggggcgtgccaatttgctcttgctgctcttgagctagttgatatcattgatgggttagataatggaattgaagctgagggccttccagagaccgcagcaatgattaaaggacggttatgggctaatgtattcaagtacagcttggatctgaaacactttcgagatgcatattgtgcgatcgtctcaaacccggatgatgatagcaaatacatctgtttgaggcgtttcatcatagtcctttgtgatcttggggagacaaaggttctttgcaatggggagattccattcactgacttggtagagaaagtggagcaagagctcttctggaaggctgaacgctcggatctgtcttctagaccaaatctctataaggttctgtattcatttgaagcacatcggaacaaatggaggaaagcagctgtatacatgtacaggtactatgttagattgaatagagaaggtaatgcaggtggcagccaccaacttcctcatgtgttgcaagagaggttgcacgctttatctgctgctatcaacgcattgcagcttgttgatccctcatttgcatggctcgactctatttgtgaagctgatgatcaaatttctccaagtaaaagacctcggaatcttttgatggagaacttggcttttggcacagattctgagctttctagattgcagttttgcgtcgacattgaaatccttgaaaaagaatacatattaacagaagcacagtatatgctcagcactctgaaatcaatatttgatttttcagaaaggcagtcaatggagtccctgatggatattcttatagatgagaaattgtatgacttggccttcacagttgtgctcaaattttggaaggagtcaggaatgaaaaagcaattggagcgtgtcttttcagtcattgctcagcaatgctgtccgaacagagcagacaacaaatcaaggaaaagtttgactgacagtcaacaagtgctactcctgccttcttctgagaatgatgcatgggagatcaacaataagagtattcctgtcacccaacaactgcaggggagcaaccactgggaaatccttgaactatatttggataaatacaaagatctgcatcctaggttgccggtcattgttgctgagacacttctttataccgatcccgagattgagctaccactttggttggttcagatgttcaagactaacaaggcagggaacaagatctcctggggcatgtctgggaaagaggcagatcctgccgccttattcagactatacataaactacggacgccatgcagaagctactaacttgctggtggagtatttagagtcgttcgcatcatcgaggccagtggaccttctccaccgcaagcagatgtccgccacttggttcccgtacacggctgtggagaggctgtggtgccagctgggtgagatgcaacgcgccggccacagcgtggatcagtgcgaccggctcaagaagctgctgcatggagccctgatgagccacctgcagcaggttgtggtcgactcgggggacgtgctgtcgtcagttggagatgggcaggggatggagggccagagcagatga

SEQ ID NO: 20865 - protein, 767 aa, Sorghum bicolor
  misc_feature: Ceres ANNOT ID no. 8671425
  misc_feature: Down-regulated in shoot tissues in response to salicylic acid treatment
MTMRARLARLGEHFARRWGSLGDALRTMRCTSFYHFSGKADELSLHRKLGCSDFTLACLLDFPKSPEGDVMSPCFPSPAEVINLVRRFSSLIMCGRNFECAQTFLGYTINLSAVLIRHGQYEAAKNLLGILETYLNNGEVSHTGQDADTACAAYLHLNGFCLLMLAHDEANIILRESKVHDAIRCFFRAASGYEAPKVLQNFSLETGFQVSGESRSISLWRLNYYEWAMQIFEQHSMSEGACQFALAALELVDIIDGLDNGIEAEGLPETAAMIKGRLWANVFKYSLDLKHFRDAYCAIVSNPDDDSKYICLRRFIIVLCDLGETKVLCNGEIPFTDLVEKVEQELFWKAERSDLSSRPNLYKVLYSFEAHRNKWRKAAVYMYRYYVRLNREGNAGGSHQLPHVLQERLHALSAAINALQLVDPSFAWLDSICEADDQISPSKRPRNLLMENLAFGTDSELSRLQFCVDIEILEKEYILTEAQYMLSTLKSIFDFSERQSMESLMDILIDEKLYDLAFTVVLKFWKESGMKKQLERVFSVIAQQCCPNRADNKSRKSLTDSQQVLLLPSSENDAWEINNKSIPVTQQLQGSNHWEILELYLDKYKDLHPRLPVIVAETLLYTDPEIELPLWLVQMFKTNKAGNKISWGMSGKEADPAALFRLYINYGRHAEATNLLVEYLESFASSRPVDLLHRKQMSATWFPYTAVERLWCQLGEMQRAGHSVDQCDRLKKLLHGALMSHLQQVVVDSGDVLSSVGDGQGMEGQSR

SEQ ID NO: 20866 - DNA, 2736 bp, Sorghum bicolor
  misc_feature: Ceres ANNOT ID no. 8671449
  misc_feature: Up-regulated in shoot tissues in response to salicylic acid treatment
  misc_feature: Up-regulated in root tissues in response to salicylic acid treatment
  misc_feature: Encodes the peptide sequence at SEQ ID NO 20867
atggctccccccgagaaccccagccccgcggcgccggccgagccgtcgcagccgccgccgccggcggcggccgcggccaaggggaaggggaagaagaaggacgagaagaaggatgacgatctgtcggaggaggatctggcgctcaaggagcagctcgagctctacgtcgtgcgggcgcaggacgcggatcccggcgtgcagaagctcgcgcttgagagcatgaggcaggagattcgctcggccacgagctcaatgacttcggtcccaaagccgctgaaattcctccgcccacactttggaactctcaagtcctattttgaaacaatgccagagtccgagctcaagaagtacatggctgacatactgtcagtgttagctttgacaatgtccattgaaggagaaagagagagcctgaaataccgtctgttgggctctgaaggtgatattggttcatggggtcatgaatatgtgagaaatttggctggtgagattgcacaagaattccaaaaacgtcaggatgatgacttgcccattgatgccctaatggagctagtgcagcagattgtttcatttcacatgaagcataatgccgagcctgaagctgtggatcttcttatggaggttgaagaccttgatttactagttgagcatgtggatgctacaaactacaaaagagcgtgcttgtatcttactagctcgtccaattttctccctgcccctgatgatagtttggcacttgacatagcatataccatctacatgaagtttggagaccttgcaagtgctttgagaacttctctgaaacttgagaaatccccgcagtatgtgaagcaggtctacacagcaactgatgatcttctgctcaagaagcaattctcgtatctcatcgcacgccatggtttggttatggagattgatgatgagatcgctgctgatgacaatgacaaggaggttttgcaagaaatagtaaataatactaagttgagtgagggatatcttactcttgctcgcgatattgaggtcatggagcctaaatcccctgaggatatatacaaggtccatttgattgatggtcgtggtgccagctccagtcttgattctgcaagacagaatttagctgcaacattcgtaaatgcattcgtgaatgctgggtttggccaggacaagttgatgaccgctccatctgattcatccagcagcgggtcttccggaaattggttattcaagaacaaggaacatggaaaagccagtgcagcagctagtctgggaatgattctcctgtgggatactgattctgggcttgctcagcttgacaagtacttgcatagtaacgatactcatgttgttgctggagctttgctaggtattggaattgtcacttgcggggtgaagagtgattgtgatcctgcgtttgctattctcatggagtatattggcaaggatgactcaaacattcgtattggagcaatattgggtcttggaattgcatatgccggttcccagaaagaagagcttaaaatgcatctatctgctgtgttgggagactcccaatcaccacttgaggtcctggtcttctcagccattgccttgggattggtgtttgtcggttcttgcaatgaagagattgcacagtctattatatttgccttgatggagcgtagtgaggctgagttggcagaacccattatacggttgcttcctgttgcgcttggccttctatatcttggaaaacaggatagtgtggaggctactgcagaggtctctaaaacatttgatgagaagattgggaagtactgtgatgtaacacttatgtcactggcatatgctgggacaggaaatgtgcttaaggttcagaaacttcttggcatatgctcacagcatcttgagaaaggcgaaacacaccaagggccagctgtccttggaattgctcttattgctatggctgaagaattaggagctgaaatggctgtacgttcgcttgagcgtcttctgcagtacggcgagcagaatataagacgagcagttcctcttgctcttggtatactctgcatatctaaccccaaggtaaatgttatggacacactgagcagattgagtcatgatgcagatgccgatgtgtcgatggctgcaattatctcattgggtttgattggtgctggcacaaacaatgccagaatagctggcatgcttcgcaatctttcaagttattactacaaagaagctgctcatctgttttgtgtaagaattgctcagggccttgttcaccttggaaagggcttgctgaccctttctccataccattctgaccgatttcttctttccccaatggctcttggagggcttgtaactgtcctgcatgcgtgtcttgatatgaagtccaccatcctagggaaataccactacatcctttacattattgtcctggcgatgcagcccaggatgcttttaactgtggatgaggatctgaagcctctctcagtacctgtccgcgttgggcaagctgtcgacgtggttggtcaggcaggaaggccgaagacaattactggcttccagacacactccacaccggtcttgcttgcagcaggggagagagctgagctagcaactgaaaatatgctagatagcatggtgcttttgtgtctcgtccacatggcagtcttcaagccttggcaacctttgtcgaggaatcgatcgcccctggatatcttgctcaatcctcggtccgttcatgtttga

SEQ ID NO: 20867 - protein, 911 aa, Sorghum bicolor
  misc_feature: Ceres ANNOT ID no. 8671449
  misc_feature: Up-regulated in shoot tissues in response to salicylic acid treatment
  misc_feature: Up-regulated in root tissues in response to salicylic acid treatment
  misc_feature (488)..(522): Pfam ID: PC_rep Pfam Description: Proteasome/cyclosome repeat
  misc_feature (451)..(487): Pfam ID: PC_rep Pfam Description: Proteasome/cyclosome repeat
  misc_feature (709)..(743): Pfam ID: PC_rep Pfam Description: Proteasome/cyclosome repeat
  misc_feature (417)..(450): Pfam ID: PC_rep Pfam Description: Proteasome/cyclosome repeat
MAPPENPSPAAPAEPSQPPPPAAAAAKGKGKKKDEKKDDDLSEEDLALKEQLELYVVRAQDADPGVQKLALESMRQEIRSATSSMTSVPKPLKFLRPHFGTLKSYFETMPESELKKYMADILSVLALTMSIEGERESLKYRLLGSEGDIGSWGHEYVRNLAGEIAQEFQKRQDDDLPIDALMELVQQIVSFHMKHNAEPEAVDLLMEVEDLDLLVEHVDATNYKRACLYLTSSSNFLPAPDDSLALDIAYTIYMKFGDLASALRTSLKLEKSPQYVKQVYTATDDLLLKKQFSYLIARHGLVMEIDDEIAADDNDKEVLQEIVNNTKLSEGYLTLARDIEVMEPKSPEDIYKVHLIDGRGASSSLDSARQNLAATFVNAFVNAGFGQDKLMTAPSDSSSSGSSGNWLFKNKEHGKASAAASLGMILLWDTDSGLAQLDKYLHSNDTHVVAGALLGIGIVTCGVKSDCDPAFAILMEYIGKDDSNIRIGAILGLGIAYAGSQKEELKMHLSAVLGDSQSPLEVLVFSAIALGLVFVGSCNEEIAQSIIFALMERSEAELAEPIIRLLPVALGLLYLGKQDSVEATAEVSKTFDEKIGKYCDVTLMSLAYAGTGNVLKVQKLLGICSQHLEKGETHQGPAVLGIALIAMAEELGAEMAVRSLERLLQYGEQNIRRAVPLALGILCISNPKVNVMDTLSRLSHDADADVSMAAIISLGLIGAGTNNARIAGMLRNLSSYYYKEAAHLFCVRIAQGLVHLGKGLLTLSPYHSDRFLLSPMALGGLVTVLHACLDMKSTILGKYHYILYIIVLAMQPRMLLTVDEDLKPLSVPVRVGQAVDVVGQAGRPKTITGFQTHSTPVLLAAGERAELATENMLDSMVLLCLVHMAVFKPWQPLSRNRSPLDILLNPRSVHV

SEQ ID NO: 20868 - DNA, 3843 bp, Sorghum bicolor
  misc_feature: Ceres ANNOT ID no. 8671445
  misc_feature: Up-regulated in root tissues in response to methyl jasmonate treatment
  misc_feature: Down-regulated in shoot tissues in response to methyl jasmonate treatment
  misc_feature: Down-regulated in shoot tissues in response to salicylic acid treatment
  misc_feature: Up-regulated in root tissues in response to salicylic acid treatment
  misc_feature: Encodes the peptide sequence at SEQ ID NO 20869
atggactcgatcgacgcggacctcgcgcgcacgcaggaggagcggcgcaagatggaggaggcgctggcggccggcgcgcccatggccgtctcctccgtcaccttcgacaccgacctctacgggggcgggggcgccgacccgaaccgcttcgcgggctacgacacctccatcccggcctccgaggacgacgccgcggaggacgacacggagaccgccaaccccgcgccacgccgcctcgcgacgtacacgggccacgccatcgccgcagccgacatcccgcggtcggccgacggcgacgacgggctgcccaagaggtcccagcgcatcatcgaccgcgaggacgactaccgccgccgccgcctcaaccagatcatctcgccggagcgccatgacccgttcgccgccggggaggccacaccggacccctcggtgcggacctacgccgacgtcatgcgcgatgcagcactgcagaagaagaaggaggacctgctcagggagattgccaagaagaagaaggaagaggaggagaaggagaaggagaggaaggctgctgcgcctgagcagccggccgccaccacaaagcggcgcaacaggtgggatcagtcgcaggacagcgatgctgctgccggtgccaagaaggcgaagacatcctcagactgggatgcccctgatgcgactcctgggattgggcgttgggatgccacccctggacgtgttggagacgccacaccctcagtgagaaggaacagatgggatgagacaccgactccagggaggatggctgatgctgatgcgacgcctgcagctggtggcgccacccctggggctactccttctggggcttgggatgcgactccaaagctgcctggtggtgtcacgccaacccctggtaagaagcagagatcaaggtgggatgagacgccagcgagtatggggagtgcaactcctggtggtcttggtgctgcaacacctgctggttatactcctggtccgacgccatttggtgcggagaaccttgccacaccaactcctagccagattgctcgtggaccgattactccggagcagtaccagctcatgcggtgggagcgggacattgaggagaggaacaggcctctcaccgacgaggagctagatgccatgttcccgcaggaggggtacaagattcttgagcccccggcttcctaccagcccatcaggactccagcaaggaagctccttgcgacaccaacacctctggggacaccactttatgctattccagaggagaatcgtgggcagcaatttgatgtgcccaaggagctgcctggtggattaccgctcatgaagccagaggattaccagtactttggaactttgctgaatgaggaagaggaggagcagctatcaccagaggagcagaaggagaggaaaatcatgaaactgctactcaaagtgaagaatggcacacccccacagcgtaaaacagcacttcggcaactgacagacaaagcacgggaattcggtgctggaccactgttcaacaaaatcctgcccttactcatgcagccaacactggaggaccaggagaggcatcttctggtgaaggtcattgatagggtactctacaagctggatgagctggtccgtccttttgtgcacaagattcttgtggttattgaaccattgttgattgatgaggactactatgctcgtgttgaaggcagggagatcatctcaaatcttagcaaagcagctgggcttgctactatgattgctgccatgcgaccggacattgataacattgatgagtatgtgagaaacaccactgctagggcgttcagtgtggtggcttctgctttgggcatccctgcacttttgccattcttgaaggctgtctgtcagagtaagaaatcgtggcaggctaggcacactggcatcaaaattgttcagcaaattgctattctcatgggctgtgctgttttgccacatctcaagtctttagttgagatcattgagcatggtttaagcgatgaaaaccagaaagtccgtacaattactgccctctctctcgctgcactcgctgaggctgctgcaccatatggtattgaaagttttgatactgtgttgaagcctttgtggaagggtatcagatctcaccgcgggaaggtccttgctgccttcctgaaggccattggtttcatcatccctcttatggatgctctgtatgctagttactacacaaaggaggtgatgcaggtcctcattagggagttccagtctccagatgaagaaatgaagaagattgttctcaaggttgtgaaacagtgtgtcagtacagagggtgtggaggctgattatatccggaatgacatccttccagatttcttcaagcacttctgggtgaggagaatggctctagatcgtaggaactataagcagcttgtggaaactacagtggagatggcaaacaaggttggagttgctgatatcgttgggaggattgttgaggatctgaaagatgagagcgagccttacagaagaatggtgatggaaacaattgagaaggtcgtggccaacttgggtgcttcagatattgatgctcgtctagaggagctgcttattgatggtatcttgtatgctttccaagagcagactagtgatgatgcaaatgttatgcttaatggttttggagctgtggttaatgcacttggacagagagttaagccttaccttcctcagatttgtggtaccatcaagtggcgattgaacaacaagagtgcaaaagttaggcagcaagctgctgatctaatctccaggattgccattgtcatgaagcagtgccaggaggagcagcttatgggtcacttgggtgttgtgctgtatgagtacttaggagaggagtatcctgaggtgctgggttcaattcttggagccttgaaggctatcgttaatgtcattggtatgactaaaatgactcctccaatcaaggatcttcttcctcgtctgacacccatcttgaagaacaggcatgagaaggtccaagagaactgcattgatcttgttggtaggattgctgatcgtggagcagaattcgtgccagcaagggagtggatgaggatttgttttgagctgctcgaaatgttgaaggctcataagaagggtattaggagagccactgtgaacacatttggttatattgcaaaggctatagggccacaggacgtgttggccaccctgttgaataacttgaaggtgcaggagcgacagaaccgtgtttgcacaactgtagcaattgccatagttgctgaaacttgctcaccttttacagttttgcctgcccttatgaatgagtaccgggtcccagagctcaatgtgcaaaatggtgttctgaagtcactctctttcctctttgagtatattggtgagatgggcaaagattacatatatgctgtcactcccttacttgaagatgctttaatggatagagatctggttcatcggcagactgctgcatctgctgttaagcacatggctctaggcgttgctggcttgggttgtgaggatgctcttgttcatctgcttaactatgtttggcccaacatatttgagacttctccccacgttataaatgctgtgatggaggcaattgaggggatgagggtcgcacttggtgcagctgtgattttgaattattgcctgcaaggtctcttccacccagcaaggaaagtacgtgaagtgtattggaagatatacaactctctgtacattggtgcgcaggatgcgcttgttgcttcttatcctgccctggaagacgatggggataatatcttcagccgtccagagctggcaatgttcgtctga

SEQ ID NO: 20869 - protein, 1280 aa, Sorghum bicolor
  misc_feature: Ceres ANNOT ID no. 8671445
  misc_feature: Up-regulated in root tissues in response to methyl jasmonate treatment
  misc_feature: Down-regulated in shoot tissues in response to methyl jasmonate treatment
  misc_feature: Down-regulated in shoot tissues in response to salicylic acid treatment
  misc_feature: Up-regulated in root tissues in response to salicylic acid treatment
  misc_feature (294)..(431): Pfam ID: SF3b1 Pfam Description: Splicing factor 3B subunit 1
  misc_feature (655)..(691): Pfam ID: HEAT Pfam Description: HEAT repeat
MDSIDADLARTQEERRKMEEALAAGAPMAVSSVTFDTDLYGGGGADPNRFAGYDTSIPASEDDAAEDDTETANPAPRRLATYTGHAIAAADIPRSADGDDGLPKRSQRIIDREDDYRRRRLNQIISPERHDPFAAGEATPDPSVRTYADVMRDAALQKKKEDLLREIAKKKKEEEEKEKERKAAAPEQPAATTKRRNRWDQSQDSDAAAGAKKAKTSSDWDAPDATPGIGRWDATPGRVGDATPSVRRNRWDETPTPGRMADADATPAAGGATPGATPSGAWDATPKLPGGVTPTPGKKQRSRWDETPASMGSATPGGLGAATPAGYTPGPTPFGAENLATPTPSQIARGPITPEQYQLMRWERDIEERNRPLTDEELDAMFPQEGYKILEPPASYQPIRTPARKLLATPTPLGTPLYAIPEENRGQQFDVPKELPGGLPLMKPEDYQYFGTLLNEEEEEQLSPEEQKERKIMKLLLKVKNGTPPQRKTALRQLTDKAREFGAGPLFNKILPLLMQPTLEDQERHLLVKVIDRVLYKLDELVRPFVHKILVVIEPLLIDEDYYARVEGREIISNLSKAAGLATMIAAMRPDIDNIDEYVRNTTARAFSVVASALGIPALLPFLKAVCQSKKSWQARHTGIKIVQQIAILMGCAVLPHLKSLVEIIEHGLSDENQKVRTITALSLAALAEAAAPYGIESFDTVLKPLWKGIRSHRGKVLAAFLKAIGFIIPLMDALYASYYTKEVMQVLIREFQSPDEEMKKIVLKVVKQCVSTEGVEADYIRNDILPDFFKHFWVRRMALDRRNYKQLVETTVEMANKVGVADIVGRIVEDLKDESEPYRRMVMETIEKVVANLGASDIDARLEELLIDGILYAFQEQTSDDANVMLNGFGAVVNALGQRVKPYLPQICGTIKWRLNNKSAKVRQQAADLISRIAIVMKQCQEEQLMGHLGVVLYEYLGEEYPEVLGSILGALKAIVNVIGMTKMTPPIKDLLPRLTPILKNRHEKVQENCIDLVGRIADRGAEFVPAREWMRICFELLEMLKAHKKGIRRATVNTFGYIAKAIGPQDVLATLLNNLKVQERQNRVCTTVAIAIVAETCSPFTVLPALMNEYRVPELNVQNGVLKSLSFLFEYIGEMGKDYIYAVTPLLEDALMDRDLVHRQTAASAVKHMALGVAGLGCEDALVHLLNYVWPNIFETSPHVINAVMEAIEGMRVALGAAVILNYCLQGLFHPARKVREVYWKIYNSLYIGAQDALVASYPALEDDGDNIFSRPELAMFV

SEQ ID NO: 20870 - DNA, 1287 bp, Sorghum bicolor
  misc_feature: Ceres ANNOT ID no. 8671660
  misc_feature: Down-regulated in shoot tissues in response to aminocyclopropane carboxylic treatment
  misc_feature: Encodes the peptide sequence at SEQ ID NO 20871
atggggtgcttcctctcctgcttccgcggcggctccgatccgtccggcgatctccgcgacccgctcgtgagggagagccgcctcggggacgccttcctgaacgacgagaaaaagtttgatgaagctactggaaagccggatgcggtggcggcttatggccatggagttgacgaggagcttcggagagaggccaattatctcaagtcatgtggcacaatctcacaaacgccaccggaaattctagattcagtcccaatcaattcagaagatgctgatgagtgcggtgacacaccaaccaacgtgcagctgatgaaagatgcagtgctacttgaagaaaactcatctgaattgctcaactctggtgagcatgatgtatcgacatgtaaggaggacattgatgaaggtactctcggggtgggatcagaaactcagtcatccttacaggacaagcctttatatcagaatgttagagatcaaagcactgattccaatgattcaccttacccaacccctctggtcctaaggggtgacattcagacccctggaactatttatactgcttataaggagacttcgaagcctggaaagcgtacaagggctagcagacagttcatctaccctgttctgcgacccatcgagaacaagatgcagtggatggaactaaaagctgagtctcctgtgctagcatccaatcctccaaaaaggagaaatctgagcgcagattacagcgagaaggctcagcaaacgtttacaagttccacagttacagagaccgaatcttcagaatatgtatccttcccaattcatgacaactgtgcagtgcagattgaagtgatgtcacctgatgaacccaaagaccaaaatatcaaccaacagcaggatgaaggtgaacacctattggagcagagttcagaatatggaaagcgtggagtcacaagcctgtctcattggctgaagccatcttctgcagatgatgagagcaagtgcagccctgatgatggcaacgttgggaaggagacatggtatgagacgagcgtctctgatgtgcctatctttcctgcatttggtttcaactgggaaaccgacaacccaactcctgtgttgcccaaggcatgggacggcaacggcatcccaaataccactaccaaatacaaagaggaccagaaagtcagctggcatgccacgccatttgaagaaaggctgttgaaggttttgtccgacgagaaacctcgccatgaaaggaaaatcagcggaaagcttatccacctcgaggaaaacgccgagtag

SEQ ID NO: 20871 - protein, 428 aa, Sorghum bicolor
  misc_feature: Ceres ANNOT ID no. 8671660
  misc_feature: Down-regulated in shoot tissues in response to aminocyclopropane carboxylic treatment
MGCFLSCFRGGSDPSGDLRDPLVRESRLGDAFLNDEKKFDEATGKPDAVAAYGHGVDEELRREANYLKSCGTISQTPPEILDSVPINSEDADECGDTPTNVQLMKDAVLLEENSSELLNSGEHDVSTCKEDIDEGTLGVGSETQSSLQDKPLYQNVRDQSTDSNDSPYPTPLVLRGDIQTPGTIYTAYKETSKPGKRTRASRQFIYPVLRPIENKMQWMELKAESPVLASNPPKRRNLSADYSEKAQQTFTSSTVTETESSEYVSFPIHDNCAVQIEVMSPDEPKDQNINQQQDEGEHLLEQSSEYGKRGVTSLSHWLKPSSADDESKCSPDDGNVGKETWYETSVSDVPIFPAFGFNWETDNPTPVLPKAWDGNGIPNTTTKYKEDQKVSWHATPFEERLLKVLSDEKPRHERKISGKLIHLEENAE

SEQ ID NO: 20872 - DNA, 1503 bp, Sorghum bicolor
  misc_feature: Ceres ANNOT ID no. 8671725
  misc_feature: Down-regulated in shoot tissues in response to aminocyclopropane carboxylic treatment
  misc_feature: Up-regulated in root tissues in response to methyl jasmonate treatment
  misc_feature: Down-regulated in shoot tissues in response to methyl jasmonate treatment
  misc_feature: Down-regulated in shoot tissues in response to salicylic acid treatment
  misc_feature: Encodes the peptide sequence at SEQ ID NO 20873
atggggaggaagaagcaggcaacagggaagagggaggaggaagcagcaggcagcagggaagagggaggaggaagcagcaagcaagcagcaagcagcatgagcaggagcagcagctcagtagctgacggctggagtgggaagatcgtgagggggcagagaagatggcatttcttgcttgaggatgggcaacgtgcagcagctctattgttaggaattaggattggatcctgggagatggctgagggggcaaggtttcatggtatgataggcggaggtggtggcaaggggatgcaagacaatgagattaatggcttctacaacatgccgtattaccaaaagtttggggagggctctcacatgtctgtagacagcgccgatggcttcaacatgaccaattgcgctggtggttctgttgccatgtcagtggacaacagcagtgtgggctccaacgagtcccgcacagtcatactgaagcatccaggccttcgtgatgccccaactgcaagctattcagttggcaatagtgtcttccgccccaaccgtgtggctgcacacacgctaaatgaggatgcattggcccgggttttgatggacccaaatcatcctacagagatactcaacagctatgagcagtggaccattgatctggggaggttggacatgggggatccttttgctcaaggagcctttggaaagctgtaccggggaacatataatggagaagatgttgccattaagctgctggagaagcctgagaatgatccagaaagagctcatttgatggagcagcaatttgtacaagaagttatgatgttgtctaggctgagtcacccaaatattgtaaggttcataggggcatgcaggaaatcaatcgtgtggtgtattattacggagtatgcaaaaggtggctcagtccggcaattcctggctagaaggcagaacaaatcggtgcctttgcggttggctgtgaaacaggcgttggatgtagcccggggaatggcatatgttcatgcattgggatttattcacagagatctgaagtcagataaccttctgatttcagcagacaaatccattaagattgccgactttggagttgctcgtatcgaagtgaaaactgaagggatgacaccagagacaggaacctaccgctggatggcaccggaaatgatccagcacaggccctatgatcataaagttgatgtctatagctttggcatcgtcttgtgggagctaataaccggcatgcttccgttcaccaacatgacggctgttcaggcagctttcgctgttgtaaataagggtgctcgcccggtaattcctcaagattgcctgccttctctaagccacattatgactcgttgctgggatgcaaacccagaagttcgcccaccatttactgagattgtctgcatgcttgagagtgctgagatggagcttgtgagcaacgtgcgcaaagcacgcttccgctgctgtatttctgaacccatgaccaccgactga

SEQ ID NO: 20873 - protein, 500 aa, Sorghum bicolor
  misc_feature: Ceres ANNOT ID no. 8671725
  misc_feature: Down-regulated in shoot tissues in response to aminocyclopropane carboxylic treatment
  misc_feature: Up-regulated in root tissues in response to methyl jasmonate treatment
  misc_feature: Down-regulated in shoot tissues in response to methyl jasmonate treatment
  misc_feature: Down-regulated in shoot tissues in response to salicylic acid treatment
  misc_feature (210)..(474): SWISSPROT Homolog: EC 2.7.11.1 Non-specific serine/threonine protein kinase
  misc_feature (219)..(473): Pfam ID: Pkinase_Tyr Pfam Description: Protein tyrosine kinase
MGRKKQATGKREEEAAGSREEGGGSSKQAASSMSRSSSSVADGWSGKIVRGQRRWHFLLEDGQRAAALLLGIRIGSWEMAEGARFHGMIGGGGGKGMQDNEINGFYNMPYYQKFGEGSHMSVDSADGFNMTNCAGGSVAMSVDNSSVGSNESRTVILKHPGLRDAPTASYSVGNSVFRPNRVAAHTLNEDALARVLMDPNHPTEILNSYEQWTIDLGRLDMGDPFAQGAFGKLYRGTYNGEDVAIKLLEKPENDPERAHLMEQQFVQEVMMLSRLSHPNIVRFIGACRKSIVWCIITEYAKGGSVRQFLARRQNKSVPLRLAVKQALDVARGMAYVHALGFIHRDLKSDNLLISADKSIKIADFGVARIEVKTEGMTPETGTYRWMAPEMIQHRPYDHKVDVYSFGIVLWELITGMLPFTNMTAVQAAFAVVNKGARPVIPQDCLPSLSHIMTRCWDANPEVRPPFTEIVCMLESAEMELVSNVRKARFRCCISEPMTTD

SEQ ID NO: 20874 - DNA, 1578 bp, Sorghum bicolor
  misc_feature: Ceres ANNOT ID no. 8671718
  misc_feature: Up-regulated in shoot tissues in response to salicylic acid treatment
  misc_feature: Encodes the peptide sequence at SEQ ID NO 20875
atggcgatgatgactctgcgacgcgcggtggcgctcggtgcccgacacatccccgccgtcgcagccgcttcctcccgcatcgtccccctccgacacatgagcgcgggcgcgggcgccgcggtggagaagatccgcgccgccgggctgctcaggacgcaggggctcatcgccgggaagtgggtggacgcctacgacgggaagaccatcgaggtgcaaaatccagcaactggtgaggtccttgcaaacgtgccctgtatgggcagcagagaaacatctgatgctattgcttctgctcacagtacattctattcttggagtaaactcactgcaggtgagaggagcaaggcactaagaaaatggtacgatctaattatttcacacaaggaagagcttgcacttctcatgacactggagcaggggaaacctatgaaagaagccctgggtgaggtcaattatggtgcaagtttcatagaatattttgcagaggaagcaaagcgtatatatggtgatatcattcccccaactttatctgatcgcagattgttggttctgaagcagcctgttggggtagttggagctattacaccatggaattttccattagcaatgataacccgaaaggttggaccagctttggcgtgtggctgcactgttgttgtcaagccatcagagttcacccctctgacagcattagctgcagcagatcttgctcttcaagctggaataccagcgggtgcactaaatgttgtgatgggtaatgctcctgagataggtgatgcattactgcagagtacacaggtcagaaagattacgttcactggatcaacagctgttggcaaaaaactgatggctggatctgcaaatactgtgaaaaaggtctccttggaacttggtgggaatgcaccttgcattgttttcgatgatgcagacattgatgttgctgttaaaggcagtcttgctgccaagttccgtaacagtggacagacatgtgtttgtgcaaacaggatattggtgcaagaaggtatctacgaaaagtttgcaactgcattcatcaaggctgttcagagtttgaaggttgggaatgggctagaagagagtacatctcagggtcctctgattaacgaagctgctgttcagaaggtggagaagttcataaatgacgcgacttcaaagggagcaaatatcatgctaggtggtaaaagacacagcctggggatgacattttatgagccaactgtagtagggaatgtcagcaatgatatgcttcttttcagagaagaagtttttggtccagttgcaccccttataccattcaaaactgaggaagaagcagtccatatggccaacgatacaaacgcaggcttagctgcatacatatttaccaagagcatacctcgttcatggcgtgtatctgaatctcttgaatacggcttagttggggtaaacgagggaattatttcaacagaggtggcaccatttggtggagtaaagcagtctggtctagggagggaaggttcgaagtacggcatcgacgaatacttggagctcaagtacatctgcatgggaaacttgggttga

SEQ ID NO: 20875 - protein, 525 aa, Sorghum bicolor
  misc_feature: Ceres ANNOT ID no. 8671718
  misc_feature: Up-regulated in shoot tissues in response to salicylic acid treatment
  misc_feature (31)..(524): SWISSPROT Homolog: EC 1.2.1.24 Succinate-semialdehyde dehydrogenase
  misc_feature (60)..(519): Pfam ID: Aldedh Pfam Description: Aldehyde dehydrogenase family
MAMMTLRRAVALGARHIPAVAAASSRIVPLRHMSAGAGAAVEKIRAAGLLRTQGLIAGKWVDAYDGKTIEVQNPATGEVLANVPCMGSRETSDAIASAHSTFYSWSKLTAGERSKALRKWYDLIISHKEELALLMTLEQGKPMKEALGEVNYGASFIEYFAEEAKRIYGDIIPPTLSDRRLLVLKQPVGVVGAITPWNFPLAMITRKVGPALACGCTVVVKPSEFTPLTALAAADLALQAGIPAGALNVVMGNAPEIGDALLQSTQVRKITFTGSTAVGKKLMAGSANTVKKVSLELGGNAPCIVFDDADIDVAVKGSLAAKFRNSGQTCVCANRILVQEGIYEKFATAFIKAVQSLKVGNGLEESTSQGPLINEAAVQKVEKFINDATSKGANIMLGGKRHSLGMTFYEPTVVGNVSNDMLLFREEVFGPVAPLIPFKTEEEAVHMANDTNAGLAAYIFTKSIPRSWRVSESLEYGLVGVNEGIISTEVAPFGGVKQSGLGREGSKYGIDEYLELKYICMGNLG

SEQ ID NO: 20876 - DNA, 3435 bp, Sorghum bicolor
  misc_feature: Ceres ANNOT ID no. 8671808
  misc_feature: Up-regulated in root tissues in response to salicylic acid treatment
  misc_feature: Encodes the peptide sequence at SEQ ID NO 20877
atgagttccgggtcggcggtgacaggcgggggtgcggaggaggcggcggcggtgccgctggggcagaagctgatggtgcacgtggcggagaacggcaacacactggagttccagtgcggcggcgacacgctcgtcgaggccatccagcactccatccagctccactgcggcataccgcccaacgaccagctcctcctctgcggcaacacctccctcgacggcaccaacgggcacgcgctcgcctactacaagcttccgcgcgacgaccgtgaggtcttcctctacaacaaggcccggcttcttgcggactcccggcccccagcgccggagtccctctacatccctgagccaaatattccaccgccgccccggccgcaggactcaccacctgtggacgcatctgcagacccggcgctgaaggcgctggtatcttatgaaacaaggttcagatatcacttccaggtcgccaatgcggtgtaccaatctagcttggcaaaatttgagctgtgcaggcggcttctgcgggaggggcaggtgcaggagcgagcgctggacacggcacggagcaacctagagcacacattccggaagctctcgcagcggtattcagattttttgcggtgcttcactcagcagcaccgttcacatgttgagatgctggctaattttgagagagatgtacagaagctgcgtgctgttaggctgcatccagcgttgcaaagtgaggagcggcattgcttgatggaccttctcaaggagaatgacctgcggaaattggctgacggatgcttgagctcacataagaagtttgaggttaaggtatcacagctgaaggccaacttcttggagctgaagaagagggtggaaggcttattcaatgccatgagctcaggtgggtgcaaggatgttgagaagctgataaaggagcatcagggaatcattggtgaccagaagatcatcatgcaagctctaagtaaagatgtggacacctcaaagaagcttgttgatgactgctcaagtttccagctatctgcttctctccgccctcatgatgcagtctcagcggttggccgtatctatgaagtacatgaaaaggataacttgcccagtatacggaattttgatcacaggcttacaaaattgcttgagaaatgcaaggacaagaaaaatgaaatgaatactttggtccatgtttgcatgcaaagagtaaaatcttctcagattagcatcaaaggcatgatgagtgaactcattgcattccaagaggtgatgggccatcaagaagattttgataatctgaaaatagtcagtggcttgggtcatgcatatagagcttgtgtcgccgaggtagccaggaggaaatcgtattttaagctgtatactggattggctggaacatatgctgaaaagttggcaaccgagtgtcaaaacgagaaaacaagacgagaggatttccataggacatggagcaggtacattccagataatgtcatgtgttccatgggactctttgattctccaagccagtgtgatgtgaaagttgctccttttgatcgtgatcttcttcccattgatgttgatgatgtggaaaagcttgcaccccagtctatacttgggtcttttctgaaatctgagagatcacagctagcaaagcctttgctaagcaattctagtaccagtggaaatttgaacaaatctgagcaaaatcctctgagcgctgatgataagatggatttccaagattttctggggggctatgattctattgatattgcaggaactagtaagttagaagtggaaaatgccaggttaaaagcagaacttgcttctgcaattgcaattctctgcaatgtcggtgctgaatatggatatgagtctattgacgaagggcaaattgatgctgtattgaaaaaggcaagggaaaaaacagctgaggcacttgctgcgaaggatgagtttgcttaccagcttcagtcattgctcactgcaaagcaggaaaaatgcttggcatatgagaagcggatccaggatcttgaggaacgcttagccaaccagtacatgcaaggtcacatggtatcaggaagcaaaggcacgtctgattccctgctttctgcatttaaaagtaacgactgcaacctggatgtatctggagtcaggcaaacccaaatacgtgatgaatcaagtgtggccatggatgagacctcttcaacatctgaacagccatctaaacaaacagaaggtggtgatgagaatatgactgacatttcaggtgcactgaacttgcagttgctcgattcagcagcatgtactaatctggatgctttcatgacagaattgccacgtgataatgaacataagatcgtaaacattgataaggaagggcccatgttgacacaacttactatggctgatgcttctgatgttcgtatagaagatcctcttagcatcttaaactcaagaactaatgagcatcatgccttagagttgaggaataaggagctccttgtgtcagagctgcagaataccctagatcaaaaatcaaagcagttgggtgaaactgaaattaaacttagtgctatgatggatgaggttaactccctgaataaagaacttgaacaaacccggggtcttcttgatgaatctcagatgaattgtgcacaccttgaaaactgtttacatgaagcaagagaagaggcccgaacaaacaaatgttcagctgacagaagggctgttgagtatgatgctctgcggtcgtctgctttgaggatacatggtttgttcgaaaggctaaataattgtgtcactgcacccggtgtgactggctttgcagagtcactgcgttctttggctatctccttggcaagctctgtaaagaaggatgaagctgataccactgttcagtttcaacaatgcatcaagatcctggccgacaaagtttatttattgacacgacagagtgctgatctgctagaacgctattcagctatgcaggcagtacatggaggtatcacaaaagagttggatgagaagaaagagctgattaagaatctctacaataaacttcaactagaaaaacaggccagcaaggagaagatatcatttggtcgatttgaagtccatgagcttgccgtcttcttccgaaacccggctgggcactatgaggcgatcaatcggaactgctcaaactactacctgtctgaggaatctgtcgccttgttcactgagcaccacccggtgcacccagcatacataatcgggcagatcgttcacattgagcggcgcatagtgcacccaggtcagatgggaggagctccacgccgtgatagcagtggtggccgtcggtcgcccgcatccatgctcaacccctacaaccttcctgggggctgtgagtacttcgtggtgactgttgccatgctgcctgatgctgcccgttga

SEQ ID NO: 20877 - protein, 1144 aa, Sorghum bicolor
  misc_feature: Ceres ANNOT ID no. 8671808
  misc_feature: Up-regulated in root tissues in response to salicylic acid treatment
MSSGSAVTGGGAEEAAAVPLGQKLMVHVAENGNTLEFQCGGDTLVEAIQHSIQLHCGIPPNDQLLLCGNTSLDGTNGHALAYYKLPRDDREVFLYNKARLLADSRPPAPESLYIPEPNIPPPPRPQDSPPVDASADPALKALVSYETRFRYHFQVANAVYQSSLAKFELCRRLLREGQVQERALDTARSNLEHTFRKLSQRYSDFLRCFTQQHRSHVEMLANFERDVQKLRAVRLHPALQSEERHCLMDLLKENDLRKLADGCLSSHKKFEVKVSQLKANFLELKKRVEGLFNAMSSGGCKDVEKLIKEHQGIIGDQKIIMQALSKDVDTSKKLVDDCSSFQLSASLRPHDAVSAVGRIYEVHEKDNLPSIRNFDHRLTKLLEKCKDKKNEMNTLVHVCMQRVKSSQISIKGMMSELIAFQEVMGHQEDFDNLKIVSGLGHAYRACVAEVARRKSYFKLYTGLAGTYAEKLATECQNEKTRREDFHRTWSRYIPDNVMCSMGLFDSPSQCDVKVAPFDRDLLPIDVDDVEKLAPQSILGSFLKSERSQLAKPLLSNSSTSGNLNKSEQNPLSADDKMDFQDFLGGYDSIDIAGTSKLEVENARLKAELASAIAILCNVGAEYGYESIDEGQIDAVLKKAREKTAEALAAKDEFAYQLQSLLTAKQEKCLAYEKRIQDLEERLANQYMQGHMVSGSKGTSDSLLSAFKSNDCNLDVSGVRQTQIRDESSVAMDETSSTSEQPSKQTEGGDENMTDISGALNLQLLDSAACTNLDAFMTELPRDNEHKIVNIDKEGPMLTQLTMADASDVRIEDPLSILNSRTNEHHALELRNKELLVSELQNTLDQKSKQLGETEIKLSAMMDEVNSLNKELEQTRGLLDESQMNCAHLENCLHEAREEARTNKCSADRRAVEYDALRSSALRIHGLFERLNNCVTAPGVTGFAESLRSLAISLASSVKKDEADTTVQFQQCIKILADKVYLLTRQSADLLERYSAMQAVHGGITKELDEKKELIKNLYNKLQLEKQASKEKISFGRFEVHELAVFFRNPAGHYEAINRNCSNYYLSEESVALFTEHHPVHPAYIIGQIVHIERRIVHPGQMGGAPRRDSSGGRRSPASMLNPYNLPGGCEYFVVTVAMLPDAAR

SEQ ID NO: 20878 - DNA, 1533 bp, Sorghum bicolor
  misc_feature: Ceres ANNOT ID no. 8671864
  misc_feature: Down-regulated in shoot tissues in response to salicylic acid treatment
  misc_feature: Encodes the peptide sequence at SEQ ID NO 20879
atggattcgctcacgtactacctgtgcctcttcttggcggctctcctccctctcttgctcctcaagctcaagaaccgtgacaacaatagcctcaggctgccgccgggcccatggcggctgccggtcatcggcagcctccaccacctgctcggcagcccgttcccccaccatgccatggctgacatcgcgcgccggctcgaggcgcccctcatctacctcaagctcggtgaggttcctgtcgtcgttgcgtcgtcgcaggacgccgctagcgagatcatgaagacgcacgacgtcaacttcgccacgcgcccgttgagcccgacgataaaggtcttcatggcagatggggtaggcctggtgttcgcgccctacggcgctctgtggcggcagctccgcaagatcagcatcctggaactgctcagcgcccgccgcgtgcagtcgttccgcggcgtccgggaggaggaggtcggccgcctcgtggctgccatcgcggcggcgtcgctgacgggcgaggccgtgaacgtcagccagaggatcgccgagctcacgaatgacacggccgtgcgctccatgatcggcgaccggttcgagaggcggcaggaattcctggataatatggcggagggagtaaagatcaccaccgggttcagcctcggcgatctgttcccgtcgtcgaggctggcgagcgtcatcggtggcatggctcgtcgggcggcggtaaaccaccgtaagatgttcgagctgatggactacgccatcaaaaagcacgaggagcagagggcagccatggccaaatctgcagagggagagggcatcgtgaaggaggatctggtggacgtgcttctgaggatacagaaggaaggtggcctggaggtgccactcaccatgggaatgatcaaggccatcatcctggacctttttggtgcggggagtgagacctctgcaagtacacttcaatgggctatgtcagagcttgtacgcaacccaaaactgatggaaagggcacaagtcgaggtacgcgagaagcttcaggggaagccaacggtgactgaagatgacttggttgagttgaggtacataaagctcatcatcaaagagaccctaaggatgcatccggtggtgccattgcttctcccaagggagtgtagagagtcatgcaaggtcatggggtatgatgtacccaagggaactactgtgtttgtgaatgtttgggcgatcagcagggatcccaaatattgggaagatgctgcgacattcaaaccggaacgatttgaggctggtacaattgatttcaagggcacagactttgaatacactccctttggggcaggtcggaggatgtgcccgggcttagcatttgcgcaggcaagcatggagatcgtgctcgcagcactcctataccattttgactggaagctgcctgatgggatgctgccaagtgaattggacatgacggaggagatgagcatcaccgcccgaaggaaacacgatctttacctgcagccagttgtcagtgtgccaccacatgtatga

SEQ ID NO: 20879 - protein, 510 aa, Sorghum bicolor
  misc_feature: Ceres ANNOT ID no. 8671864
  misc_feature: Down-regulated in shoot tissues in response to salicylic acid treatment
  misc_feature (34)..(502): SWISSPROT Homolog: EC 1.14.13.68 4-hydroxyphenylacetaldehyde oxime monooxygenase
  misc_feature (34)..(501): Pfam ID: p450 Pfam Description: Cytochrome P450
MDSLTYYLCLFLAALLPLLLLKLKNRDNNSLRLPPGPWRLPVIGSLHHLLGSPFPHHAMADIARRLEAPLIYLKLGEVPVVVASSQDAASEIMKTHDVNFATRPLSPTIKVFMADGVGLVFAPYGALWRQLRKISILELLSARRVQSFRGVREEEVGRLVAAIAAASLTGEAVNVSQRIAELTNDTAVRSMIGDRFERRQEFLDNMAEGVKITTGFSLGDLFPSSRLASVIGGMARRAAVNHRKMFELMDYAIKKHEEQRAAMAKSAEGEGIVKEDLVDVLLRIQKEGGLEVPLTMGMIKAIILDLFGAGSETSASTLQWAMSELVRNPKLMERAQVEVREKLQGKPTVTEDDLVELRYIKLIIKETLRMHPVVPLLLPRECRESCKVMGYDVPKGTTVFVNVWAISRDPKYWEDAATFKPERFEAGTIDFKGTDFEYTPFGAGRRMCPGLAFAQASMEIVLAALLYHFDWKLPDGMLPSELDMTEEMSITARRKHDLYLQPVVSVPPHV

SEQ ID NO: 20880 - DNA, 1521 bp, Sorghum bicolor
  misc_feature: Ceres ANNOT ID no. 8671868
  misc_feature: Down-regulated in shoot tissues in response to salicylic acid treatment
  misc_feature: Encodes the peptide sequence at SEQ ID NO 20881
atggactcgctcacctactacctgtgcctcttcttggcggctctcctccctctcttgctcctcaagctcttcaagaaccgtgacaacaatagcctcaggctgccaccgggcccatggcggctgccggtcatcggcagcctccaccacctgctcggcagcccgttcccccaccatgtcatggctgacatcgcgggccggctcgaggcgcccctcatctacctcaagctcggtgaggttcccgtcgtcgttgcgtcgtcgcaggacgcggctcgcgaaatcatgaagacgcacgacgtcaatttcgccacgcgcccgttgagcccgacgatgaaggacctcatggcagatgttgaaggcctggtgttcgcgccctacggccctctgtggcggcagctccgcaagatcagcaccatggagctgctcagcgcccgccgcgtgcagtcgttccgcggcgtccgggaggaggaggtcggccgcctcgtggctgccatcgcggcggcgtctccgacgggcgaggccgtgaatctcagccagaggatcgccgagctcacgaatgacacggccgtgcgctccatgatcggcgaccggtttgagaagcagcaggaattcctggagaatatggcggagcggagggacctcggcgatctgttcccgtcgtcgaggctggcgagcgtcatcggtggcatggctcgtcgggcggcggtaaaccgccgtaagatgttcgagctgatggactacgccatcaaaaagcacgaggagcggagggcagccatggccaaatctgcagagggagagggcatcgtgaaggaggatctgctggacgtgcttctgaggatacagaaggaaggtggcctggaggtgccactcaccatgggaatgatcaagggcatcatcatggacctttttggtgcggggagtgagacctctgcaagtacacttcaatgggctatgtcagagcttgtacgcaacccaaaagtgatggaaatggcacaagccgaggtacgcgaaaagctgcaggggaagccaacggtgactgaagatgacttggttgagttgaggtacataaagctcatcatcaaagagaccctaagggtgcatccggtggtgccattgcttctcccaagggagtgtagagagtcatgtaagatcatggggtatgatgtacccaagggagctactgtgtttgtgaatgtttgggcgatctgtagggatcccaaatactgggacgatgctgcaacattcaaactggaacgatttgaggctggtacaattgatttcaagggcacagactttgaatacacaccctttggggcaggtcggaggatgtgccccggcatggcatttgcgcaggcaagcatggagctcgtgctcgcagcactcctgtaccattttgactggaagctgcctgatgggatgctgccaagtgaattggacatgacagaggagatgagcatcaccgcccgaaggaaacatgatctttacttgcagccagttgtcagtgtgccgccacatgcagtataa

SEQ ID NO: 20881 - protein, 506 aa, Sorghum bicolor
  misc_feature: Ceres ANNOT ID no. 8671868
  misc_feature: Down-regulated in shoot tissues in response to salicylic acid treatment
  misc_feature (33)..(497): SWISSPROT Homolog: EC 1.14.13.68 4-hydroxyphenylacetaldehyde oxime monooxygenase
  misc_feature (35)..(496): Pfam ID: p450 Pfam Description: Cytochrome P450
MDSLTYYLCLFLAALLPLLLLKLFKNRDNNSLRLPPGPWRLPVIGSLHHLLGSPFPHHVMADIAGRLEAPLIYLKLGEVPVVVASSQDAAREIMKTHDVNFATRPLSPTMKDLMADVEGLVFAPYGPLWRQLRKISTMELLSARRVQSFRGVREEEVGRLVAAIAAASPTGEAVNLSQRIAELTNDTAVRSMIGDRFEKQQEFLENMAERRDLGDLFPSSRLASVIGGMARRAAVNRRKMFELMDYAIKKHEERRAAMAKSAEGEGIVKEDLLDVLLRIQKEGGLEVPLTMGMIKGIIMDLFGAGSETSASTLQWAMSELVRNPKVMEMAQAEVREKLQGKPTVTEDDLVELRYIKLIIKETLRVHPVVPLLLPRECRESCKIMGYDVPKGATVFVNVWAICRDPKYWDDAATFKLERFEAGTIDFKGTDFEYTPFGAGRRMCPGMAFAQASMELVLAALLYHFDWKLPDGMLPSELDMTEEMSITARRKHDLYLQPVVSVPPHAV

SEQ ID NO: 20882 - DNA, 1368 bp, Sorghum bicolor
  misc_feature: Ceres ANNOT ID no. 8671946
  misc_feature: Up-regulated in root tissues in response to salicylic acid treatment
  misc_feature: Up-regulated in shoot tissues in response to salicylic acid treatment
  misc_feature: Encodes the peptide sequence at SEQ ID NO 20883
atgggtattgggaatggatcatcaagcaatgtgtcgcacaaagcgatgcaagatgagaccacgccgcttctcccgatcaaagctgaggaggacgtggttcacgagttcgatggagcttctttctctggtgcggtcttcaatctgtcgacgaccattgtaggggctggaatcatggctctgcctgcgagtatcaagatgctaggccttatccctggtattctaatgatcatccttgtggcgttgctcaccgaggcatccattgacatgctggtcaggtgcagccaccagggcaagattacatcctacgggtggttgatgggtgacacttttggtcagtgggggagaattgccctacaagcatcagtggtgataaacaatgtcggcgtattgattgtatacatgattattattggcgatgtcctatcaggaacatcatcaacaggtgttcatcacagtggtgtatttgaggggtggtttggacctcatatgtggaattctcgtcccattgtactcctcactacaactcttgttgtatttgctccattggtgagctttaagcgtctggattcattgagatacacatctgcactatcagttgctcttgctgtggtttttgttgtaatcactgctggggttgctattgtcagactcatccaaggaactgtggagatccccaaactctttcctgagatagatggagttagttctgtctggaaactgtttacagctgtgcctgttcttgtcactgcctacatctgccactacaatgttcacagcattgataatgagctggaggacaagacccaaattaaaccaattgtacaaacttcactgggactctgctcaagtgtttacattgcaacaagcttctttgcatatctcctcttcggcgaggctaccttggctgatgtgcttgccaatttcgattctgaccttcgcattccattcagctctgtcttcaatgacatagtgagagtgagctatgttgtccatatcatgcttgtctttcctatagtcttctttgcccttaggctcaacctggatggattactctttcccaccgcaaggcacatttcccatgacaacaagaggttcaccattatcaccatctcgctcattgctgtaatttatcttgctgctatcttcgtaccgagcatctgggatgcgttccaattcactggcgccacagctgctgtgcttattggtttcatctttcctgccatgattatactcagggatccatatggtgtttccaccaagcgtgacaaggttttggcggtaacaatgattgtgcttgctgtggtgtccaattctgtggccctgtacagcgatgcgctcaacatcttctacaggaagcaggaggcctag

SEQ ID NO: 20883 - protein, 455 aa, Sorghum bicolor
  misc_feature: Ceres ANNOT ID no. 8671946
  misc_feature: Up-regulated in root tissues in response to salicylic acid treatment
  misc_feature: Up-regulated in shoot tissues in response to salicylic acid treatment
  misc_feature (37)..(443): Pfam ID: Aa_trans Pfam Description: Transmembrane amino acid transporter protein
MGIGNGSSSNVSHKAMQDETTPLLPIKAEEDVVHEFDGASFSGAVFNLSTTIVGAGIMALPASIKMLGLIPGILMIILVALLTEASIDMLVRCSHQGKITSYGWLMGDTFGQWGRIALQASVVINNVGVLIVYMIIIGDVLSGTSSTGVHHSGVFEGWFGPHMWNSRPIVLLTTTLVVFAPLVSFKRLDSLRYTSALSVALAVVFVVITAGVAIVRLIQGTVEIPKLFPEIDGVSSVWKLFTAVPVLVTAYICHYNVHSIDNELEDKTQIKPIVQTSLGLCSSVYIATSFFAYLLFGEATLADVLANFDSDLRIPFSSVFNDIVRVSYVVHIMLVFPIVFFALRLNLDGLLFPTARHISHDNKRFTIITISLIAVIYLAAIFVPSIWDAFQFTGATAAVLIGFIFPAMIILRDPYGVSTKRDKVLAVTMIVLAVVSNSVALYSDALNIFYRKQEA

SEQ ID NO: 20884 - DNA, 1980 bp, Sorghum bicolor
  misc_feature: Ceres ANNOT ID no. 8672037
  misc_feature: Up-regulated in shoot tissues in response to methyl jasmonate treatment
  misc_feature: Up-regulated in root tissues in response to methyl jasmonate treatment
  misc_feature: Encodes the peptide sequence at SEQ ID NO 20885
atgggccgccgtcccgatgtccgcttcgtctcctccggcgtcaagctcccgtccgcgcccgcctccgcgccgtccccggcgcccgcgccggcgctcctctccgcggcgctgccgttcgcgcacatcggccgcgccatcgacgccgccgcccgccgcctgggctcctgcctcccccgcgtccccgtcgcgcgggccgacccggcggccccgcccccgctggcgcggcggcatgggaaggacggcggagggcccgaggagcgggtgctgatcagcgaggtcgcggtgcgggggaaggacggggagccgctggagcgggccgagctggaggcggcggccgccgcggcgctgcgcgcgtgccgccccaacgccgcgctcaccgtgcgggaggtgcaggaggacgtgcaccgcatcgtcgagagcggacttttccggtcgtgcatgcccgtcgctgtcgacacccgcgatggcattcgcctcgtcttcgaggtggagccgaaccaagacttccatgggctggtttgtgagggcgccaacatgctaccatccaagttcctggaagatgcattccgtgatcgccatggaaaaattattaacattaggcatctggataaagtgatcaaatctgtcaatggatggtaccaggagcgtggcctaactgggttggtttcatatgctgagatactttctggaggggttctgaggctgcaggtttcagaagctgaggttaataacattagcattcgcttcctagacaggaagactggtgaaccaactcttggaaaaacacagccagaaaccatccttcggcagcttaccaccaagaaagggcaggcttacaatagggcacaggtgaaaagggatgtagaaacaattcttactatgggaatcatggaggatgttacaataattccacagccagttggagattctaataaagtggaccttgtcatgaatcttgttgaacgcccttcgggtggtttctctgctggtggtggaatttcaagtgggataacaaatggacccctttctggacttattggcagctttgcatattcacatcggaatgtttttgggaggaacaagaaattaaatctctctttggaaagggggcaaatcgattcgatatttagattgaactttactgacccttggattgatggcgacaataagagaacctccagaactgttatggttcagaactctaggactcctggaacacttgtccatggtggtgatcatcctgaccatgggcccataacaattggacgtgttactgctggcttggaatacagtcgaccattcagacccaagtggagtgggacacttggcttaatttttcagcatgctggtgctcgtgatgataaagggagtccggtcataagggatttctataacagccaattaactgccagtggacatgattatgatgatactctgctagctaagtttgaaagtgtctacacagattctggagaccatagctccacaatgtttgttttcaacattgagcaaggtctccctgttcttcctgagtggcttagcttcaacagagtgacagcacgtttgaggcagggatatgaaattggtccagctaggcttcttctaagtgcttctggaggtcacgtggagggaaattttccacctcatgaagcatttgctattggtgggactaatagtgtaagaggatatgaagaaggtgctgttggctctgggcgttcttatgccgttggtagtggtgaagtttcatgccgcctgtttgggccactggaaggcgtgatctttggcgactatggcagtgatcttggttctggtcctaaagttcctggtgacccagccggagctcgtggaaagccaggcagtggctatggctacggtgttggcgtccgcgtggactccccactgggacctctacggcttgagtacgccttcaatgataagcaagcaagccgattccactttggtgttggctacagaaattaa

SEQ ID NO: 20885 - protein, 659 aa, Sorghum bicolor
  misc_feature: Ceres ANNOT ID no. 8672037
  misc_feature: Up-regulated in shoot tissues in response to methyl jasmonate treatment
  misc_feature: Up-regulated in root tissues in response to methyl jasmonate treatment
  misc_feature (355)..(659): Pfam ID: Bac_surface_Ag Pfam Description: Surface antigen
  misc_feature (240)..(322): Pfam ID: Surf_Ag_VNR Pfam Description: Surface antigen variable number repeat
MGRRPDVRFVSSGVKLPSAPASAPSPAPAPALLSAALPFAHIGRAIDAAARRLGSCLPRVPVARADPAAPPPLARRHGKDGGGPEERVLISEVAVRGKDGEPLERAELEAAAAAALRACRPNAALTVREVQEDVHRIVESGLFRSCMPVAVDTRDGIRLVFEVEPNQDFHGLVCEGANMLPSKFLEDAFRDRHGKIINIRHLDKVIKSVNGWYQERGLTGLVSYAEILSGGVLRLQVSEAEVNNISIRFLDRKTGEPTLGKTQPETILRQLTTKKGQAYNRAQVKRDVETILTMGIMEDVTIIPQPVGDSNKVDLVMNLVERPSGGFSAGGGISSGITNGPLSGLIGSFAYSHRNVFGRNKKLNLSLERGQIDSIFRLNFTDPWIDGDNKRTSRTVMVQNSRTPGTLVHGGDHPDHGPITIGRVTAGLEYSRPFRPKWSGTLGLIFQHAGARDDKGSPVIRDFYNSQLTASGHDYDDTLLAKFESVYTDSGDHSSTMFVFNIEQGLPVLPEWLSFNRVTARLRQGYEIGPARLLLSASGGHVEGNFPPHEAFAIGGTNSVRGYEEGAVGSGRSYAVGSGEVSCRLFGPLEGVIFGDYGSDLGSGPKVPGDPAGARGKPGSGYGYGVGVRVDSPLGPLRLEYAFNDKQASRFHFGVGYRN

SEQ ID NO: 20886 - DNA, 795 bp, Sorghum bicolor
  misc_feature: Ceres ANNOT ID no. 8672070
  misc_feature: Down-regulated in root tissues in response to salicylic acid treatment
  misc_feature: Encodes the peptide sequence at SEQ ID NO 20887
atggaagcgggctggttctttctcacaatccgggctcctcgtatacttaggcccgctgcttccccactgggcctacatgggctggccgatcacctgctaggagtcggtctaacagacctgcctctccggctctcccgttcccctcccactgccagtccacctcgctctctcgtctcgtggcttcctggcggcggctgggcgagcggcggcgccctcgttgggctcttcaccggcgacgagcatccatctggcggagaatattgcactcacataactgatcttaggatgagtctctgtacaatagctcgacgactatgtctttcgaaaccatcctctggcagacgtctttcagtagtttggggtcatctatacagcaccgaggttgcttctgagaaagttgtggatctagctgaccgcatcgctgctctccctcctgaggagatcaaacagattgctccagcccttctcttcagactgaaccgagaaccgccacaggtgatatctggccagggtttcagttttggtgctcagggtggttctggggctggtgctgggaaggctgaggagaagaaagctgagaagacagtcttcgatgtcaagttggagaagttcgatgctgctgcaaagatcaagattatcaaggagatcaggacatttacggatttggggctgaaggaggcaaaggagctagtggagaaggcacctgtcattctgaagcaatccctcacaaaggaggaagcagaagcaatcatagggaagataaaggcagctggtggtgttgctgtgatggagtga

SEQ ID NO: 20887 - protein, 264 aa, Sorghum bicolor
  misc_feature: Ceres ANNOT ID no. 8672070
  misc_feature: Down-regulated in root tissues in response to salicylic acid treatment
  misc_feature (197)..(264): Pfam ID: Ribosomal_L12 Pfam Description: Ribosomal protein L7/L12 C-terminal domain
MEAGWFFLTIRAPRILRPAASPLGLHGLADHLLGVGLTDLPLRLSRSPPTASPPRSLVSWLPGGGWASGGALVGLFTGDEHPSGGEYCTHITDLRMSLCTIARRLCLSKPSSGRRLSVVWGHLYSTEVASEKVVDLADRIAALPPEEIKQIAPALLFRLNREPPQVISGQGFSFGAQGGSGAGAGKAEEKKAEKTVFDVKLEKFDAAAKIKIIKEIRTFTDLGLKEAKELVEKAPVILKQSLTKEEAEAIIGKIKAAGGVAVME

SEQ ID NO: 20888 - DNA, 1296 bp, Sorghum bicolor
  misc_feature: Ceres ANNOT ID no. 8672078
  misc_feature: Up-regulated in shoot tissues in response to salicylic acid treatment
  misc_feature: Encodes the peptide sequence at SEQ ID NO 20889
atggactctaacaatgatgatcttgataagcagaatgaagcaatggaaactcaaatattcattcctcaagacgcccaagggattatccttgcttttcttcctggcagggatgttgtcaagtcccgcagtgtatgcaagttctggcgagactgtgttgaagaacctagttttgtggaccgtcacctgaataatgcttgccgcttccaccagtccattgcttgtttcacctcgcttgatcatggcctagtccacatgtacacatttgatcctgccacaatgaatttcagaagcgtggagcttgtattctcaagtaggtttaacatgtcaggcccctgcaatggcttggtgtgtgcctatgatataaaaggcgatgctgaggtcttgaatcccacaacaaggaagcattttaggctcccagattcagtactcaaggtacagtctctttactctgaatattttgttggatttgtgccctccacaaaagagtacaaggtggtctctatccgccaccatgtgcggttcttgacatttgaaatatgcactattggtgcactgtcgtggaggacatggaggacgatacatgaatctgcagagctcctaaaggcaacaaaggcagttattgttaatgatggcatgtattggctacttcttaatgaggcttcctcccatttgtgtcgagaaatcctgacgctcaacctgacagatgagaggttctcaaaaattcccatcccagatgctgtaaaaaaccataatttggaactgtttgaaggggaaggaaagcttcgtttgttgtcaacacattctgatggatctaacaatatagtgtcggatatttgggtggcagacttgactcgtcaagactggatccacttgcagactatcattcctcggatgcctgtgggcataagcccaattttccagctcaagactaaaatcttctttggcaaccagaagagactcctctgtgtagatcttcaggatggtacagtttcatacatcaacatgccttctggtgagactttgatatcttgtggcatgtttgtggagagctttgcacctgctgtgacaggtatggtgagctcgaccgcatcatcgtatggtatccgttcttgtctggctgaaccatcctcagcggaccctgggccatctttccgtggcgcaggatcatcctctgcaagccgtgggcgatcttctggtctcactggatggtccacagctgaccttgagcaatccttcaagagaacaaagagaacgacaaacatgcagtggaagatatcaaaacatagagcaagctag

SEQ ID NO: 20889 - protein, 431 aa, Sorghum bicolor
  misc_feature: Ceres ANNOT ID no. 8672078
  misc_feature: Up-regulated in shoot tissues in response to salicylic acid treatment
  misc_feature (16)..(63): Pfam ID: F-box Pfam Description: F-box domain
MDSNNDDLDKQNEAMETQIFIPQDAQGIILAFLPGRDVVKSRSVCKFWRDCVEEPSFVDRHLNNACRFHQSIACFTSLDHGLVHMYTFDPATMNFRSVELVFSSRFNMSGPCNGLVCAYDIKGDAEVLNPTTRKHFRLPDSVLKVQSLYSEYFVGFVPSTKEYKVVSIRHHVRFLTFEICTIGALSWRTWRTIHESAELLKATKAVIVNDGMYWLLLNEASSHLCREILTLNLTDERFSKIPIPDAVKNHNLELFEGEGKLRLLSTHSDGSNNIVSDIWVADLTRQDWIHLQTIIPRMPVGISPIFQLKTKIFFGNQKRLLCVDLQDGTVSYINMPSGETLISCGMFVESFAPAVTGMVSSTASSYGIRSCLAEPSSADPGPSFRGAGSSSASRGRSSGLTGWSTADLEQSFKRTKRTTNMQWKISKHRAS

SEQ ID NO: 20890 - DNA, 1968 bp, Sorghum bicolor
  misc_feature: Ceres ANNOT ID no. 8672093
  misc_feature: Up-regulated in root tissues in response to methyl jasmonate treatment
  misc_feature: Up-regulated in shoot tissues in response to methyl jasmonate treatment
  misc_feature: Encodes the peptide sequence at SEQ ID NO 20891
atgcctgcgctctacgcttacggagatggcgggtgcctcgtctcggcgccggctgagctgtccgggctcttctgccgcggcgccgtgcagcagcggaagcgcacgctggtggccgcgtccgcggtcgccgtggcggcggcggcggagtgcgtgagggcggccaagaaacagaggcagcagctgccgctgccgctgccgtcgctcgacgcgctcccggacgagtgcctcttcgagatcctgcgccgcgtgcccgggggccgcggccgcggcgcctccgcctgcgtctcccgccgctggctcgcgctcctcggcagcatccgggcctccgagctcggccaggccgccgccgcggcggacaccccgtcgctgcccgacctgaacgaggagttcgtcatggaggaggaggataaggaggagtcccccgcggatcggtgcgccgtcgacagggtcctggagggcaaggaggccactgacgtccgcctggccgccatggccgtcgtcgccggatcccgcggcgggctggagaagctcgccgtccgcggcagccacccgacccgtggcgtcacggaccaaggtctctcggcggtcgcacgcggcagccccaacctcggctcgctcgcgctttgggatgtgcctcttatcaccgatgctgggcttgcggagatcgccgccgggtgcccctcgctggagcgtctggatatctctcgatgccccctcatcacagacaagggcctcgcagctgtcgcgcaggggtgccccaacttggtgtctctgaccatcgaggcatgctccggtgttgctaatgagggcctgagggcgattggccgcagctgcgtgaagctgcaagctgtgaacatcaagaactgccctcttgttggtgaccaaggcatctccagcctggtgtgctctgctaccgcttcgcttgctaagatccggctccagggattgaacataactgatgcttcgcttgctgtgattggatactatgggaaggccgtcactgaccttacactcactcgtctcgctactgttggtgagaggggtttctgggtgatggctaatgctgctggcctgcagaatctcaggtgcatgagtgttacctcttgccctggagtcaccgatcttgcgctcgcttctattgccaagttctgcccaagcttgaagcagctttgcctcaggaagtgtggacatgtgtcggatgctggccttaaggcgttcacagaatcagcaaaggtgtttgagaacttgcagcttgaggaatgcaaccgggttactcttgtcggtattcttgctttcctcctcaactgcagccagaagttcagggctctctctttggtgaaatgcatggggatcaaggatatcggctctgcgcctgcacagcttcctctttgccgatcacttcgtttccttacaatcaaggattgcccaggtttcactgatgcaagcttggctgtggtggggatgatttgccctcagttggagcaggttgacctcagtggtcttggtgaggtcactgacaatgggcttcttccattgatccagtcttctgaagctggtctgatcaaggttgacttgagtggttgcaagaacatcacagatgtggctgtctcctccctggtgaagggacatggaaaatctctgaagaaagtcagccttgagggttgcagcaagataacagatgctagcctattcaccatgtccgagagctgcactgagcttgcggagcttgatctttcaaactgcatggttagtgaccatggtgttgccattctggcatctgcaaggcacctcaagcttcgtgttctctcactgtctggttgctctaaggttactcagaagagtgtgccgttcttgggcaaccttggccagtctcttgagggcctcaaccttcagttctgcaacatgattggcaaccacaacattgcatcgctggagaagcagctctggtggtgtgatatccttgcatag

SEQ ID NO: 20891 - protein, 655 aa, Sorghum bicolor
  misc_feature: Ceres ANNOT ID no. 8672093
  misc_feature: Up-regulated in root tissues in response to methyl jasmonate treatment
  misc_feature: Up-regulated in shoot tissues in response to methyl jasmonate treatment
  misc_feature (459)..(620): SWISSPROT Homolog: EC 1.14.11.27 [Histone H3]-lysine-36 demethylase
MPALYAYGDGGCLVSAPAELSGLFCRGAVQQRKRTLVAASAVAVAAAAECVRAAKKQRQQLPLPLPSLDALPDECLFEILRRVPGGRGRGASACVSRRWLALLGSIRASELGQAAAAADTPSLPDLNEEFVMEEEDKEESPADRCAVDRVLEGKEATDVRLAAMAVVAGSRGGLEKLAVRGSHPTRGVTDQGLSAVARGSPNLGSLALWDVPLITDAGLAEIAAGCPSLERLDISRCPLITDKGLAAVAQGCPNLVSLTIEACSGVANEGLRAIGRSCVKLQAVNIKNCPLVGDQGISSLVCSATASLAKIRLQGLNITDASLAVIGYYGKAVTDLTLTRLATVGERGFWVMANAAGLQNLRCMSVTSCPGVTDLALASIAKFCPSLKQLCLRKCGHVSDAGLKAFTESAKVFENLQLEECNRVTLVGILAFLLNCSQKFRALSLVKCMGIKDIGSAPAQLPLCRSLRFLTIKDCPGFTDASLAVVGMICPQLEQVDLSGLGEVTDNGLLPLIQSSEAGLIKVDLSGCKNITDVAVSSLVKGHGKSLKKVSLEGCSKITDASLFTMSESCTELAELDLSNCMVSDHGVAILASARHLKLRVLSLSGCSKVTQKSVPFLGNLGQSLEGLNLQFCNMIGNHNIASLEKQLWWCDILA

SEQ ID NO: 20892 - DNA, 4050 bp, Sorghum bicolor
  misc_feature: Ceres ANNOT ID no. 8672129
  misc_feature: Up-regulated in root tissues in response to methyl jasmonate treatment
  misc_feature: Encodes the peptide sequence at SEQ ID NO 20893
atggcgccgcttcctccgcgcgagctcctctctgtcatcgaggcggcgctgctgggctccgcggcgccgtcgccggcgcagcgcgtggagctcctccacgccgtccgcgacgccgcccccacgttccgcacgctactctcctatccggggccgaaggcgtctgatcggactcaggtggagagcaaagaggtgcggctcccaggcatgccgcccatcactctcgatgacaccgacgtgcagactgcccttaagttaagtgatgaactcaatctgaatgagattgagtgtgttcgtttgctagttgatgctaacagagagtctgttgcacttgaccaaggtcttgatgctgatctgatgtctgaaattgaggagcaaatccagcctttatttaatgatggtcttcgacaacggataatttcccttgtgaaggagctgaaccgggaagaaccagctggaattggccgaccaagctctgagcgttatgtgcttgatttcagaggagctcttgtggaaagaagggcaattgtctcaagagagagattaagtttgagccactgcctcactctttctgcacttattaaactaatgagccccagagaggttaaggatgtattttcaatattgaaagactgtgcagctgaagcaaatcaaaatagtagtgtggagctccagatcacctatggagttctgttctctcttgtggcaacttttatttctgatgccctaagtcctcttgagaaagcattattgtcatcgtctgattcctcatttagacgtgaatttcatgaacttgtgatgaagacaggtaacaatacgactattgaagggtttgttggtgttgtgagacttgcatggtctgtacatttgatgctaactcaagatcgaagtaattcaagagaaatgtcagatatttggtcatgtctggaaattgtctatcgtcaaaattcttttgagtttttgcgggagcaagttttgaaaacagctgcataccagaatgatgatgaggacattgtctacatgtacactggctacactcacaaactaatgatgtgctttatttcccaccctacttccagagataagataaaggaaattaaggagaaagcaatgactgccctcagtccatatgggccaccgcggagtcatcgggaagatcttggtagaaatggggaacaagatgatcagcctactaaggagccttttgtatccctgctggaactagttagagaaatctatcagaaagagcctgagctagggaatggtaatgaggaattgtggacctttgttatatatgcaggagaagaccacaccaacacacaaactcttgtggccttccttggacttctcagtactttggcttccaccgaagttggtgctgccaaagtctatgagcttctccagggaaaaacttaccgttcagtgggttggagcactttgtttgattgcttatctatctatgaggagaagttcaaaaaatcaattcaatcttctgcaaacataccacctgattttcctgagggggatgcacaggctcttgttgcatatttagctgttcttcagaaggtggtggaaaatgggaatcctatggaacgcaagaagtggttccctgacattgaacctttattcaagcttctcagctatgaaaatgtgcctccatacttgaagggggctctgcgaaattcaataactgcatttatcaaagtgtcacccctactaaaagatgctatttggaattatcttgagcaatatgatcttcctgtggttacggctccattaggtcaccatacagcaacacaggtctatgatatgaggtttgagttgaacgaagtagaagcgaggagggagagttacccctcaaccatatctttcctcagattgatcaatgcacttattgtagaagaaagaaacataagtgacaaaggccggagggttttgagcatgtatgacataaaggatgatgatatttatgcttctgtgaacacattagctccttcctctatcgagagacagctccctctgctagaactactcaaagatttcatgagtgggaaagttgctttccggaatattatgaacatcatattagtgggtgttgactctcttatcaatgagcgaactacccagacatatggtatcattttggagaaagctgtccatctatctcttgaaatatttattcttgtcatggagagagatctggctcttgctgatgtttttcggccactctaccagccattggatgttatattagctcaaagtcatagacaaattgtagcattgctagagtttgtacgatatgattatcttccccaaattcaacagtgttctatcaaaattatgggcatcctgagttctagaatagttggtttggtacagttgcttttgaaagctgatgttggaaaaatggtaatagaagattatgctgcttgcttggagttccggtttgatgattttcaggtcatagaagacacaaaagatgatgttggagttctaatactgcagttgcttgttgacaatatttctcgtccagctccaaacattacacatttgctcttgggatttgatgtcaatggatccattgagcaaacggttctaaaaccaaaatcccactacagttgtttgaagataatccttgacaatattgaaaaagcgacaaagccagacataaatgccttactgcacgaattcagttttcagcttctctatgagttatgtcttgatcctttaacttgttggcctgtgatggatctcctgagtacaaagaagtaccagttcttttctaagttagaactcatattttccttgcccactgatgacggatgtcagcatgttggaaccatcggagtgacaccgctcccgaaaaggaacagtaaccaatctcttcgtatcagcatgctccatgagagggcatggttgctaaagatgttagcactggcattacatatatccgatatatcatcatctgtatacaaggaagcctgcttggctattctttatcatacttttggtcagtgtgctgagaacttccagagctcaagtttgttcgattctcgtgctttgactagcatcagcgatgtaccagcaaagaggaataaggttttggacttgcttgaggttctacagttcagatgcccggacatttcaatgaagtatccacagctgctttccaacctgggaattgaatcaaagattgaagagatcctaaggaactctgcaacttctgaaaacggtggtgtatattattattcagagagaggtgatcgactgattgatcttgatgctttccatgaaaaacttctccagatgtcacaagaattgaacccacaattaagcgagtctgagaaagccggactaaaagaatcagttcatcatttgctgaaatgggcttggcgatataataaaaatcttgaagaacaggctgcccaacttcacatgttaactggctggtcacagattgttgaagttgctgtatcaagaaggatgtcattatttgaggagcgttctcagctattgtttgagctgcttgatgcttcattgaatgccacgacatctccagattgttcagtgaaaatggcatatgttttaacgaatgtatcgttgacctgtatggctaaactgcgggatgaaagattcatatgcccaactggtacagattctgatgcggttacttgccttgacattattttgtcaaagcagctaccaaatgcagcttgtaactcattgctattcaagcttgtgatggcaacgctaagaaatgaatcatctgaaaccttgagaagacggcaatatgcattattactgagttattttcagtattgtagtagcattcttgactctgatgtccctccatcagtttttcggttcttgctactggaggagcaagagggtgatgatgaggacatcactcttcaaaaggttctcaaggagcacaatgagttagcacatgccaacttttccatcataaggaaggaagctcaagctatcgttgatttgggaaacataactcactgtaaatcgttagcatgtctgcctgatggcatggattggtga

SEQ ID NO: 20893 - protein, 1349 aa, Sorghum bicolor
  misc_feature: Ceres ANNOT ID no. 8672129
  misc_feature: Up-regulated in root tissues in response to methyl jasmonate treatment
MAPLPPRELLSVIEAALLGSAAPSPAQRVELLHAVRDAAPTFRTLLSYPGPKASDRTQVESKEVRLPGMPPITLDDTDVQTALKLSDELNLNEIECVRLLVDANRESVALDQGLDADLMSEIEEQIQPLFNDGLRQRIISLVKELNREEPAGIGRPSSERYVLDFRGALVERRAIVSRERLSLSHCLTLSALIKLMSPREVKDVFSILKDCAAEANQNSSVELQITYGVLFSLVATFISDALSPLEKALLSSSDSSFRREFHELVMKTGNNTTIEGFVGVVRLAWSVHLMLTQDRSNSREMSDIWSCLEIVYRQNSFEFLREQVLKTAAYQNDDEDIVYMYTGYTHKLMMCFISHPTSRDKIKEIKEKAMTALSPYGPPRSHREDLGRNGEQDDQPTKEPFVSLLELVREIYQKEPELGNGNEELWTFVIYAGEDHTNTQTLVAFLGLLSTLASTEVGAAKVYELLQGKTYRSVGWSTLFDCLSIYEEKFKKSIQSSANIPPDFPEGDAQALVAYLAVLQKVVENGNPMERKKWFPDIEPLFKLLSYENVPPYLKGALRNSITAFIKVSPLLKDAIWNYLEQYDLPVVTAPLGHHTATQVYDMRFELNEVEARRESYPSTISFLRLINALIVEERNISDKGRRVLSMYDIKDDDIYASVNTLAPSSIERQLPLLELLKDFMSGKVAFRNIMNIILVGVDSLINERTTQTYGIILEKAVHLSLEIFILVMERDLALADVFRPLYQPLDVILAQSHRQIVALLEFVRYDYLPQIQQCSIKIMGILSSRIVGLVQLLLKADVGKMVIEDYAACLEFRFDDFQVIEDTKDDVGVLILQLLVDNISRPAPNITHLLLGFDVNGSIEQTVLKPKSHYSCLKIILDNIEKATKPDINALLHEFSFQLLYELCLDPLTCWPVMDLLSTKKYQFFSKLELIFSLPTDDGCQHVGTIGVTPLPKRNSNQSLRISMLHERAWLLKMLALALHISDISSSVYKEACLAILYHTFGQCAENFQSSSLFDSRALTSISDVPAKRNKVLDLLEVLQFRCPDISMKYPQLLSNLGIESKIEEILRNSATSENGGVYYYSERGDRLIDLDAFHEKLLQMSQELNPQLSESEKAGLKESVHHLLKWAWRYNKNLEEQAAQLHMLTGWSQIVEVAVSRRMSLFEERSQLLFELLDASLNATTSPDCSVKMAYVLTNVSLTCMAKLRDERFICPTGTDSDAVTCLDIILSKQLPNAACNSLLFKLVMATLRNESSETLRRRQYALLLSYFQYCSSILDSDVPPSVFRFLLLEEQEGDDEDITLQKVLKEHNELAHANFSIIRKEAQAIVDLGNITHCKSLACLPDGMDW

SEQ ID NO: 20894 - DNA, 4287 bp, Sorghum bicolor
  misc_feature: Ceres ANNOT ID no. 8672184
  misc_feature: Up-regulated in root tissues in response to aminocyclopropane carboxylic treatment
  misc_feature: Encodes the peptide sequence at SEQ ID NO 20895
atggatttagtgcggatggggagcatcgccagcgggagcatgcggcggacggcgtcgtcgtggcgggcgtcagggcggagcgacgctttcggccggtccgtgcgggaggaggacgacgaggaggcgctgcgatgggcggccatcgagaagctgcccacctacgaccgcatgcgcaagggcatcctcacgggcgccggcgcaggcttcgaggaggtggacatccaggggctcggcatggaggagcgcaagaacctcattgagcgccttgtacgcaccgccgaggaggacaacgagcgcttcctgctcaagctccgtgaccgtatggagcgagttgggatcgataatccaacaatagaagtgcggtttgagcacctgaacatcgatgcagaggcctacgtcggcaaccggggtatcccgacgatgaccaacttcttctccaacaaaatcatggatgcactaagtgctatgcacatcgttgccagcgggaagagacctatctctatccttcacgacatcagtggagtcatacgacccggcagaatgtctctgctgcttggtccccctggatccgggaaaacaagtctacttctggctttgtcagggaaacttgactcaactctgaaggtgtcaggaagagtaacttacaatggtcatgacatggatgaatttgtccctcagaggacatcagcatacattgggcagcatgatattcacgtaggcgaaatgacggtccgggaaacactttccttctctgcaagatgtcaaggagttggaacacgttatgacatgcttactgaactttcaagaagggagaaagaagccaacattcagccagatcctgatatcgatgtttacatgaaggctatttccgtggaaggtcaggaaagtgtggtcacagattacatcctcaagattctaggtctggaggtctgtgcagatacaatggttggagactctatgatcagaggtatctcaggaggacaaaagaagcgtgtcacaactggcgagatgcttgttggtccagctaaggcgctattcatggatgaaatctccactggtctggacagctccacaacatatcagattgttaactctctaaggcagtcggtccacatccttggtggaactgcacttatcgcattgcttcagcctgcgcctgaaacatatgagctcttcgatgacattgttctcctctctgagggccaaatcgtataccagggtcctcgggagaatgtccttgaattctttgaggccatgggcttcaaatgtcctgagagaaaaggtgttgcagacttcttgcaagaagttacatctaggaaggatcaacaccagtactggtgcagaagagacgagcgatacagatacatctcagttaatgacttttcagaagcgttcaaagcattccacgttgggcgtaagctgggaacagagctcaaggagcccttcgatcgcaccaggaaccatcctgcagctctcacaacgtcgaagtatggtatcagcaagatggagcttctcaaagcatgcttctctagagagtggctactgatgaagaggaactcatttgtttatatcttcaaagtagtccagctcatcattctcggaaccattgcgatgacggtcttcctgcgcacgacaatgcatcgacgtggtgtcgaagatggagtgatatttctgggcgctatgttccttggactagtcacacatttgttcaatggttttgctgagctcgccatgagtattgcaaagctgccaatattctataagcagagggatctcctcttctatccatcgtgggcatatgcattgcctacatggttgctaaagataccaatatcatttttggaatgcgctgtgtggattggcatgacttactatgtcattggcttcgatccaaacatcgaaaggttctttcgccattacctgctgctcgtactaatcagccagatggcatctggacttttccggcttcttgctgcagtaggcagagaaatggtcgtcgcagacacatttgggtcattcgcgcagcttgttcttctgattcttggtggtttcttgatagcaagagataacatcaagaaatattggatctggggctattggtcctcccctctgatgtatgcccagaatgccatagcagtgaatgaattccttggccatagctggcaaaaggttgtcgatagtacacatagcaacgacacgctcggagttcaaatcctaaaggcccgcggcatctttgtcgatccaaactggtattggattggtgttggtgcattgcttgggtatatcatgctcttcaacgtactcttcattctgttccttgactggcttggcccacttggacaaggtcaggccgttgtttctgaagaggagctgagggagaagcatgtaaaccgtactggtgaaaatgttgagttgctggctcttggaacatcttctcagaattcgccttcagatggaagaggagaaattgctggagctgaaaccaggaatagaggaatggcacttccatttacgccattgtccatcacctttgacaatgtcaaatactcagtggacatgcctcaggaaatgaaagacaaaggtattactgaagaccgtctactgctgctgaagggtgtaagtggagccttcagaccaggagtccttacagcactgatgggagtcagtggagcgggtaagactaccctgatggatgtgttggcgggaaggaaaactggtggttacattgaaggagatatttcaatctctggatacccaaagaaacaagaaacctttgctcggattgctggctactgtgagcaaaatgatatccattctccacatgtcactgtttatgaatccctcctgtactccgcatggctccggttgccccatgaagtggattcagaagcaagaaagatgtttgtggaacaagtcatggaactcgtggaattgacaccactgaggggagcattggtaggactgccaggagtaaatggtttatccacagaacagaggaagagactcaccattgctgttgagctcgtggccaatccatccatcatattcatggatgaaccaacttcaggactagatgcgagggcagctgcaatcgtgatgagggcagtccgaaacacggtggatactggaaggacggttgtctgcacaatccaccagccaagcattgatatatttgaagctttcgatgagctatttctaatgaaacgaggaggagaagaaatatatgtcggacctttgggacgcaactcatgccatctgattgactactttgagggaatagaaggagtaaagaaaatcaaggatggttacaaccctgcaacttggatgttggaagtgaccaccttatctcaagaagatatccttgggatcaactttgccgaagtatacagaaactctgacctgtaccggaggaacaaagctttgattagtgaattaagcataccaccaccagggtccagggacttgtacttcccaacccagtattcacaatccttccttacacaatgcatggcttgcctgtggaagcagcacaagtcttactggagaaatccatcatataccgcaactagaatcttcttcacaacagttattcaccagcttggcactaggcaggacctgttatatgctttgggatccatgtatgcagcagttcttttcattggaattcagaatggtcaaactgtgcagccaattgtggatgttgagcgaacagttttctaccgagaaaaggcagctggaatgtactctgctctaccctatgcttttgcacaggttcttattgagatcccacacatcttccttcagacagtcgtgtatggtctcattgtctacagcctgattggctttgaatggacagctgagaagttcttatggtatatgttcttcatgttcttcaccttcatgtacttcacgttctatgggatgatggcagtcgccatgacaccaaacagtgacattgccgctatagtctcaactgcattctacgcaatatggaacatctttgccggcttccttatcccccgcccgaggataccaatatggtggagatggtactcgtgggcttgcccagtggcttggacactatatggacttgtcgcctcacaatttggagacatcacagacgtcaggctggaagatgatgagatagtgaaagatttcgtcaacagattctttggattctatcatgacgacttggcttatgtagctactgctgttgttggattcactgttctctttgctttcgtctttgccttctccatcaaagtcttcaacttccagagaagataa

SEQ ID NO: 20895 - protein, 1428 aa, Sorghum bicolor
  misc_feature: Ceres ANNOT ID no. 8672184
  misc_feature: Up-regulated in root tissues in response to aminocyclopropane carboxylic treatment
  misc_feature (869)..(1078): SWISSPROT Homolog: EC 3.6.3.27 Phosphate-transporting ATPase
  misc_feature (223)..(414): SWISSPROT Homolog: EC 3.6.3.43 Peptide-transporting ATPase
  misc_feature (503)..(716): Pfam ID: ABC2_membrane Pfam Description: ABC-2 type transporter
  misc_feature (1167)..(1369): Pfam ID: ABC2_membrane Pfam Description: ABC-2 type transporter
  misc_feature (179)..(401): Pfam ID: ABC_tran Pfam Description: ABC transporter
  misc_feature (880)..(1070): Pfam ID: ABC_tran Pfam Description: ABC transporter
  misc_feature (721)..(787): Pfam ID: PDR_assoc Pfam Description: Plant PDR ABC transporter associated
MDLVRMGSIASGSMRRTASSWRASGRSDAFGRSVREEDDEEALRWAAIEKLPTYDRMRKGILTGAGAGFEEVDIQGLGMEERKNLIERLVRTAEEDNERFLLKLRDRMERVGIDNPTIEVRFEHLNIDAEAYVGNRGIPTMTNFFSNKIMDALSAMHIVASGKRPISILHDISGVIRPGRMSLLLGPPGSGKTSLLLALSGKLDSTLKVSGRVTYNGHDMDEFVPQRTSAYIGQHDIHVGEMTVRETLSFSARCQGVGTRYDMLTELSRREKEANIQPDPDIDVYMKAISVEGQESVVTDYILKILGLEVCADTMVGDSMIRGISGGQKKRVTTGEMLVGPAKALFMDEISTGLDSSTTYQIVNSLRQSVHILGGTALIALLQPAPETYELFDDIVLLSEGQIVYQGPRENVLEFFEAMGFKCPERKGVADFLQEVTSRKDQHQYWCRRDERYRYISVNDFSEAFKAFHVGRKLGTELKEPFDRTRNHPAALTTSKYGISKMELLKACFSREWLLMKRNSFVYIFKVVQLIILGTIAMTVFLRTTMHRRGVEDGVIFLGAMFLGLVTHLFNGFAELAMSIAKLPIFYKQRDLLFYPSWAYALPTWLLKIPISFLECAVWIGMTYYVIGFDPNIERFFRHYLLLVLISQMASGLFRLLAAVGREMVVADTFGSFAQLVLLILGGFLIARDNIKKYWIWGYWSSPLMYAQNAIAVNEFLGHSWQKVVDSTHSNDTLGVQILKARGIFVDPNWYWIGVGALLGYIMLFNVLFILFLDWLGPLGQGQAVVSEEELREKHVNRTGENVELLALGTSSQNSPSDGRGEIAGAETRNRGMALPFTPLSITFDNVKYSVDMPQEMKDKGITEDRLLLLKGVSGAFRPGVLTALMGVSGAGKTTLMDVLAGRKTGGYIEGDISISGYPKKQETFARIAGYCEQNDIHSPHVTVYESLLYSAWLRLPHEVDSEARKMFVEQVMELVELTPLRGALVGLPGVNGLSTEQRKRLTIAVELVANPSIIFMDEPTSGLDARAAAIVMRAVRNTVDTGRTVVCTIHQPSIDIFEAFDELFLMKRGGEEIYVGPLGRNSCHLIDYFEGIEGVKKIKDGYNPATWMLEVTTLSQEDILGINFAEVYRNSDLYRRNKALISELSIPPPGSRDLYFPTQYSQSFLTQCMACLWKQHKSYWRNPSYTATRIFFTTVIHQLGTRQDLLYALGSMYAAVLFIGIQNGQTVQPIVDVERTVFYREKAAGMYSALPYAFAQVLIEIPHIFLQTVVYGLIVYSLIGFEWTAEKFLWYMFFMFFTFMYFTFYGMMAVAMTPNSDIAAIVSTAFYAIWNIFAGFLIPRPRIPIWWRWYSWACPVAWTLYGLVASQFGDITDVRLEDDEIVKDFVNRFFGFYHDDLAYVATAVVGFTVLFAFVFAFSIKVFNFQRR

SEQ ID NO: 20896 - DNA, 3204 bp, Sorghum bicolor
  misc_feature: Ceres ANNOT ID no. 8672188
  misc_feature: Down-regulated in root tissues in response to methyl jasmonate treatment
  misc_feature: Up-regulated in shoot tissues in response to methyl jasmonate treatment
  misc_feature: Encodes the peptide sequence at SEQ ID NO 20897
atggagttttcaaagcaagggcaggcacccgtgccaaacaacattgggtcacaaccgttaccctcttcaaatgtccaatctaatcaaacagagcatccatctttgttttttccatcatcattgcctggtgactggagttcacagcagatgttctctatgggaacgtcagtaccagttagctcatattatattgtccccatgagtcagcaatcagtccaactaggtgcttccaggccagaggtttcacgtcctttgggggcacaacctttgctaagtagggtatcattgaggccaccccagcaggtgctgagtattcaaacatctttgccagcaatggctggaacacaaccctcaccatctatggcaggcaggaaatcacaacagacaattgcttctccaaaggttcaaatgctgaaatctccatcgttccagtcatctaataagcggtctgcacagaaggagccaccgtcaaaggttcaacaatttgaatctgtgaggtccaagttcagggagtcacttgttgctgcgctgagtttggattcagatcagcagaataagagtcagtctcctaataatgtgcattctgatgaatctacagataatttcaaaccagcagcaggagatgtggtacaggatttagtggcaaccacatcaaaagatgtagccaattcaggtatagccacaactgtagctcccagtaaatgcgaggaaagtgagaagttaagcagtgatttagctccagagatgatcacgagcataaatgatgacatgcagcaacagtcaaatcaggtttcttcagaagatgacttattgggtcagtgtatggttgcagatgaacttttgcaaggtcatgggcttagttgggtttctgatcttgatgttgggatctctgaacctaacgcagaacctaatgatttaaaaaggccgcgaacttctgatgtggagtctgagtcaaaaagaataaagtctgccaatgagttagcaatggatacggagaaatttaatcaaagggctgaaagtttggcgtttagaattgaagaggagctgttcaaattgtttggtggagtaaataagaagtacaaggaaaagggcagatctcttttgtttaatttgaaagacaaaagcaaccctgagctaagagagagggtcttgtctggagatattgcgcctgaacgcctttgttcaatgactgcagaagaacttgcctccaaagaactctcagagtggcggctggctaaagctgaggagttcgcacagatggttgtccttccgagtaaggaggttgatcctaggcgcttggttagaaaaactcacaaaggagagttccaagttgaattcgaagaaccagatggtttctcagtggaggttgaacttgggagtaatcttactaatattccttcaaaagctgttgaagatcagaccaagtctaatggaacagatcgtaaagaagatgttcaagaaaaagacaaagcatctgatagcacttcacaagatgaggatggcagaacatgcaacaatgatatgccaggtgatgtagaatatattgataatgagaaagctgatctcatgcaggaacttattttggatgacatgaaggacaccgtaaatctcccacctattccttcgttagatgaattcatgcagggcctagattctgagccaccttttgttgatctctcagttgagactcctcaagaagatgtcaatgactctgaggaacctgacaccaccatggagcctgaggatcttccagagacagaagataatgcatctgcaccagagaaaactgaatctgaatctgataagtcatctgcacaggttaacagtgagcccaagttagagtcaccagtacatacagcagttccaaattcggatcttactgaaccacgtgatggagagctgaacaaatcctccccctcccctggcaaaggtgaagccaagcaaacaactactgataatgtctctaatcctgattctgttcacagtcaggctgccatactccctatgatacgtgagagcatatgggaaggtgcaattcaactaacagtgtcttcactctctaatgttgttgctattttcaaaagtggtgaaaagccatcattaaaagattggcgtcgttttgttgagattaagggaagagttaaacttagtgcttttcaagattttgtcgagcagcttcccaaatctagaagccgtgctataatgactatcgatgcatatatttcagatgagagagtaggattagctgagcctgcagaaggaatagagctgtacctgtgcccttctcatgggaaaaccgtggaaatcctgtcacggtacttgccaaaggagcaccaggagagccttgctgtcgcggaatcatccttcattggagtcgtggtatggcggaggcccaacatccctagggtacccacctcccacggctcccaccacagacatgatggttccaagaggcagcagtcgatcctagggaaaccacaggttatgaatccggccgcaaggccctccctacctctcaactcatatggtgcaccaccagggtttcccaaccagcgccgccgcgcagaggaagatgtaactgatgatgtccctccgggctttggacccggtgttgctagggatgaggatgatcttcctgaatttaattttgttaattcgtcacaccatgctgccaatgtaactgcgcatgcctacaagggccggccacatgtagcaccaccctctgctcgcccagcagagcaaatgagggaactggttcagaagtatggtaaaagatcatctgttcaagccccccgttcctgggatgacgatgacgatgacatacctgagtggaaccccagccagacgattaatcagccaccaccgccactgcctcacgccccacagcaactgccgttgcctccacctcccgtccagcagatgaacgcctaccagcagcagcagtaccacatcccaagtgcagtgcagcctcaggttcccctcacttcgctgccccatgcttacctccggacccagcagcctgcccaggcatggcagcagcagcagcccagtcatgcttggtggccagcgcagggcgttgctgccgctgccgcacaggtgactaacattgtacagcaaccccagtatggtgtagtgcctggcagtagtggcgtccagggctacgactctagcagcgcgagtggtgtggcatggaggccgagatag

SEQ ID NO: 20897 - protein, 1067 aa, Sorghum bicolor
  misc_feature: Ceres ANNOT ID no. 8672188
  misc_feature: Down-regulated in root tissues in response to methyl jasmonate treatment
  misc_feature: Up-regulated in shoot tissues in response to methyl jasmonate treatment
  misc_feature (396)..(616): SWISSPROT Homolog: EC 2.3.1.48 Histone acetyltransferase
  misc_feature (315)..(423): Pfam ID: TFIIS_M Pfam Description: Transcription factor S-II (TFIIS), central domain
  misc_feature (675)..(761): Pfam ID: SPOC Pfam Description: SPOC domain
MEFSKQGQAPVPNNIGSQPLPSSNVQSNQTEHPSLFFPSSLPGDWSSQQMFSMGTSVPVSSYYIVPMSQQSVQLGASRPEVSRPLGAQPLLSRVSLRPPQQVLSIQTSLPAMAGTQPSPSMAGRKSQQTIASPKVQMLKSPSFQSSNKRSAQKEPPSKVQQFESVRSKFRESLVAALSLDSDQQNKSQSPNNVHSDESTDNFKPAAGDVVQDLVATTSKDVANSGIATTVAPSKCEESEKLSSDLAPEMITSINDDMQQQSNQVSSEDDLLGQCMVADELLQGHGLSWVSDLDVGISEPNAEPNDLKRPRTSDVESESKRIKSANELAMDTEKFNQRAESLAFRIEEELFKLFGGVNKKYKEKGRSLLFNLKDKSNPELRERVLSGDIAPERLCSMTAEELASKELSEWRLAKAEEFAQMVVLPSKEVDPRRLVRKTHKGEFQVEFEEPDGFSVEVELGSNLTNIPSKAVEDQTKSNGTDRKEDVQEKDKASDSTSQDEDGRTCNNDMPGDVEYIDNEKADLMQELILDDMKDTVNLPPIPSLDEFMQGLDSEPPFVDLSVETPQEDVNDSEEPDTTMEPEDLPETEDNASAPEKTESESDKSSAQVNSEPKLESPVHTAVPNSDLTEPRDGELNKSSPSPGKGEAKQTTTDNVSNPDSVHSQAAILPMIRESIWEGAIQLTVSSLSNVVAIFKSGEKPSLKDWRRFVEIKGRVKLSAFQDFVEQLPKSRSRAIMTIDAYISDERVGLAEPAEGIELYLCPSHGKTVEILSRYLPKEHQESLAVAESSFIGVVVWRRPNIPRVPTSHGSHHRHDGSKRQQSILGKPQVMNPAARPSLPLNSYGAPPGFPNQRRRAEEDVTDDVPPGFGPGVARDEDDLPEFNFVNSSHHAANVTAHAYKGRPHVAPPSARPAEQMRELVQKYGKRSSVQAPRSWDDDDDDIPEWNPSQTINQPPPPLPHAPQQLPLPPPPVQQMNAYQQQQYHIPSAVQPQVPLTSLPHAYLRTQQPAQAWQQQQPSHAWWPAQGVAAAAAQVTNIVQQPQYGVVPGSSGVQGYDSSSASGVAWRPR

SEQ ID NO: 20898 - DNA, 810 bp, Sorghum bicolor
  misc_feature: Ceres ANNOT ID no. 8672282
  misc_feature: Down-regulated in root tissues in response to methyl jasmonate treatment
  misc_feature: Up-regulated in shoot tissues in response to methyl jasmonate treatment
  misc_feature: Encodes the peptide sequence at SEQ ID NO 20899
atggcggtgagcaacaacatcacggcgtgcgtgacgctgctggcgctaatctgcgcggtgcccgtgatcgcgtcagggatctggttcgcgtcggcgcagggcgaggagtgcgcgcgcctggcgcggtggcccgtggcgatcctgggcggcctgctcctcctggcggcgctggcgggcttcgtcggcgcgtactggaaccggcggcgcctcctggcgttctacctcttcgcgatggcgtcgctcgtcgtgctgctcatcgcgctgctcgtcttcgccttcgccgtcacccggggatccggcgcgtacccggtgctcggccgcgcctacgacgactaccacctcgacggcttctccatgtggctcagaggctacgtctcggatgaccctggacggtgggagaagatcagggcctgcctcgctgtctctgatacctgcaagaagctcgccagacaggctgcgttcaccaacgccgagcagttctatcagtcccacctctccccgttacagtctggttgctgcaagccgccgtcggtgtgcgggttcagctacgtgagcccgacggtgtggacggcggcggcgcggccggcggcggacccggactgcgggctgtggagcaacgacccggggcagctgtgctacgagtgcgagtcctgcaaggcgggcctcctggagacgctccgggaccagtggcacaaggccaacatcgcgctcgtcgtcgccaccgtcgccctcgtcatcctctacctcgtcggctgcagcgcctacaagaacgcgcaggccgccgccatcttcagccgctacaagtactag

SEQ ID NO: 20899 - protein, 269 aa, Sorghum bicolor
  misc_feature: Ceres ANNOT ID no. 8672282
  misc_feature: Down-regulated in root tissues in response to methyl jasmonate treatment
  misc_feature: Up-regulated in shoot tissues in response to methyl jasmonate treatment
  misc_feature (3)..(247): Pfam ID: Tetraspannin Pfam Description: Tetraspanin family
MAVSNNITACVTLLALICAVPVIASGIWFASAQGEECARLARWPVAILGGLLLLAALAGFVGAYWNRRRLLAFYLFAMASLVVLLIALLVFAFAVTRGSGAYPVLGRAYDDYHLDGFSMWLRGYVSDDPGRWEKIRACLAVSDTCKKLARQAAFTNAEQFYQSHLSPLQSGCCKPPSVCGFSYVSPTVWTAAARPAADPDCGLWSNDPGQLCYECESCKAGLLETLRDQWHKANIALVVATVALVILYLVGCSAYKNAQAAAIFSRYKY

SEQ ID NO: 20900 - DNA, 2646 bp, Sorghum bicolor
  misc_feature: Ceres ANNOT ID no. 8672263
  misc_feature: Up-regulated in shoot tissues in response to methyl jasmonate treatment
  misc_feature: Up-regulated in root tissues in response to methyl jasmonate treatment
  misc_feature: Up-regulated in shoot tissues in response to salicylic acid treatment
  misc_feature: Encodes the peptide sequence at SEQ ID NO 20901
atggcggcggagccggagcagaccgcggagcagttccggggccaggcgcggctgccccacttcgcgaccccgcggcgctacgacctgcgcctcacgcccgacctcgccgcctgcgccttcgccggctcggtgtcggtgtccctcggcgtcaccgcgccgacgcggttcctcgtgctcaacgccgccgagctcgacgtcgcgccagcgggcgtcagcttcgcgccgcagggctccgaccaggtgctgcaacctttggaggttaccaacgtgtcagaagatgagatcctgattattcgcttcagtgaggtgcttcctctcggggaggggactttgacgattgccttccagggaactttgaatgataagatgcatgggttctacagaagtgtgtatgagctcaatggagagaagaaaaacatggctgtaacacagtttgaaccagctgatgcgaggcgctgcttcccttgttgggatgagcctgctttcaaggctgtgttcaaaattactcttgaagttccttctgagaccattgctttgtcaaatatgccagccactgaagagaagatcaatggtcctaccaaaatagtctacttccaggaatctccgataatgtctacatacctagtggctgttattgttggcatttttgactatgtggaagatttcaccacagatggaactagagtccgtgtttatacacaagttggtaagagtgcgcaagggaagtttgctctagaggttgccttgaagacattggtcctctttaaggagtattttgctgtgccataccccctccccaaaatggacatgattgctattccggattttgcagctggagccatggagaactatggcttggttacataccgtgaaacagcattgctatttgatgaaaaacactctgcagctgccaataagcaacgggttgcagttgttgtagctcatgaattagctcatcaatggtttggaaatcttgtcacaatggagtggtggacacatctgtggcttaatgagggctttgcgacttgggtgtcttacttagctgcagatcagttcttccctgaatggaatgtttggactcagtttctagaggaatctacaacaggtttcaagttggatgctcttgcaggttcacatccaattgaggtggacataaatcatgttgatgaaatagatgagatatttgatgctataagctataggaaaggagcttctgtcattcggatgctgcaaagctatcttggggctgaggtctttcagaaatctttggctgcatacatcaaaagatttgcgtattcaaatgcaaagacagaggacttatgggctgcccttgaagaggggtctggtgaaccagttagaacattaatgcattcatggacaaaacagcaaggttatcctgttgtcagtgtgaaagtcaaggatggaaaggtccagctggagcagacacaatttctttcaagtgggtccacaggagatgggcaatgggtggttcctgtcacactatgttgttgtgcgtactcacgccaagagaagttcctttttcatgggaaacaagaagattttgatttgtcagggttagggctcacagaatgccaaaagaagtgtagcttctggattaaacttaatgtcaaccagaccagcttctatagggtgagctatgatgatgaacttgcatcccgacttcggtatgcaattgaaaccaacaaattgagtgcagcagacagatacggtgtgctcgatgatgcttatgccctctgtatggctggcaaacaaaagctagtctccttgttgcagttgatttctgtatacaaggatgagactgagtatactgtgcttgcacaagtaatcacgacgagtctgcacattgccgagatgatggctgttgctgctccagaggagttggttaatctgaagaagttcctaattgatttcctggagccatttgcactgaaacttggctgggatgctaagagtagcgagggccacctgaatgctttgttaagaggcacactattaactgctcttgcagaacttggccatgagactaccataaatgaagctgttcgtcgatttaatgtctttttggaagacagagagacgccgctcctccctccagatgttagaaaggctgcatatgttgctttgatgcagacagtgagcaaatcaaacaaaactggctacgaatcgctattgaagatatatagagagactgatctaagccaggagaaagttcgtgtgttaggttctttggcatcatcccctgaccctgatgttgtccgtgaagcattggatttcatattgtcacctgaggtgaggaatcaggacgcaatatttttgctaagaggggtgagttcaggggcacacgaggtcgcatggcaatggctgaaggacaactgggactacatattgggagcctactctggcactctgctcacctatttcgtcaacataaccgtgtcgccactggccaccgatgaacacggtgatgaggcggaggagttcttcaagagcagaaccaagccgaacatcgcgaggactgtgaagcagagcattgagagagtaaggatcaatgcccaatgggtcaagaacatcaaggctgaggctgacctcggcagtgttctcgagaagctggctcacaagcactga

SEQ ID NO: 20901 - protein, 881 aa, Sorghum bicolor
  misc_feature: Ceres ANNOT ID no. 8672263
  misc_feature: Up-regulated in shoot tissues in response to methyl jasmonate treatment
  misc_feature: Up-regulated in root tissues in response to methyl jasmonate treatment
  misc_feature: Up-regulated in shoot tissues in response to salicylic acid treatment
  misc_feature (17)..(862): SWISSPROT Homolog: EC 3.4.11.7 Glutamyl aminopeptidase
  misc_feature (18)..(403): Pfam ID: Peptidase_M1 Pfam Description: Peptidase family M1
MAAEPEQTAEQFRGQARLPHFATPRRYDLRLTPDLAACAFAGSVSVSLGVTAPTRFLVLNAAELDVAPAGVSFAPQGSDQVLQPLEVTNVSEDEILIIRFSEVLPLGEGTLTIAFQGTLNDKMHGFYRSVYELNGEKKNMAVTQFEPADARRCFPCWDEPAFKAVFKITLEVPSETIALSNMPATEEKINGPTKIVYFQESPIMSTYLVAVIVGIFDYVEDFTTDGTRVRVYTQVGKSAQGKFALEVALKTLVLFKEYFAVPYPLPKMDMIAIPDFAAGAMENYGLVTYRETALLFDEKHSAAANKQRVAVVVAHELAHQWFGNLVTMEWWTHLWLNEGFATWVSYLAADQFFPEWNVWTQFLEESTTGFKLDALAGSHPIEVDINHVDEIDEIFDAISYRKGASVIRMLQSYLGAEVFQKSLAAYIKRFAYSNAKTEDLWAALEEGSGEPVRTLMHSWTKQQGYPVVSVKVKDGKVQLEQTQFLSSGSTGDGQWVVPVTLCCCAYSRQEKFLFHGKQEDFDLSGLGLTECQKKCSFWIKLNVNQTSFYRVSYDDELASRLRYAIETNKLSAADRYGVLDDAYALCMAGKQKLVSLLQLISVYKDETEYTVLAQVITTSLHIAEMMAVAAPEELVNLKKFLIDFLEPFALKLGWDAKSSEGHLNALLRGTLLTALAELGHETTINEAVRRFNVFLEDRETPLLPPDVRKAAYVALMQTVSKSNKTGYESLLKIYRETDLSQEKVRVLGSLASSPDPDVVREALDFILSPEVRNQDAIFLLRGVSSGAHEVAWQWLKDNWDYILGAYSGTLLTYFVNITVSPLATDEHGDEAEEFFKSRTKPNIARTVKQSIERVRINAQWVKNIKAEADLGSVLEKLAHKH

SEQ ID NO: 20902 - DNA, 1599 bp, Sorghum bicolor
  misc_feature: Ceres ANNOT ID no. 8672518
  misc_feature: Down-regulated in shoot tissues in response to salicylic acid treatment
  misc_feature: Encodes the peptide sequence at SEQ ID NO 20903
atggccggaaccgagcggccaaacggcccgatggacccgccgcggcccgcgagcggccgctccggcggggtcggcgctggtgactcgccggtgaggtgggacgacgacgattacgacggcggcggcggccgcgtcgaaggcttggcgggactccacatatttgaccaagaggcagacgagccaccagtcaataacgacatggctagcagccttgatactaactgcattcctattgctaacggattcaacactgaaacaaccgaaacttctctagagacagaacctggaaagggcattaacccgcttcatgagcatactggcatctgggtccctgtttctgtcccgccaatgacagcgcaggcccgcgaggagtggcacagggggtttggttgcaatggcggatacttccccgaagaagagttcggctgggagctggatgaagagaactatgagatgacgatgtgggatgtgtttgctgatatggttgtcgcagcaaaacgtaaggtgatatctgccgcaacatatgactttgggagacatgggatgtcagtggtgtccaacttctttctccaagaggcttggaaggacatggcacaaacacttgcagatgcaaacgctggtattgcgaacgagcttcttgagaccgagccaactaagtggttgcctgacagtgctgctacctcttgcatgctctgtggcgtgcggtttcatccaataatgtgctctcgccatcattgtcgtttctgtggtggagtattctgtaatggttgttcaaagggtagaagcttgatgcctccaaaatttatgactgcagaacctcagagggtttgtgatgtctgcggagtacgtctagagagtatccaacctcaattgatgaatcagatcagtcgggcctcacaacttccaactcgggatgtcacagacctgagtaccctgaggtcatggctgaatttcccttgggcacacacaatggaatatgagatatacaaggctgcaaattctttacgtagttactgtaaggtgggaggactgaaaccagagaaggctatccctgatactattcttagacaagcaaaaggtcttgctatagttactgtggtgaaggttgggatgatggttacatacaaacttggcactgggctggttgttgctcgaagagtggatggctcctggtcaccgccttcagcaatctccacctgtggtattggatatggggctcaggctggaggtgagatagctgactttattattgttctgaggaacacggatgctatcagaacattcagtgggaaggcacatctgtctgttggtgctggtgttagcgcttctgctggccatgttggacgtgcagctgaggctgacttccgtgctggtgatggtggttatgctgcatgttatacatacagttgtagcaaaggtgcctttgtgggctgtgcgttgaatggcagcatagtatcaactcgagatactgagaacgcacgattttacggaggtcctgtcaaggcatctgatatccttctaggatcaatggcgaggccgcctgcagcctctcctctgtacaaagctctgtcagaattgtttgacaagattggaagataa

SEQ ID NO: 20903 - protein, 532 aa, Sorghum bicolor
  misc_feature: Ceres ANNOT ID no. 8672518
  misc_feature: Down-regulated in shoot tissues in response to salicylic acid treatment
  misc_feature (214)..(280): SWISSPROT Homolog: EC 3.1.3.48 Protein-tyrosine-phosphatase
  misc_feature (218)..(286): Pfam ID: FYVE Pfam Description: FYVE zinc finger
MAGTERPNGPMDPPRPASGRSGGVGAGDSPVRWDDDDYDGGGGRVEGLAGLHIFDQEADEPPVNNDMASSLDTNCIPIANGFNTETTETSLETEPGKGINPLHEHTGIWVPVSVPPMTAQAREEWHRGFGCNGGYFPEEEFGWELDEENYEMTMWDVFADMVVAAKRKVISAATYDFGRHGMSVVSNFFLQEAWKDMAQTLADANAGIANELLETEPTKWLPDSAATSCMLCGVRFHPIMCSRHHCRFCGGVFCNGCSKGRSLMPPKFMTAEPQRVCDVCGVRLESIQPQLMNQISRASQLPTRDVTDLSTLRSWLNFPWAHTMEYEIYKAANSLRSYCKVGGLKPEKAIPDTILRQAKGLAIVTVVKVGMMVTYKLGTGLVVARRVDGSWSPPSAISTCGIGYGAQAGGEIADFIIVLRNTDAIRTFSGKAHLSVGAGVSASAGHVGRAAEADFRAGDGGYAACYTYSCSKGAFVGCALNGSIVSTRDTENARFYGGPVKASDILLGSMARPPAASPLYKALSELFDKIGR

SEQ ID NO: 20904 - DNA, 1182 bp, Sorghum bicolor
  misc_feature: Ceres ANNOT ID no. 8672596
  misc_feature: Down-regulated in shoot tissues in response to aminocyclopropane carboxylic treatment
  misc_feature: Encodes the peptide sequence at SEQ ID NO 20905
atgaacaggcgtgcggtcaccatagcgctaatctcagtcggcgcaacggtgaccctggcgtgcttggccgcgtgcgccttgacgcgtcgtcgccggaacaagaagaagaagaagaaggacaaggacgggaaaacagcggtgtgggaggacgaggaggtggtggtgggggcggtgaaggtggccgcggcggcgccggtggtggtgctggagcggccgctgatggagctgacgctggcggacctggccgcggccacgtccgggttcgggcgcgagtcgcagctcgcggacacgggcggccgcagcggggccgcgtaccgcgccgtgctccccggggacctgcacgtcgttgtccgcgtcgtcgagggcgccgtggctggagttgcggaggacgccgacgccgccgccatcgaggccgggttccgggagcttgcacggctcaggcatcccaacattctcccgctccttggttactgtattgcagggaaccaaaaacttgtgctttacgagtacatggagaaaggcgacctccaccggtggctccacgagctgccagtggggagcatggacaccgaggacatctgcatggacaccatggaagccatcgaggacagaaaacccgccggcgactggccgactcggtaccgcatcatcctcggcgtcgctcgaggtctcgcgttcctgcaccaggggtggacgggggcggccgccgggtccggccggcggcggcggcccatcgtgcacggccgtctggtgccgaccaacatcctgctcggcgacgacatggagccccggatctccgacttcctgcaccgccccggcggcggcggcggcggcgacgagacggcgacgccggcgagcgacgtgtaccgcttcgggacggtggtgttcgaggtggtgacggggcaggcgaggtggggcgacgcggcgaccacgagctgggcgcgcggcgtgatccggaaccgcaagggcctcaacctcgtggacgaccggctccgggacgagacggcgggcacggacgccgagaaggagatggccgagtgcctgcaggtcgggttcctctgtaccgccggcgcgccggagaagaggcccaccatgcagcaggtggtcgggctgctcaaggacgtcaggccgccggcgacgaccgccggagccggaggagtgccgccgctcggggtctcatga

SEQ ID NO: 20905 - protein, 393 aa, Sorghum bicolor
  misc_feature: Ceres ANNOT ID no. 8672596
  misc_feature: Down-regulated in shoot tissues in response to aminocyclopropane carboxylic treatment
  misc_feature (70)..(182): SWISSPROT Homolog: EC 2.7.11.1 Non-specific serine/threonine protein kinase
  misc_feature (99)..(372): Pfam ID: Pkinase_Tyr Pfam Description: Protein tyrosine kinase
MNRRAVTIALISVGATVTLACLAACALTRRRRNKKKKKKDKDGKTAVWEDEEVVVGAVKVAAAAPVVVLERPLMELTLADLAAATSGFGRESQLADTGGRSGAAYRAVLPGDLHVVVRVVEGAVAGVAEDADAAAIEAGFRELARLRHPNILPLLGYCIAGNQKLVLYEYMEKGDLHRWLHELPVGSMDTEDICMDTMEAIEDRKPAGDWPTRYRIILGVARGLAFLHQGWTGAAAGSGRRRRPIVHGRLVPTNILLGDDMEPRISDFLHRPGGGGGGDETATPASDVYRFGTVVFEVVTGQARWGDAATTSWARGVIRNRKGLNLVDDRLRDETAGTDAEKEMAECLQVGFLCTAGAPEKRPTMQQVVGLLKDVRPPATTAGAGGVPPLGVS

SEQ ID NO: 20906 - DNA, 2883 bp, Sorghum bicolor
  misc_feature: Ceres ANNOT ID no. 8672615
  misc_feature: Down-regulated in root tissues in response to methyl jasmonate treatment
  misc_feature: Down-regulated in shoot tissues in response to methyl jasmonate treatment
  misc_feature: Up-regulated in root tissues in response to salicylic acid treatment
  misc_feature: Up-regulated in shoot tissues in response to salicylic acid treatment
  misc_feature: Encodes the peptide sequence at SEQ ID NO 20907
atgccggagcggcaccagtcgatcgacgcgcagctgcggctgctggcccccgggaaggtctccgaggacgacaagctcgtcgagtacgacgccctcctcgtcgaccgcttccttgacatcctccaggacctgcacggcccccacctgcgcgaattcgtccaggagtgctacgagctctcggcggagtacgagaacgaccgggatgaggctcggctcggcgagctcgggagcaagctcaccagcctgccgccgggggactccatcgtcgtcgccagttccttctcgcacatgctcaacctcgccaacctcgccgaggaagtgcaggtcgcgcagcgccgccggatcaagctcaagcgtggggacttcgccgacgaggcctccgcgccgacggagtcggacatcgaggagacgctcaagcgcctcgtctcgcagctcggcaagtcgcgggaggaggtcttcgacgcgctcaagaaccagaccgtcgacctcgtcttcaccgcccaccccacgcagtccgtcaggaggtctcttctccagaagcacggcaggatccgtaactgcctgaggcagctctatgccaaggacatcactgctgacgacaaacaggagcttgacgaggcacttcagagggagattcaagctgctttcagaactgatgaaatccgcagaacccctcccactcctcaagatgaaatgcgtgctggaatgagttacttccatgaaactatatggaagggtgtaccaaaattcttgcgccgtattgacactgctctgaaaaatattgggatcaatgaacgtctcccttacaatgctcctctcattcagttctcttcctggatgggtggtgatcgtgatggaaatcctagagtaacaccagaggttacacgggatgtatgcttgttggcaagaatgatggctgctaacctgtacttctctcagatcgaagatctaatgtttgagctctctatgtggcgctgcagtgatgaacttcggatccgtgcagatgaactacatcgctcttcaaaaagagctgcaaagcactatatagaattctggaagcaagttcctccaaatgaaccatatcgtgtcatacttggtgatgtcagggataaattgtactacacacgtgaacgttctcgtcacctattgtcatctggaatttctgagattccagaggaggcaacttttactaatgttgaacagtttctggaacctcttgagctctgctatagatcattatgtgcttgtggtgacaaacctatagctgacggaagtcttcttgatttcttgcgtcaagtatcaacttttgggcttgcccttgtgaagcttgacatcaggcaggaatctgatcgacacaccgatgttcttgattcaataacgacacatcttggaattggctcctatgctgaatggtccgaggagaaacgccaggattggctgttgtctgaactgaggggcaaacgtccattgtttggttctgatcttcctcagactgaagagactgctgatgttctaggcacgtttcatgtccttgcagagcttccagcagattgctttggcgcgtatatcatctcaatggcaactgccccatctgatgttctcgcggtcgagcttttgcagcgggagtgccatgtaaagcagccactgagagttgttccactctttgagaaactagcagatcttgaagcagctccagcggctgtagcacgactcttttcaattgactggtacatgaataggattaatggcaagcaggaggtcatgattggatattcagactctggcaaagatgccggccgtctctctgcagcatggcaaatgtataaagcacaagaagagctcatcaaggtggcaaagcattatggagtgaagttgacaatgtttcatggaagaggtggaacagttggcagaggaggtggtccaactcatctggccatattatctcagccaccagacacgatacatgggtcgcttcgtgtaacagttcaaggcgaagttattgagcactcctttggagaggagctcttgtgctttagaactttgcaacgctacactgcagctactcttgaacatggcatgcatcctccaatttcccccaagccagaatggcgtgctctgatggatgaaatggctgttgtagcaactaaagaatatcgatcaattgtcttccaagaaccacgcttcgttgaatacttcagatcggctacgcctgagactgaatatggtaggatgaatattggcagccgtccgtcaaagaggaagcctagcgggggaatagaatcgctccgtgcaattccatggatctttgcttggacacaaacaaggttccatctgcctgtttggcttggatttggtgcagcgatcaagcacatcatgcagaaggacatcaggaacatccatgtactgaaagaaatgtacaatgagtggccattcttcagggtcacccttgatttgcttgagatggttttcgccaagggagacccgggaattgcagctgtatatgacaaattgctagtggctgaggatttgcaatccttcggtgagcaactaaggaagaactatgaggagacaaaagagctcctccttcaggttgctggtcacaaggacgtccttgaaggcgatccttacctgaagcagcgtctgcggctgcgtgagtcctacatcaccactctgaacgtgtgccaggcctacaccctgaagcggatacgtgacccgagcttccaggtgagcccgcagccgcccctgtccaaggagttcaccgacgagagccagccggtggagctggtgcagctgaaccagcagagcgagtacgcgccaggcctggaggacacactgatcctgaccatgaagggcatcgctgccggcatgcagaataccggctag

SEQ ID NO: 20907 - protein, 960 aa, Sorghum bicolor
  misc_feature: Ceres ANNOT ID no. 8672615
  misc_feature: Down-regulated in root tissues in response to methyl jasmonate treatment
  misc_feature: Down-regulated in shoot tissues in response to methyl jasmonate treatment
  misc_feature: Up-regulated in root tissues in response to salicylic acid treatment
  misc_feature: Up-regulated in shoot tissues in response to salicylic acid treatment
  misc_feature (1)..(960): SWISSPROT Homolog: EC 4.1.1.31 Phosphoenolpyruvate carboxylase
  misc_feature (7)..(960): Pfam ID: PEPcase Pfam Description: Phosphoenolpyruvate carboxylase
MPERHQSIDAQLRLLAPGKVSEDDKLVEYDALLVDRFLDILQDLHGPHLREFVQECYELSAEYENDRDEARLGELGSKLTSLPPGDSIVVASSFSHMLNLANLAEEVQVAQRRRIKLKRGDFADEASAPTESDIEETLKRLVSQLGKSREEVFDALKNQTVDLVFTAHPTQSVRRSLLQKHGRIRNCLRQLYAKDITADDKQELDEALQREIQAAFRTDEIRRTPPTPQDEMRAGMSYFHETIWKGVPKFLRRIDTALKNIGINERLPYNAPLIQFSSWMGGDRDGNPRVTPEVTRDVCLLARMMAANLYFSQIEDLMFELSMWRCSDELRIRADELHRSSKRAAKHYIEFWKQVPPNEPYRVILGDVRDKLYYTRERSRHLLSSGISEIPEEATFTNVEQFLEPLELCYRSLCACGDKPIADGSLLDFLRQVSTFGLALVKLDIRQESDRHTDVLDSITTHLGIGSYAEWSEEKRQDWLLSELRGKRPLFGSDLPQTEETADVLGTFHVLAELPADCFGAYIISMATAPSDVLAVELLQRECHVKQPLRVVPLFEKLADLEAAPAAVARLFSIDWYMNRINGKQEVMIGYSDSGKDAGRLSAAWQMYKAQEELIKVAKHYGVKLTMFHGRGGTVGRGGGPTHLAILSQPPDTIHGSLRVTVQGEVIEHSFGEELLCFRTLQRYTAATLEHGMHPPISPKPEWRALMDEMAVVATKEYRSIVFQEPRFVEYFRSATPETEYGRMNIGSRPSKRKPSGGIESLRAIPWIFAWTQTRFHLPVWLGFGAAIKHIMQKDIRNIHVLKEMYNEWPFFRVTLDLLEMVFAKGDPGIAAVYDKLLVAEDLQSFGEQLRKNYEETKELLLQVAGHKDVLEGDPYLKQRLRLRESYITTLNVCQAYTLKRIRDPSFQVSPQPPLSKEFTDESQPVELVQLNQQSEYAPGLEDTLILTMKGIAAGMQNTG

SEQ ID NO: 20908 - DNA, 894 bp, Sorghum bicolor
  misc_feature: Ceres ANNOT ID no. 8672664
  misc_feature: Up-regulated in shoot tissues in response to salicylic acid treatment
  misc_feature: Up-regulated in root tissues in response to salicylic acid treatment
  misc_feature: Encodes the peptide sequence at SEQ ID NO 20909
atggagacacagctcacgccacggcagataaggccacgtgcatccttcgctgctccgtgctcaccagcgctctcctccagtctccacttcacttcgtccctgatcgccgggcgagcagcggcaacggccatgatgagcttggcgtccggcgttccctccgcgcaggcattccccgcgttaatgactcccgccgctggctcccacacccactgtcgggtccacacgcatgcggcggcctccaagagcggattggcctgccgcgtcgcgcgcagcgggagcggtggcgctcggtggctgccggtctcctgtgcagcggggggcggcgcagttggtgatgcttttgttactgaggacacaacaaatgtgaagtttcctcgggaactaacggttccaggctatacataccctttggttgcagttggcacagattactcacttcgccttgatactgagcaatggaaagaaaagattggtattgagagctttgacggttcctctgtttttgactccatttttaaggcaccagttgtgaaatcattaagcataattcttgttagagatgttgatggcaagacctttgtgaatgctctaaatgatgtcattgctcgccaaataaaaaacccaaatgctgaggaagaatcttccctgtcaaccttgcagaatacctttcttgggcgcaatctcaaacagggaacaaacatatacttaacttggcttgaacccaaaagaatgctgatttccatttccgaaaatcaagatccacgtcaagttgatgcagagatcgaatctgctactgttaattatgctctatacgatggcttctttggtaaatccccagtgtccccttctttgagatcatctacagcccgattgctggaagcgcttctgcagtga

SEQ ID NO: 20909 - protein, 297 aa, Sorghum bicolor
  misc_feature: Ceres ANNOT ID no. 8672664
  misc_feature: Up-regulated in shoot tissues in response to salicylic acid treatment
  misc_feature: Up-regulated in root tissues in response to salicylic acid treatment
  misc_feature (152)..(289): SWISSPROT Homolog: EC 5.5.1.6 Chalcone isomerase
METQLTPRQIRPRASFAAPCSPALSSSLHFTSSLIAGRAAATAMMSLASGVPSAQAFPALMTPAAGSHTHCRVHTHAAASKSGLACRVARSGSGGARWLPVSCAAGGGAVGDAFVTEDTTNVKFPRELTVPGYTYPLVAVGTDYSLRLDTEQWKEKIGIESFDGSSVFDSIFKAPVVKSLSIILVRDVDGKTFVNALNDVIARQIKNPNAEEESSLSTLQNTFLGRNLKQGTNIYLTWLEPKRMLISISENQDPRQVDAEIESATVNYALYDGFFGKSPVSPSLRSSTARLLEALLQ

SEQ ID NO: 20910 - DNA, 1365 bp, Sorghum bicolor
  misc_feature: Ceres ANNOT ID no. 8672964
  misc_feature: Up-regulated in shoot tissues in response to salicylic acid treatment
  misc_feature: Encodes the peptide sequence at SEQ ID NO 20911
atggcaccattgtattatgcagcttcattagaggattcgagtgggctgaaacaatacacagcttcgacccatcagaatctctatgctgaatctcctgcatccactgaggacattaacataagtgctctgactgcatctgtggaaagtgaagtggcaactgagaaagatggcccagttgacagtcaggtgcatgaaactgcagctttagaaaatgtggaactgaaagatgatgtttcttgtgctgaaaatgagcataacaaatcgggcagccctgttcatttggaggatccactagtacctttgaaggatgtagaaaagcatgatctaactcccgcaaaggactttgtcgtatctaacacagaagatcaacaagaagccagggatatccgcttgcaggtacaagatgtggattccatggaagattcaggcaaagtaccagatggaaccatagaggcttcaaccgatgatgatttagaactgggtactgcagatgtagaaaagcatgatcaacctaacttgctggaaccaagattggagtctgtttctgccccagaattgtctgtcttggatgagtctgatgataaaatgcaatgtggtgtttctggcaaggatgaggtaccacatgtggatgagaaaaccgaaactactgttgacaaggtaaccggaggttctgcaaactgcgaggatcttctttgtgagtcatcaaggacggaacctgacattcaagagagtcacactagccttggagaagaggtagacgtcacaatcacaacaggtggaacagtcttccctgattcagttagttgtgatttatcatgtccacacgatggtggcatgacagtatacgagggatctgagacggtgtcatcagagaaccaaactgatgctcagaaagaaaacatccattcagatgtctctcagacagatgaatgcactaagactcagaaagtccctccagtaggcacacagggagaaaattctgctgaagattctgatgtgcaggtgtctgagatggacaaatgcaatgagatgccgaaggaagctccagcacatgcaacaggagcaaatcctgctgaagacgaagcttccctgaaagaagacatcactgtgcagacagacaacaagccttctgcctccccagctcctgaagatccaaaggtcagtgacaaggagaagctggcagaagaaaaccagaagctgaaagagcttcttcaaaagcttctcgcatccggcaatgatcagatgggggtcatcacagacctaagtgagaaggttaaggcgctcgagcggaagctggcacgcaagaagaggccaaaggtgagggtgcacaggccgtccgggcatgtgactgccaaagtccactga

SEQ ID NO: 20911 - protein, 454 aa, Sorghum bicolor
  misc_feature: Ceres ANNOT ID no. 8672964
  misc_feature: Up-regulated in shoot tissues in response to salicylic acid treatment
  misc_feature (26)..(388): SWISSPROT Homolog: EC 2.3.1.48 Histone acetyltransferase
MAPLYYAASLEDSSGLKQYTASTHQNLYAESPASTEDINISALTASVESEVATEKDGPVDSQVHETAALENVELKDDVSCAENEHNKSGSPVHLEDPLVPLKDVEKHDLTPAKDFVVSNTEDQQEARDIRLQVQDVDSMEDSGKVPDGTIEASTDDDLELGTADVEKHDQPNLLEPRLESVSAPELSVLDESDDKMQCGVSGKDEVPHVDEKTETTVDKVTGGSANCEDLLCESSRTEPDIQESHTSLGEEVDVTITTGGTVFPDSVSCDLSCPHDGGMTVYEGSETVSSENQTDAQKENIHSDVSQTDECTKTQKVPPVGTQGENSAEDSDVQVSEMDKCNEMPKEAPAHATGANPAEDEASLKEDITVQTDNKPSASPAPEDPKVSDKEKLAEENQKLKELLQKLLASGNDQMGVITDLSEKVKALERKLARKKRPKVRVHRPSGHVTAKVH

SEQ ID NO: 20912 - DNA, 2010 bp, Sorghum bicolor
  misc_feature: Ceres ANNOT ID no. 8673695
  misc_feature: Up-regulated in shoot tissues in response to salicylic acid treatment
  misc_feature: Encodes the peptide sequence at SEQ ID NO 20913
atggcggaggctgttgccgcggctgccgggtggccggcagatgaagaggcgcggccgctcaaggtggtcttcggctccccggcgaagtacttcaccgacgcggcgccgatcgggaacggccgcctcggcgccatggtctggggcggcgtcgaatctgagaggctccagcttaaccatgacactctatggacaggtgggcctggtaattatacaaatcccaaagcacctgctgttctttctaaagtaaggagctttgttgataatggaaagtaccctgaagccacagctgctgcatatgatctgtctggtgaccaaacacaggtctttcaacctcttggggatattgatctggtctttgggaagaacatcaagtacacaaattacaaacgagagctagatcttcacactgcaacagtcaccgtcacatatactgttggggagatagtctactcaagggaacatttctcctcaaatccacatcaagtcattgcaactaaaatctctgcaaacaaaccgggaaatgtctctttcacagtgtctttaactactacactaaaccacaagattcgtgtaacacatgcaaatgaaataatcatggagggtagctgtccaggcgaaagacctcaagagggcaacactgctgctgatcctcccattggaattaaattttgtgcaattctttatgtgcagataaatggtgccaatagcacagtggaagtattgaatgataacatgctgaaacttgattgtgccgactctgttgttttacttcttgcagccactacttcatttgaaagtgcattcatcaaaccctcagaatctaaattggatccaacagtgtctgctcttacaacattaagtattgctaggagcacgtcgtattcacagctaaaagcctaccacattgatgattaccagactcttttccaccgtgtttccttgcaactatcacaaggctctaatgtagttcagtcagcagagactagttctcagtgtgctactgtatcagattatgcttttcaaatatctgaccacaccacatcgacagcccttaaagattttgtgaagcctacggtagaaagaattgtaactttcaaagacaatgaagacccttctcttgtggaacttctatttcagtttggtcgttatctactcatttcgtgctcaaggcctggaacccaaatttccaatctgcaagggatatggagcaatgacccttcaccaccatgggatgcagcaccccatccaaatataaatctgcaaatgaattactggcctgcgcttccttgtaaccttagcgaatgccaagaaccactgtttgactttattggctccctctcagtcaatggggctaagacagcaaaagtcaacccccagtgtggtgtgaggtgtttccctattcctttgtctctctatctttgtccacaaaaaagtcaaaataaggcccgtttattaaaacacctagataaattttatactaaaaaagatattccttgggtgaatttgatttggaatgctcactaccctcttggtcaagtccttcatgctactgctgataagggctctttttggtggagggatgttttgaaattatgtgatcttttcagaggaatggttaagtgcactattggggatggctctacagtgctcttctgctctgatctttggaataacaacattctggagtccaagtttccaaggcttttttcctttttcagaaacaggaatatttctgtagcaagttttctgtcaaacaacacacttgaagcccaatttaatttgcaactatcagaacaagcctttcaagaatttcaaagtttacaagacctcattcaagcctgccgccgccgcccaggagtgtgtccgtgctgccgccgccgccctcgaccaggagcgcgcgcacgccgacgctctggagcagcaggccgctgcccttcgcgagcgcctccgtcccgaccagctccgggacgactccactgtggacgacgacgacctctccatcacctctga

SEQ ID NO: 20913 - protein, 669 aa, Sorghum bicolor
  misc_feature: Ceres ANNOT ID no. 8673695
  misc_feature: Up-regulated in shoot tissues in response to salicylic acid treatment
  misc_feature (18)..(457): SWISSPROT Homolog: EC 3.2.1.51 Alpha-L-fucosidase
MAEAVAAAAGWPADEEARPLKVVFGSPAKYFTDAAPIGNGRLGAMVWGGVESERLQLNHDTLWTGGPGNYTNPKAPAVLSKVRSFVDNGKYPEATAAAYDLSGDQTQVFQPLGDIDLVFGKNIKYTNYKRELDLHTATVTVTYTVGEIVYSREHFSSNPHQVIATKISANKPGNVSFTVSLTTTLNHKIRVTHANEIIMEGSCPGERPQEGNTAADPPIGIKFCAILYVQINGANSTVEVLNDNMLKLDCADSVVLLLAATTSFESAFIKPSESKLDPTVSALTTLSIARSTSYSQLKAYHIDDYQTLFHRVSLQLSQGSNVVQSAETSSQCATVSDYAFQISDHTTSTALKDFVKPTVERIVTFKDNEDPSLVELLFQFGRYLLISCSRPGTQISNLQGIWSNDPSPPWDAAPHPNINLQMNYWPALPCNLSECQEPLFDFIGSLSVNGAKTAKVNPQCGVRCFPIPLSLYLCPQKSQNKARLLKHLDKFYTKKDIPWVNLIWNAHYPLGQVLHATADKGSFWWRDVLKLCDLFRGMVKCTIGDGSTVLFCSDLWNNNILESKFPRLFSFFRNRNISVASFLSNNTLEAQFNLQLSEQAFQEFQSLQDLIQACRRRPGVCPCCRRRPRPGARARRRSGAAGRCPSRAPPSRPAPGRLHCGRRRPLHHL

SEQ ID NO: 20914 - DNA, 945 bp, Sorghum bicolor
  misc_feature: Ceres ANNOT ID no. 8673733
  misc_feature: Down-regulated in shoot tissues in response to salicylic acid treatment
  misc_feature: Encodes the peptide sequence at SEQ ID NO 20915
atgacggcttggcgtgggcgtggtggtctggtgacggttccttcgagcccgacgagcgaactgtggcagcggcggtggcggtttcttggagcccgtcgagcgaactgcggcagcggcggcggcagtggagtgtgccgcggtcgatccccagcagtagggaaaataagactattttgggatgcagagtggaccttttttgaagaggcgtctacttgtggtccgacccataaccaagtttgggcttggcccaacccaaattgctcggcatccaacgaggcaccggcacgaaacctcgcgccgccaccaaatctccggggagcgaagaggcggctgcagcgagtgcgcgacaagccgtcaaggacgacgaaggcggcaaggccagcggccagaggaggaggcatgcttaagttcctgtccaaggtggtggtggagtactgccctctggacccgcggaaggcggcggcagtggagctcctcgcgcagtgcaacggccgcaaggccaaggactccaacccggcctgctccgtcgagctccgccgcctcccctccccgcctctgtccacggaccccaagtcgcagccgactctcccgcctccgcgggtcctcgtgacctacctcaacggagccgaggaggccatcatggccgctgagggcgctacggcgcagggcatccgtgaccagatcctcgcacggggccggctcatcgacacggagcagatgttccgcgacggcggggagaagtggcccgtcgtcatccccgaggaggagctcggcatgtcgttccctggcatcaaggtgaacattctacatagttaccacaggacttttatatcaaggtctgtcatgtgtgctgtggacgacatcctcaacgatagggatgaaaatgccaaagaaagccgaggacaagccccaggcctagtgaccaagtcagagttttctatttga

SEQ ID NO: 20915 - protein, 314 aa, Sorghum bicolor
  misc_feature: Ceres ANNOT ID no. 8673733
  misc_feature: Down-regulated in shoot tissues in response to salicylic acid treatment
MTAWRGRGGLVTVPSSPTSELWQRRWRFLGARRANCGSGGGSGVCRGRSPAVGKIRLFWDAEWTFFEEASTCGPTHNQVWAWPNPNCSASNEAPARNLAPPPNLRGAKRRLQRVRDKPSRTTKAARPAARGGGMLKFLSKVVVEYCPLDPRKAAAVELLAQCNGRKAKDSNPACSVELRRLPSPPLSTDPKSQPTLPPPRVLVTYLNGAEEAIMAAEGATAQGIRDQILARGRLIDTEQMFRDGGEKWPVVIPEEELGMSFPGIKVNILHSYHRTFISRSVMCAVDDILNDRDENAKESRGQAPGLVTKSEFSI

SEQ ID NO: 20916 - DNA, 1464 bp, Sorghum bicolor
  misc_feature: Ceres ANNOT ID no. 8673817
  misc_feature: Up-regulated in shoot tissues in response to methyl jasmonate treatment
  misc_feature: Up-regulated in root tissues in response to methyl jasmonate treatment
  misc_feature: Encodes the peptide sequence at SEQ ID NO 20917
atggaggagccgctgctgagcgcaccgtcgaccacggaaaagcttcttcacggggtaggaggaggcaaggaggaggaggaggaggagagcttggcgttggcggtgcgcgagacgaagcagcagctgtaccttgccgggccgctcgtcgtcgggttcctcctgcagaacctggtccagatggtctccgtcatgttcgtcggccacctcggcgagctcgcgctggccagcgcgtccctggccacctccttcgccggcgtcacgggcttcagcttgctggctggcatggcgtgcagccttgacacgctgtgcggccaagcgttcggagcgaagcagtactaccagctgagcgtgtacaagcagcgagccatggtggtgctcactctggtgagcataccggtgtcggtagtctgggcctacaccggcgagatcctcgcctggtgcgggcaggacccggagatcgcggcggcggcagggatctacatccggtggctgatcccggcgctgttcctgttcggggcgctgcagtgccacgtccggttcctgcagacgcagaacctggtggtgcccgtgatgctgagctccggcgccaccgcgctgtgccacccggccgtctgctggctgctggtgcgcgcgctcgggctgggcagcaacggcgccgcgctcgccaacgccatctcctacctcgccaacctcgccttcctcgcgctctacgtccgcctctcgccgtcctgcaagtacagctggacggggttctccgccgaggcgttccgtggcgtccccgacttcctcaagctcgccgtgccgtccgccgtcatggtctgcatgaagtggtggtccttcgagttcctggtgatgttctccggcctcctccccaaccccaagctcgagacggccgtgctgtccatttgcttgaacaccaacagcttcgcattcatggttccgctgggactcggtggtgccgtaagcacgcgtgtgtcgaacgagctcggcgcggggcacccgcgggcggcgcggctggcgacgcgggtggtggcggtgctggcgctggcggcgggcgtgtcggaaggggtggtcatggtgctggtgcgccaccagtgggggtacgcctacagcaacgaggaggaggtggtccgctacaccgccaggatgatgcccctcatcgccgtctccctcgtcttcgacggcatgcagagcgtgctctcgggcgttgtccggggctgtggccgccaaaaggccggcgcgtacatcaacctcgccgcgtactacctcgccggcgtcccgtcggcgttcgtcttcgccttcgtttgccgtctaggaggaatgggcctgtggttgggcatcatgtgcggcctggtggtgcagatgctgctgctgctctccatcacactatgcaccaactggaacaacgaagcgctgaaagcgaaggatcgggtgttcagctctgctcttcctccattagattag

SEQ ID NO: 20917 - protein, 487 aa, Sorghum bicolor
  misc_feature: Ceres ANNOT ID no. 8673817
  misc_feature: Up-regulated in shoot tissues in response to methyl jasmonate treatment
  misc_feature: Up-regulated in root tissues in response to methyl jasmonate treatment
  misc_feature (268)..(431): Pfam ID: MatE Pfam Description: MatE
  misc_feature (47)..(207): Pfam ID: MatE Pfam Description: MatE
MEEPLLSAPSTTEKLLHGVGGGKEEEEEESLALAVRETKQQLYLAGPLVVGFLLQNLVQMVSVMFVGHLGELALASASLATSFAGVTGFSLLAGMACSLDTLCGQAFGAKQYYQLSVYKQRAMVVLTLVSIPVSVVWAYTGEILAWCGQDPEIAAAAGIYIRWLIPALFLFGALQCHVRFLQTQNLVVPVMLSSGATALCHPAVCWLLVRALGLGSNGAALANAISYLANLAFLALYVRLSPSCKYSWTGFSAEAFRGVPDFLKLAVPSAVMVCMKWWSFEFLVMFSGLLPNPKLETAVLSICLNTNSFAFMVPLGLGGAVSTRVSNELGAGHPRAARLATRVVAVLALAAGVSEGVVMVLVRHQWGYAYSNEEEVVRYTARMMPLIAVSLVFDGMQSVLSGVVRGCGRQKAGAYINLAAYYLAGVPSAFVFAFVCRLGGMGLWLGIMCGLVVQMLLLLSITLCTNWNNEALKAKDRVFSSALPPLD

SEQ ID NO: 20918 - DNA, 1161 bp, Sorghum bicolor
  misc_feature: Ceres ANNOT ID no. 8678542
  misc_feature: Down-regulated in shoot tissues in response to salicylic acid treatment
  misc_feature: Encodes the peptide sequence at SEQ ID NO 20919
atggcgacgccgcctcgtttccctcccgccctcgccggctgcttcccgcgcagaggctcgcctcggggcccggacaaccctaaccctaggccaagctctcctctccccggctctcccgaggacgccctcctccgcgctgccttcgacggcgacctccgcctcgtcaagaagatgacgagagtgctggacgggggcgaggaacggggcgcggaaaaggtgagggctgtgcggagcagcaacggactgggcgctctgcacctcgccgctgcccgtgggaagctgccggtgtgccgatacctggtcgacgacctgggtctggatgtcaattcaatcaacgaggcaggtttgacccccttgacatgtgctattgatgctgggagcgtggatgtggtgcagtacctcctcaataatggcgctgatacagaaacactcatcagcactgggcttactcctcttgtttacgctgttggaaaagcactgcatcttgctgctcaaaatgggcgtgatgatatcgtgaaggttttgttggatcaccatgcagattttcactacagacgtgaaatgtatttcagtgatcaggtggagtccctctctgtggttgttggcgtcttcgtgcccagcagcgattggagttttgagaatgttctgagaatgggaaccgaagtagagaccgaggaccgaactttcagtcttttcgagttcagtctcggtctattcggtgtccgtttttggtcccggttttttcccagtcctgctttcactcataacaagatagcttggggtgtcaacagacctcttatttatgccatttctgctcgttcattgaaatgtgtgaagcttcttattgaggctggtgctgatgttcagggtattggtactgaaacacccttagcacttgctgctactgatggcttaactgacatcctgaagtgcttagttcaagctggtgcagatcccaatgtttgtgatggtgtaggccctcccccccacccaacagtaacctgtaattctagtacagtactaagcagactcccatgcaattctagtaaagttctctttgttatgttactatatttgttacatcaatgctgtgagtatccttggccaaatgagtcctgtctattatcccttcatattcttattcttcttaattgcttatga

SEQ ID NO: 20919 - protein, 386 aa, Sorghum bicolor
  misc_feature: Ceres ANNOT ID no. 8678542
  misc_feature: Down-regulated in shoot tissues in response to salicylic acid treatment
  misc_feature (106)..(180): SWISSPROT Homolog: EC 2.7.11.1 Non-specific serine/threonine protein kinase
  misc_feature (80)..(113): Pfam ID: Ank Pfam Description: Ankyrin repeat
  misc_feature (114)..(146): Pfam ID: Ank Pfam Description: Ankyrin repeat
MATPPRFPPALAGCFPRRGSPRGPDNPNPRPSSPLPGSPEDALLRAAFDGDLRLVKKMTRVLDGGEERGAEKVRAVRSSNGLGALHLAAARGKLPVCRYLVDDLGLDVNSINEAGLTPLTCAIDAGSVDVVQYLLNNGADTETLISTGLTPLVYAVGKALHLAAQNGRDDIVKVLLDHHADFHYRREMYFSDQVESLSVVVGVFVPSSDWSFENVLRMGTEVETEDRTFSLFEFSLGLFGVRFWSRFFPSPAFTHNKIAWGVNRPLIYAISARSLKCVKLLIEAGADVQGIGTETPLALAATDGLTDILKCLVQAGADPNVCDGVGPPPHPTVTCNSSTVLSRLPCNSSKVLFVMLLYLLHQCCEYPWPNESCLLSLHILILLNCL

SEQ ID NO: 20920 - DNA, 5487 bp, Sorghum bicolor
  misc_feature: Ceres ANNOT ID no. 8678623
  misc_feature: Up-regulated in shoot tissues in response to methyl jasmonate treatment
  misc_feature: Up-regulated in root tissues in response to methyl jasmonate treatment
  misc_feature: Up-regulated in root tissues in response to salicylic acid treatment
  misc_feature: Up-regulated in shoot tissues in response to salicylic acid treatment
  misc_feature: Encodes the peptide sequence at SEQ ID NO 20921
atgcaggaggggctagggcaaaggatgcatgtacctcatggtatcaatctgtgcttcgcaacttcttccgtgccctttcaggtggaatcttctattgagctgggtaccggagaagtgaacccccctgtaacatctgaaaagttacctgctaactcacaagctgttaatgatgctggagcacttgaaggtactgacatgaatggaaaatcggttcaaaaacctaagaggaaaaaacataggccaaaggtcattaaagaaggacaatcagcaaagttgcagaagcctaaaactccaaagcctcccaaggaaaatgggaatcagcctactgcaaagagaaagtatgtcaggaggaagggactaagtgcaccagctgaacaaattccatcaggaggtgctgatacacaaactacagctaaaccaggagtagcccaaagatgtttggactttgatgtggaggaccagcatggacatttggatctggtatcacaaacccgggaaacggagatacagactggtcctggggacacacagccatcaatatctggagttgaaagaagtaatgttcaggtatcatgccattggggtggtacaagcagttctattagttcagttgacccaatagttgatatacaaggattacgggcagactgcatgcctaaaagtgtcaattttgacctgaacaattctagagtaagtcagatgccaaccaattattctagtctaatggacagctctggacaatttttccagtatggtttaagagaaaaagttcaaacaaatcaattactggattctaattctagtctgccagttagacatgtctctcatctcaccagttcggtagatcatatgcgacacccctcagccaattttgatcaatacataagcaaatctcaagattgtacagaaaaatcacccagacattatcagatgcttagtagttatagaatttcagaaaatatgacagcagcttctcagtataccgaaagggtgtcaatggggggcaatttcaatcctgaagcttgtataggcgaaggtgcaataatcaaacaaatggcccaatactatagacttccagaaagtccatttgtacctcccaagcataatgaaagggatgtgatgaatggaaatctgaacgaattttctgtgaagaatgattacttgaagttttctaccaatagtaactaccaaactggagcaggttttggttttcatgattctccaggctattcggatgttcttgcaatgagtaaaaaaagagaacacaatgctatcagtggtcatcagatttcttttggcattgactttattaactcaaatagaacaaggaagttctatagtgatgaccccttttccactagctctcaaacatcttattatcctgaagcatgcaaaaggatgagaccagaggatcatagcaatcagctcaacggaactacgggaaaattttcttcctcgttagcattttctgatggtttgaacacaaataaagtttcagctatgaaccatggaattggtaccttggctgacatacaaaggttgatggcccttgagaaatcacaagcttcacaacaaatgattaactttattacgtcacaaaacaacatgaaccatgacaaaggatttattgctttacctaataaacagttccgaagcttcattgcacaggacataccattgcctggcagtacggtgaacaaattggaagagaatgatatcttgaggaatggagtgcatcaaattcatccttgggaaactacatccaggccacatcactctagcaacaattttgctttaccaaataaattgcctggatacttaactgcagggaacgcacagttatcgagcagcacagtgaatccatccacagaaaactatattcagagtaatgctattcatcaacatcaatgcttagaaaacgttgtggctaaggtgccagtcttatctgaaacacacaacatttccagccaagagggccataaccactgcactgctgctactactgatgagcacatcagaactacaagtaatgaagttgttagatcccttacccaggaagcaagccaaccaaccacaaatgggaaccacaatcttaactcttctagagtaactgcagaagcaaagtccactgagaagccaagaaaaaggggccgcccaagaaaagtagtgaaccccaatggggagccaaaagaaagagttactaaaggcaaacaaaatgttggtcatgcaaaacctatatcaccaaaaggttcatgtaccgactttttaaaaactaatggtattacttatgcttctgaaccttccactggaattactcctaggatgtcaactgtggagtcgaaaagttctgaccaagataaggagattcatggaggtgtcattcctcaagctgcagcagcatcagttgatcctttagatggcataattcaaaagattaagctcttaagcataaacggaccagacaagattgtggcagaggtacccaaaaatgctcttgttccatatgaaggtgaatttggtgcactggttgcatttgaggggaagacaaagaaaagccgttctcgggccaaagtgaacatcgatccggtcaccactatgatgtggaacttattaatggggccagatatgggtgatggtgctgaagggttggacaaggataaagagaagtggcttgacgaagaaagaagagtgttcagaggacgggttgattcattcattgctcgtatgcatctagttcagggggacaggcgtttctctcgatggaaaggatcagtcgtggactcagtcgtgggtgtatttcttacccagaatgtttcagatcatctttcaagttctgctttcatggcggttgctgccaaatttcctgctaagacagaggttcctgaaaaacctgtggctgagatgtctcatactcctcctgaacagaaggatagttgttctggactgtttggtgattctatcaaattacagggcaagatattcattgaagaggtaagtgacgttagatcattgattactacagaagataatgaagaaagtaatagtaatgaattgatcggaagctctgctgggtatggaataaaccgtgcaactggaggatgccatgtctcttataggaagtcactaactggatcccatggaaatgggctatcaggatctgtttttccaactaccggcttttcaagcgtggtagaaactgaagatggatcattggaggatgttatttcttctcaaaattctgctgtttcttcccagaattcctcagattatctctttcatagaaccgatccaacaggttctagttcattgcaaaatttcaccgaagagggctgtatcatgagaaatatatctagcgggactggcagatcaactgactacacagcgtttctgccaattcaagatccaacaggcatgctcggattatcagaatattatggacttaatcctcttccagtttcaggtgtgaacaagggcgtgttgcttgatctaaacagatcatatcagccattacatacttctatgccctatgtgcagaatagcgagtctgatttcacaggtgtgtcatgtttcagccatatggataaatcattccacacaggccctgatagagtgaatctttccagtgttacacaatctgaggctagtctttaccctactgatcctttgcaacaaggcgatttttcaccagtaattaaacaaaacttccaaccacatagttcagataaagtgccatttttcaaggagcactcttcatgtggaaatgatttttcaaggaacaaaactgaaactccttctgtggaaccacttgtctattcaaatcctcaagaggtgtacactacctcaacagatccaatgggtgctgaacaatttcaatcaggatgtggccaacaggacaatgatgccagaatccagacagcatcacatgaaaggcatcagtcttcagccttgtgtgaaaaccagaattctcattcagaggtcttgcaaggagttgctgcaggctcaacgcagaagttcattgatattcaaaaggggccaccagaagctcaacaaaatggatcaaaagcaaagaaggtacggggccgacctaggaaaacttatgactgggacagtttacgaaaagaagtgctttctaatggtggggataaacaaagaagtcatgatgcaagggatactgttgattgggaggcagttaggcaagcagaagtccgggaaatatctgaaactatcagagagagaggaatgaataacatgctagcagaacggataaaagaattcctgaaccgattggtgacagaccatggaagcattgatcttgaatggctaagagatgttcaaccggacaaagccaaggatttccttctaagcattagagggcttggactaaaaagtgttgagtgcgttcgcctcttgacgctacatcatatggcttttccagtggacacaaatgttggacggatatgtgtgaggcttggatgggtgccacttcaaccactgccagagtctcttcagttgcacctattggaaatgtatgagcttcactaccaaatgattacttttggaaaggttttctgcacaaaaagtaagcctaattgcaattcatgtccaatgagagctgaatgtaagcactttgctagtgcattcgcaagtgctaggcttgctcttcccgcacccgaagaaaaacgtttggctacatcggaagatgcaaatccaataattgaggaaccactgagtccagaacctgaacctgaaaatgtagaggcaaaggagggtgcaatagaggatttcttttgtgaagaccctgatgaaattcctaccattaatcttaatatcgaggagtttacacaaaacttgaagaactatatgcaagcaaacaatgttgacattgaatatgctgacatgtcgaaggcattggttgccatcacccctgatgctgcttccattccaactccaaagctcaagaatattagtcgtctgaggacagaacaccaattcgaacagagagaaccggatgatccatgtccatatcttctttccatatggaccccaggggagactggtagactatgtggaagttcaacatgctttagttgcaacagtatacgagaaatgcaggctcagaaagtcagaggaacacttttgataccatgccgaacagcaatgagaggaagcttcccacttaatgggacatattttcaagttaatgaggtatttgctgaccattactcaagccaaaatccaattgatgtcccacgaagttggatatgggacctcccaagacgaactgtttactttggaacctcagttcctacaatatttagaggtttaacgactgaacagatacaacaatgcttttggagaggatttgtttgtgtgaggggctttgataggacagtgagggcaccaaggcccctttatgcaaggttgcattttcctgccagcaaggttgttagaggcaaaaaacctggagcagcaagagaggaagaataa

SEQ ID NO: 20921 - protein, 1828 aa, Sorghum bicolor
  misc_feature: Ceres ANNOT ID no. 8678623
  misc_feature: Up-regulated in shoot tissues in response to methyl jasmonate treatment
  misc_feature: Up-regulated in root tissues in response to methyl jasmonate treatment
  misc_feature: Up-regulated in root tissues in response to salicylic acid treatment
  misc_feature: Up-regulated in shoot tissues in response to salicylic acid treatment
  misc_feature (1395)..(1541): SWISSPROT Homolog: EC 4.2.99.18 DNA-(apurinic or apyrimidinic site) lyase
  misc_feature (1372)..(1512): Pfam ID: HhH-GPD Pfam Description: HhH-GPD superfamily base excision DNA repair protein
MQEGLGQRMHVPHGINLCFATSSVPFQVESSIELGTGEVNPPVTSEKLPANSQAVNDAGALEGTDMNGKSVQKPKRKKHRPKVIKEGQSAKLQKPKTPKPPKENGNQPTAKRKYVRRKGLSAPAEQIPSGGADTQTTAKPGVAQRCLDFDVEDQHGHLDLVSQTRETEIQTGPGDTQPSISGVERSNVQVSCHWGGTSSSISSVDPIVDIQGLRADCMPKSVNFDLNNSRVSQMPTNYSSLMDSSGQFFQYGLREKVQTNQLLDSNSSLPVRHVSHLTSSVDHMRHPSANFDQYISKSQDCTEKSPRHYQMLSSYRISENMTAASQYTERVSMGGNFNPEACIGEGAIIKQMAQYYRLPESPFVPPKHNERDVMNGNLNEFSVKNDYLKFSTNSNYQTGAGFGFHDSPGYSDVLAMSKKREHNAISGHQISFGIDFINSNRTRKFYSDDPFSTSSQTSYYPEACKRMRPEDHSNQLNGTTGKFSSSLAFSDGLNTNKVSAMNHGIGTLADIQRLMALEKSQASQQMINFITSQNNMNHDKGFIALPNKQFRSFIAQDIPLPGSTVNKLEENDILRNGVHQIHPWETTSRPHHSSNNFALPNKLPGYLTAGNAQLSSSTVNPSTENYIQSNAIHQHQCLENVVAKVPVLSETHNISSQEGHNHCTAATTDEHIRTTSNEVVRSLTQEASQPTTNGNHNLNSSRVTAEAKSTEKPRKRGRPRKVVNPNGEPKERVTKGKQNVGHAKPISPKGSCTDFLKTNGITYASEPSTGITPRMSTVESKSSDQDKEIHGGVIPQAAAASVDPLDGIIQKIKLLSINGPDKIVAEVPKNALVPYEGEFGALVAFEGKTKKSRSRAKVNIDPVTTMMWNLLMGPDMGDGAEGLDKDKEKWLDEERRVFRGRVDSFIARMHLVQGDRRFSRWKGSVVDSVVGVFLTQNVSDHLSSSAFMAVAAKFPAKTEVPEKPVAEMSHTPPEQKDSCSGLFGDSIKLQGKIFIEEVSDVRSLITTEDNEESNSNELIGSSAGYGINRATGGCHVSYRKSLTGSHGNGLSGSVFPTTGFSSVVETEDGSLEDVISSQNSAVSSQNSSDYLFHRTDPTGSSSLQNFTEEGCIMRNISSGTGRSTDYTAFLPIQDPTGMLGLSEYYGLNPLPVSGVNKGVLLDLNRSYQPLHTSMPYVQNSESDFTGVSCFSHMDKSFHTGPDRVNLSSVTQSEASLYPTDPLQQGDFSPVIKQNFQPHSSDKVPFFKEHSSCGNDFSRNKTETPSVEPLVYSNPQEVYTTSTDPMGAEQFQSGCGQQDNDARIQTASHERHQSSALCENQNSHSEVLQGVAAGSTQKFIDIQKGPPEAQQNGSKAKKVRGRPRKTYDWDSLRKEVLSNGGDKQRSHDARDTVDWEAVRQAEVREISETIRERGMNNMLAERIKEFLNRLVTDHGSIDLEWLRDVQPDKAKDFLLSIRGLGLKSVECVRLLTLHHMAFPVDTNVGRICVRLGWVPLQPLPESLQLHLLEMYELHYQMITFGKVFCTKSKPNCNSCPMRAECKHFASAFASARLALPAPEEKRLATSEDANPIIEEPLSPEPEPENVEAKEGAIEDFFCEDPDEIPTINLNIEEFTQNLKNYMQANNVDIEYADMSKALVAITPDAASIPTPKLKNISRLRTEHQFEQREPDDPCPYLLSIWTPGETGRLCGSSTCFSCNSIREMQAQKVRGTLLIPCRTAMRGSFPLNGTYFQVNEVFADHYSSQNPIDVPRSWIWDLPRRTVYFGTSVPTIFRGLTTEQIQQCFWRGFVCVRGFDRTVRAPRPLYARLHFPASKVVRGKKPGAAREEE

SEQ ID NO: 20922 - DNA, 2496 bp, Sorghum bicolor
  misc_feature: Ceres ANNOT ID no. 8678788
  misc_feature: Up-regulated in root tissues in response to methyl jasmonate treatment
  misc_feature: Up-regulated in shoot tissues in response to methyl jasmonate treatment
  misc_feature: Up-regulated in root tissues in response to salicylic acid treatment
  misc_feature: Encodes the peptide sequence at SEQ ID NO 20923
atggaggccgccgcggcgcagctgacgccgggcgctgtccaggcgatcgcgaacggggcggtgtgcgcagcgctccagccggtgctgcaggtgctggaggtgcgccgtgtcgccaccaccaagagcggtgacgccagcgccagcgccaaccccaccccctcggagcgggagcgctaccgcttgatactctccgacggcgtcgacgcgcaccaggccatcctcgccaccgccttcaacccattcgtcagggacggcaccctacgcaagggcacaatcgtccacctcaacgagttcatatgcgacaccatccgagataaaaggatcatcattattgtgaaaattgaaattctacaaactgcatgtgccctaatcgggaaccccaaaaactacatggcacaaattcaagggaaggtacaagatcccaacttatcggccattgctgctcaaaattctggtgccccaggcatgccggagtcttctgttgctctaagagcagatcaagcttctaacaatctttcatatggtggaccctttattgatgctcaaggcatggtaggtttttccattggccggacagtagaacgtgatcatagcaacgtgtttactggaggctcttatggtacattgtcagcacaaaacacagtaaatgcaaatatggtggagccaagatttcagcagccttctctgatctctcatcaaaaccaagggtttgcagttactggcacaggtgaggccttgacccctccaggcaatgctcaccggcgccatgagcattcatatcagcagctaccttcagggtatatcaatagagctccagttgctagtgaaccggcatcccatgttgtcgcaatttcttcattgaaagtttaccagactagatggacaatcaaggccagggtgactgctaagactggtgtcaagcattggaacaatgccaaaggtacagggaaacttttctcatttgatctcattgatggagaaggtggacaaattcgtgcagtatgcttcaaagaagcggttgataagttttatgatctaattgaggttgataaggtgtacttgatatctagtggagcagtgaaaccttcacagaagcggtttaatcctttgaataatgatcttgaaataactctggacaccttaacttcatctgtagagatttgttctagtgatgatttcaatattcctaaggtgcagtacagttttcagcagatcagtgaaatagagaacatggataatcatagtgcggtagatttacttggtgttgttacatcagttggtccttctgttatgatgacaaggaaggatggcacccaaacccagaaaagaacccttcaactgagggacatgtctggtcggagtgtgggagtgaccttttggggagacttctgtgatgttgaagggcagcagttgcagctgcagtgtcattccagtttcaatcctatacttgctttgataggtgcccgtatcagtgatttcagtggtagatcagtgagtacaatagggtcaacacagttgaaaataaacccagactttcctgatgctgaaaggctgagacagtggtatgtaactgaaggaatgaccactgcttgtctctctctatctcgggaacagtttaattcagtccaggctgatgtccgcaaaacaattgcacaaatcaaggatgaaaccttgggacgtaataagacagactggatcactgttaaggctgcaatctcacatgtacagactgaaagtttttgttatccagcgtgccccttaatttttaatgagaagccatgcaacaaaaaggtcatagatagtggtgatgggatatggttttgtgagagatgtgataagagctctggaagctgtgagtacaggtacatggttaaatttcgaatccaagatcacaccagcactatcatcgctaccgcattccaggaggctggtaagcagatatttggccgcaccgcacaagaacttcgcacaataagaaatgttaaccatgacgaggcactattcacagagatcatagaaggagcccgttggcatctaaatctatttaagttgaaagttagggaggaaagctacaacgatgaacaacgtattggatgtaccataattaatgctgaaaagttggatccatccaaagagagtaatgtcctttttgaagccattgacagacttatgcagggcagatcaggcccaagcccaggagatcagggcagcattgccaataaagctggtttcagcaattcaccagatggtcgcagtgccatcaatatgtgtggcacaaatcagtttgggcaacaaggaagcatagatgggagggtgtctactacatctgcaggtttggatagcgagcagcaaccagcgggtggaggcttcacaggcaacaattatggatctgctgctggcaactatggatatgttgctgctggcaatgccaggcagggtccgtgcttcaaatgccatcagccaggacactggagtaaggagtgtcctgggcggtaa

SEQ ID NO: 20923 - protein, 831 aa, Sorghum bicolor
  misc_feature: Ceres ANNOT ID no. 8678788
  misc_feature: Up-regulated in root tissues in response to methyl jasmonate treatment
  misc_feature: Up-regulated in shoot tissues in response to methyl jasmonate treatment
  misc_feature: Up-regulated in root tissues in response to salicylic acid treatment
  misc_feature (565)..(716): Pfam ID: Rep_fac-A_C Pfam Description: Replication factor-A C terminal domain
  misc_feature (7)..(119): Pfam ID: Rep-A_N Pfam Description: Replication factor-A protein 1, N-terminal domain
  misc_feature (294)..(377): Pfam ID: tRNA_anti Pfam Description: OB-fold nucleic acid binding domain
  misc_feature (813)..(830): Pfam ID: zf-CCHC Pfam Description: Zinc knuckle
MEAAAAQLTPGAVQAIANGAVCAALQPVLQVLEVRRVATTKSGDASASANPTPSERERYRLILSDGVDAHQAILATAFNPFVRDGTLRKGTIVHLNEFICDTIRDKRIIIIVKIEILQTACALIGNPKNYMAQIQGKVQDPNLSAIAAQNSGAPGMPESSVALRADQASNNLSYGGPFIDAQGMVGFSIGRTVERDHSNVFTGGSYGTLSAQNTVNANMVEPRFQQPSLISHQNQGFAVTGTGEALTPPGNAHRRHEHSYQQLPSGYINRAPVASEPASHVVAISSLKVYQTRWTIKARVTAKTGVKHWNNAKGTGKLFSFDLIDGEGGQIRAVCFKEAVDKFYDLIEVDKVYLISSGAVKPSQKRFNPLNNDLEITLDTLTSSVEICSSDDFNIPKVQYSFQQISEIENMDNHSAVDLLGVVTSVGPSVMMTRKDGTQTQKRTLQLRDMSGRSVGVTFWGDFCDVEGQQLQLQCHSSFNPILALIGARISDFSGRSVSTIGSTQLKINPDFPDAERLRQWYVTEGMTTACLSLSREQFNSVQADVRKTIAQIKDETLGRNKTDWITVKAAISHVQTESFCYPACPLIFNEKPCNKKVIDSGDGIWFCERCDKSSGSCEYRYMVKFRIQDHTSTIIATAFQEAGKQIFGRTAQELRTIRNVNHDEALFTEIIEGARWHLNLFKLKVREESYNDEQRIGCTIINAEKLDPSKESNVLFEAIDRLMQGRSGPSPGDQGSIANKAGFSNSPDGRSAINMCGTNQFGQQGSIDGRVSTTSAGLDSEQQPAGGGFTGNNYGSAAGNYGYVAAGNARQGPCFKCHQPGHWSKECPGR

SEQ ID NO: 20924 - DNA, 3237 bp, Sorghum bicolor
  misc_feature: Ceres ANNOT ID no. 8679190
  misc_feature: Down-regulated in shoot tissues in response to salicylic acid treatment
  misc_feature: Encodes the peptide sequence at SEQ ID NO 20925
atggatccgaggcgccacctctcccagttcagcaatccaaccctggctgcgtcctccttctctgaggagcagcttcgccttcccactgagaggcaggtcggattttggaagcaggagtcgttgcatcacattggaagcaagtcagttgcatcttctccaattgaaaagccccaacccattgggacaaaaactgtggctcggatagatccacaaccatacaagctgagagaccagaagactgcatttagccttgagcacaagacttttggtcaagagagacatgttaacttgccaccatctctgtggagaactgatcaagaccctaacctccaatctgattcatctttgtttcccgacggaaggaggactaatccaaatgaggcctacaatgagaatgggcttttctcaagctccctgtcagaaatttttgacagaaaatgtgagacagtttactctggcacttccatcaacttagtgattgattgtactgtacattttatgcttcaatctgtagtgggactgagatccaaggatgtgcttctacgtcagccagttgaaaaggttgatccaactcatgtagatgaggagccctttgagttaacggaggaaatagaagcgcaaataataggaaacatacttcctgatgatgatgacctattatcaggtgttcttgatgttgggtacacagcccatgctaacaatggtgatgatgtcgatgatgatatattctacactggaggcgggatggaactggaaaccgatgaaaataaaaaaaatacagaaactaatggtggagctaatgatggccttgggttgcttaatggcacaatgaatggtgaacatccatatggggaacacccttcaagaactctcttcgtccgaaacattaatagcaatgttgaggattctgaattaaggctcctatttgagcattatggagaaatcagcaacctttacactgcctgcaaacatcgtggttttgtgatgatatcttactatgacataagatcagcatggaatgccatgagggcacttcaaaacaagccactcagacgtagaaaacttgacatacattactccattccgaaggacaatccttcggagaaggatattaaccaggggatgcttgttgtatttaatgttgacccgtctgtaacaaataatgatatccatcagatatttagcgactatggtgaaataaaagagattcgtgatgcaccgcaaaagggtcatcacaaaattattgaattttacgatgtcagagcagccgaaagtgcagttcgtgctttaaacaggagtgatcttgctggcaagaaaataaaattggagactggccgtctgagtgctgctagacgctccatgcactccgttcgaggaaaaaaaggtggagttgtgagagcacctaaagaggtgctccataaactccagtttttttgtggagctgctccactgtgtgtggagtttgtggagcaatcccaaacaccccctaatctttgtttatttctgtatatgggctctcctgtcctaaacaaaacatatttttgtttattctttcatattgtattcctaattctttgtatcatatttaggtgtattgatatatacttaagcaattattatgtgatgcaacaacaacaacaacaacaacaacaacaacaacaacaacaaagccttttagtcccaagcaagttgggtttaacacagcacatgtccaaagagttggggcaggaggaatttggtgtatgcaaactgggcagtccaagcacaaatagccctccattggcttcattgggttcatctaatatggcagcaatgacatcttctggtcgtgaaaatgggagtattcatggtttgcattctggacttctcacatcaatgagcccgttcagagaggcttctttcccgggtctatcatctaccataccacagagcctgtcctctcccattggaattgcatctgctgcaactcatagtagtcaggcttcccttggtgagctcagccactcacttagtcggatgaatgggcatatgaattatggttttcaaggcatgggtgcccttcatccccattcccttcctgaagttcacaatggagcaaataatggcaccccttacaatctaaacaccatggcaccaattggtgtcaatagcaactcgagaacagctgaagcagttgacagcagacatcttcataaagtgggttctggtaacctcagtgggcactcatttgatcgtgtcggcgaaggagctatgggattttcaagaagtggaagcggtcctgtccgtggtcaccagctaatgtggaataattcaaataacttccaccgtcatcccaattcccctgtgctgtggcaaaatccgggatcatttgtaaacaatgtaccgtctcgccccccagcacaaatgcatggagttccaagagcaccatcacacatgattgagaatgttcttccaatgcatcatcatcatgtgggctctgcaccagcaatcaatccgtcactttgggacaggcggcatggctatgcaggggaattgacggaagcatcaagttttcatcctggcagtgttgggagcatgggatttcctggtagccctcagcttcatggtttggagctaaatagcatattttctcacaccagtgggaatcgcatggatccaaccgtgtcttccgctcagatcagcgcaccatctcctcaacaaagaggtcctatgttccatggaaggaatcctatggttcctcttccatcatttgattcacctggtgagcggatgagaagccggagaaatgactcaggtgctaaccagtctgataataaacggcagtacgagcttgatgttgaccgcataatgcggggggaagactcacgaactacactgatgataaagaatatcccgaataagtatacctccaagatgctcttggctgctattgatgaaagtcataagggcacttatgattttatttacttgccgattgattttaagaataaatgtaatgttggctatgctttcatcaacatgaccaaccctcagcatatcatcccgttttatcagacttttaatggtaaaaagtgggagaagtttaacagtgagaaggtggcatcacttgcttatgccagaatccaagggaaaacagccctgattgctcatttccagaactctagtttgatgaatgaggacaaacgctgccgccccatactcttccactcagaaggtcctaatgcaggagatcagtag

SEQ ID NO: 20925 - protein, 1078 aa, Sorghum bicolor
  misc_feature: Ceres ANNOT ID no. 8679190
  misc_feature: Down-regulated in shoot tissues in response to salicylic acid treatment
  misc_feature (956)..(1052): Pfam ID: RRM_2 Pfam Description: RNA recognition motif 2
  misc_feature (291)..(357): Pfam ID: RRM_1 Pfam Description: RNA recognition motif. (a.k.a. RRM, RBD, or RNP domain)
  misc_feature (376)..(442): Pfam ID: RRM_1 Pfam Description: RNA recognition motif. (a.k.a. RRM, RBD, or RNP domain)
MDPRRHLSQFSNPTLAASSFSEEQLRLPTERQVGFWKQESLHHIGSKSVASSPIEKPQPIGTKTVARIDPQPYKLRDQKTAFSLEHKTFGQERHVNLPPSLWRTDQDPNLQSDSSLFPDGRRTNPNEAYNENGLFSSSLSEIFDRKCETVYSGTSINLVIDCTVHFMLQSVVGLRSKDVLLRQPVEKVDPTHVDEEPFELTEEIEAQIIGNILPDDDDLLSGVLDVGYTAHANNGDDVDDDIFYTGGGMELETDENKKNTETNGGANDGLGLLNGTMNGEHPYGEHPSRTLFVRNINSNVEDSELRLLFEHYGEISNLYTACKHRGFVMISYYDIRSAWNAMRALQNKPLRRRKLDIHYSIPKDNPSEKDINQGMLVVFNVDPSVTNNDIHQIFSDYGEIKEIRDAPQKGHHKIIEFYDVRAAESAVRALNRSDLAGKKIKLETGRLSAARRSMHSVRGKKGGVVRAPKEVLHKLQFFCGAAPLCVEFVEQSQTPPNLCLFLYMGSPVLNKTYFCLFFHIVFLILCIIFRCIDIYLSNYYVMQQQQQQQQQQQQQQSLLVPSKLGLTQHMSKELGQEEFGVCKLGSPSTNSPPLASLGSSNMAAMTSSGRENGSIHGLHSGLLTSMSPFREASFPGLSSTIPQSLSSPIGIASAATHSSQASLGELSHSLSRMNGHMNYGFQGMGALHPHSLPEVHNGANNGTPYNLNTMAPIGVNSNSRTAEAVDSRHLHKVGSGNLSGHSFDRVGEGAMGFSRSGSGPVRGHQLMWNNSNNFHRHPNSPVLWQNPGSFVNNVPSRPPAQMHGVPRAPSHMIENVLPMHHHHVGSAPAINPSLWDRRHGYAGELTEASSFHPGSVGSMGFPGSPQLHGLELNSIFSHTSGNRMDPTVSSAQISAPSPQQRGPMFHGRNPMVPLPSFDSPGERMRSRRNDSGANQSDNKRQYELDVDRIMRGEDSRTTLMIKNIPNKYTSKMLLAAIDESHKGTYDFIYLPIDFKNKCNVGYAFINMTNPQHIIPFYQTFNGKKWEKFNSEKVASLAYARIQGKTALIAHFQNSSLMNEDKRCRPILFHSEGPNAGDQ

SEQ ID NO: 20926 - DNA, 2874 bp, Sorghum bicolor
  misc_feature: Ceres ANNOT ID no. 8679302
  misc_feature: Up-regulated in shoot tissues in response to methyl jasmonate treatment
  misc_feature: Up-regulated in shoot tissues in response to salicylic acid treatment
  misc_feature: Up-regulated in root tissues in response to salicylic acid treatment
  misc_feature: Encodes the peptide sequence at SEQ ID NO 20927
atggaggtgtgctgctgctcgacctcctcgtcgtcgtccgtcctcaccgtgggccacggcggcgccgcgcggatgctggcggcgccggcgggtcggtggggcgcggcggcggggttcgggagggcgatggtgctggcgcaccagctcccgctcccgctcccgctcccgctcccgcgcccggcagccagggccagggccaggccggccccgcggcgccgcaggggaggaggagtcgtcagggcggtgttcgagcggttcacggagcgggccgtcaaggcggtggtgctgtcgcagcgggaggcccgggggctcggggagcccgccgtggcgccgcgccacctcttcctcggcctcgtcgccgaggaccgctcctcgggcgggttcctctcgtccgggatcaacatcgagcgcgcaagggaggagtgccgcggcatcgctgccgccagggacgacgccgactcgacggccgcgccgtcgtccaggcccggatcgggggggctcgacacggacgtgcccttctccgccaccgccaagcaggtcttcgatgtcgccgtcgtgctgtccaagaacatgggcgccagcttcatctcgcctgagcacctcgccatcgcgctcttcaccctcgacgatccaaccaccaacaacctcctaaggagtttgggagcggatcccagtcacctagcatcagttgcggtcgaccgtctccaagcggagcttgcgaaagatggcagagaacctgccgaaccgtcgtctttcaaagtcccaaagaaagcccctgctggagccggaagatctgccttctcccactccttgactaaaaagaaagataagggtgcactggatcaattttgtttggatttgaccacacaagctagtggaggtttcattgatcctattattggccgtgaagacgagattgaaagagtagttcagataatatgccgacggacgaagaacaaccctattcttctgggtgaggcgggtgttggcaaaactgcaattgctgaggggctggctcttcgaattgcaaatggagatgtccccatttaccttgtggcaaagcgtatattgtcactggacgttggtctacttattgctggtgcaaaggagaggggtgaactggagtctagggtcactaatataatccgtgaagtccgggaagcaggcgatgttattctttttatcgatgaggttcacaatcttattggatctggaactgttggaaagggtaagggttctggtcttgacattggcaacttgctgaagcccgcacttgctagaggtgaactgcagtgcattgcggctacaactctagatgaacaccggatgcattttgagaaggataaggctttggcccgccgcttccagccagtattagtagatgagcctagtcaggaagatgctgtgaagatattactgggtcttcgtgagaaatatgaaacttaccataaatgcaaattcacattggaagccatcaatgcagcagtttatttgtcagcaagatacattcctgacagacaacttcctgataaggctattgatctgattgatgaggctggaagtagggctcggatggaatcatttaataagaagaaggaagggcagtcttcaattctcttgaaatcaccagatgagtactggcaagagataagagctgctcaggccatgcatgaagtggtgttatctaacaaggcaaaatattctccaaatgagaatgctcaagaaagtggtagcgctaccgttgaagcaccaagtcgagacaatatcgagtcaacatctggttcctcactctcagctgatgaaccaattgtagttgggacagaggaaattgcaagagttgcctcattatggtctggaataccagtgcagcagttgactgccgacgataaaaaacttctagtaggactagacgacgagctcagaaaacgtgtcattggtcaagatgatgctgttgtggccatatctcgtgcagtgaagagatcacgtgttggccttaatgaccctgacagacctattgccacgctgcttttctgtggtccaacaggagttggtaaaacagagctcaccaaagctctagcagctagttattttggatcggaatctgctatgcttaggttagacatgagcgagtatatggagaggcacactgtgagcaagctcataggttctcctccagggtacattgggtatggtgaaactggtactttgacagaagcagtcaggagaaaaccatttaccgtggtattgatggatgagatagagaaagctcaccctgatattttcaacatccttctccaaatctttgaggatggacatttgacagactcacagggccgtaaggtttccttcaaaaatacgttgattgtcatgacttcgaatgttggttcgacaacaatttcaaagggacgacagagcataggtttcttgaaggaagataccgagtcaagctcgtattttgcaatgaaatccttagtaatggaagagctcaaggcatttttccgtccagagttgctcaataggattgacgagatggttgtgttccgtcctctggagaagactcagatgctggccattcttgatatcatcctaaaggaagtcaagggccgacttttggcccttgggataggtttggaggtgtctgaggcaatgaagcacctgatttgccaagaaggctacgacaagagctatggtgctcggcctctgaggagagctgttgcccacattatcgaggatgtcattagtgaagctattctttttggcgagttcaagcctggtgacacgatactgatggacattgatgcagaggggaagccatgcatgaaccatctggaccgacagatcgtccaggtctctgacccaacacggacgttctga

SEQ ID NO: 20927 - protein, 957 aa, Sorghum bicolor
  misc_feature: Ceres ANNOT ID no. 8679302
  misc_feature: Up-regulated in shoot tissues in response to methyl jasmonate treatment
  misc_feature: Up-regulated in shoot tissues in response to salicylic acid treatment
  misc_feature: Up-regulated in root tissues in response to salicylic acid treatment
  misc_feature (671)..(890): SWISSPROT Homolog: EC 3.4.21.53 Endopeptidase La
  misc_feature (670)..(844): Pfam ID: AAA_2 Pfam Description: ATPase family associated with various cellular activities (AAA)
  misc_feature (184)..(236): Pfam ID: Clp_N Pfam Description: Clp amino terminal domain
  misc_feature (320)..(525): Pfam ID: AAA Pfam Description: ATPase family associated with various cellular activities (AAA)
MEVCCCSTSSSSSVLTVGHGGAARMLAAPAGRWGAAAGFGRAMVLAHQLPLPLPLPLPRPAARARARPAPRRRRGGGVVRAVFERFTERAVKAVVLSQREARGLGEPAVAPRHLFLGLVAEDRSSGGFLSSGINIERAREECRGIAAARDDADSTAAPSSRPGSGGLDTDVPFSATAKQVFDVAVVLSKNMGASFISPEHLAIALFTLDDPTTNNLLRSLGADPSHLASVAVDRLQAELAKDGREPAEPSSFKVPKKAPAGAGRSAFSHSLTKKKDKGALDQFCLDLTTQASGGFIDPIIGREDEIERVVQIICRRTKNNPILLGEAGVGKTAIAEGLALRIANGDVPIYLVAKRILSLDVGLLIAGAKERGELESRVTNIIREVREAGDVILFIDEVHNLIGSGTVGKGKGSGLDIGNLLKPALARGELQCIAATTLDEHRMHFEKDKALARRFQPVLVDEPSQEDAVKILLGLREKYETYHKCKFTLEAINAAVYLSARYIPDRQLPDKAIDLIDEAGSRARMESFNKKKEGQSSILLKSPDEYWQEIRAAQAMHEVVLSNKAKYSPNENAQESGSATVEAPSRDNIESTSGSSLSADEPIVVGTEEIARVASLWSGIPVQQLTADDKKLLVGLDDELRKRVIGQDDAVVAISRAVKRSRVGLNDPDRPIATLLFCGPTGVGKTELTKALAASYFGSESAMLRLDMSEYMERHTVSKLIGSPPGYIGYGETGTLTEAVRRKPFTVVLMDEIEKAHPDIFNILLQIFEDGHLTDSQGRKVSFKNTLIVMTSNVGSTTISKGRQSIGFLKEDTESSSYFAMKSLVMEELKAFFRPELLNRIDEMVVFRPLEKTQMLAILDIILKEVKGRLLALGIGLEVSEAMKHLICQEGYDKSYGARPLRRAVAHIIEDVISEAILFGEFKPGDTILMDIDAEGKPCMNHLDRQIVQVSDPTRTF

SEQ ID NO: 20928 - DNA, 2412 bp, Sorghum bicolor
  misc_feature: Ceres ANNOT ID no. 8679322
  misc_feature: Up-regulated in shoot tissues in response to salicylic acid treatment
  misc_feature: Encodes the peptide sequence at SEQ ID NO 20929
atggcggcgttcgcggtctctggagcggcgctcggtggggccgtaagggctccccgactcaccggcggcgaggaggggagtctggtcttccggcgcaccggccccttcttaactcgtgcagggggtgctagagttggaggttccgggacgcacggggccatgcgcgcggcggccgcgtcgtccaggaaggcggtcgtggttgccgaaggcgagaacgacggcctcgcatcgaaggctgactcggctcagttccagtcggatgaactggaggtaccagacgttactgaagagacgatgtgcgatgccggcgtggctgatgctcaagccttgaacagagttcgagtggtcccaccaccgagcgatggacaaaaaatattccagattgaccccatgctgcaaggctataagtaccatcttgagtatcggtacagcctctataggagaatccgttcagacattgatgagcatgaaggaggcttggaagccttctcccgtagttatgagaagtttggatttaatcgcagcgcggaaggtatcacctatcgagaatgggctcctggagcactttctgcagcattggtgggcgacttcaacaactgggatccaaatgcagaccgtatgagcaaaaatgagtttggtgtttgggagatttttctgcctaacaatgcagatggtacatcacctattcctcatggaactcgtgtaaaggtgagaatggatactccatcagggataaaggattcaattcctgcctggatcaagtactcagtacaggctccaggagaaataccatacgatgggctttattatgatcctcctgaagaggtaaagtatgtgttcaagcatcctaaacctaaacgaccaaaatcattgaggatatatgaaacacatgttggaatgagtagcccggaaccgaagataaacacatatgcaaactttagggatgaggtcctcccaagaataaaaaaacttggatacaatgcagtgcaaataatggcaatccaagagcactcatattatggaagctttggataccatgtaactaatttttttgcaccaagtagtcgttttggtactccagaagatttgaagtctatgattgatagagcacatgagcttggtttgctagttctcatggatgtggtccatagtcatgcgtcaagtaatactctggatgggttgaatggttttgatggtacggatacacattattttcatagtggtccacgaggccatcactggatgtgggattctcgcttattcaactatgggaactgggaagttttaagatttcttctctccaatgctagatggtggcttgaggaatataagtttgatggtttccgctttgatggtgtgacctccatgatgtacactcaccacggattacaagtaacatttacggggaacttcaatgagtattttggctttgccaccgatgtagatgcagtggtttacttgatgctcgtaaatgatctaattcatggactttatcctgaggctgtaaccattggtgaagatgttagtggaatgcccacatttgcccttcctgttcaagatggtggggtaggttttgactatcggatgcacatggctgtggctgacaaatggattgaacttctcaagcaaagtgatgaagcttggaagatgggtgatattgtgcacacactaacaaatagaaggtggttggagaagtgtgtaacttatgctgaaagtcatgatcaagcattagtcggtgacaagactattgcattttggttgatggacaaggatatgtatgatttcatggcccttgatagacctgcaactcctaccattgatcgtgggatagcattacataagatgattagacttatcacaatgggtttaggaggagagggctatcttaatttcatgggaaatgagtttggacatcctgaatggatagattttccaagaggtccacaaagacttccaagtggtaagttcattccagggaataataacagttatgacaaatgccgtcgaagatttgacctgggtgatgcggactatcttaggtatcgtggtatgcaagagtttgatcaggcaatgcaacatcttgagcaaaaatatggattcatgacatccgatcaccagtatatttctcggaaacatgaggaggataagatgattgtgtttgaaaagggagatttggtatttgtgttcaacttccactgcaacaacagctattttgactaccgtattggttgtcgaaaacctgggatgtataaggtggtcttggactcggacgctggactatttggtggatttggcaggatccatcacgcagcagagcacttcactaccgactgttcacatgataacaggccccattcgttctctgtttatacaccaagcagaacctgcgtcgtctatgctccagcggaatga

SEQ ID NO: 20929 - protein, 803 aa, Sorghum bicolor
  misc_feature: Ceres ANNOT ID no. 8679322
  misc_feature: Up-regulated in shoot tissues in response to salicylic acid treatment
  misc_feature (3)..(803): SWISSPROT Homolog: EC 2.4.1.18 1,4-alpha-glucan branching enzyme
  misc_feature (169)..(253): Pfam ID: Isoamylase_N Pfam Description: Isoamylase N-terminal domain
  misc_feature (707)..(802): Pfam ID: Alpha-amylase_C Pfam Description: Alpha amylase, C-terminal all-beta domain
  misc_feature (292)..(613): Pfam ID: Alpha-amylase Pfam Description: Alpha amylase, catalytic domain
MAAFAVSGAALGGAVRAPRLTGGEEGSLVFRRTGPFLTRAGGARVGGSGTHGAMRAAAASSRKAVVVAEGENDGLASKADSAQFQSDELEVPDVTEETMCDAGVADAQALNRVRVVPPPSDGQKIFQIDPMLQGYKYHLEYRYSLYRRIRSDIDEHEGGLEAFSRSYEKFGFNRSAEGITYREWAPGALSAALVGDFNNWDPNADRMSKNEFGVWEIFLPNNADGTSPIPHGTRVKVRMDTPSGIKDSIPAWIKYSVQAPGEIPYDGLYYDPPEEVKYVFKHPKPKRPKSLRIYETHVGMSSPEPKINTYANFRDEVLPRIKKLGYNAVQIMAIQEHSYYGSFGYHVTNFFAPSSRFGTPEDLKSMIDRAHELGLLVLMDVVHSHASSNTLDGLNGFDGTDTHYFHSGPRGHHWMWDSRLFNYGNWEVLRFLLSNARWWLEEYKFDGFRFDGVTSMMYTHHGLQVTFTGNFNEYFGFATDVDAVVYLMLVNDLIHGLYPEAVTIGEDVSGMPTFALPVQDGGVGFDYRMHMAVADKWIELLKQSDEAWKMGDIVHTLTNRRWLEKCVTYAESHDQALVGDKTIAFWLMDKDMYDFMALDRPATPTIDRGIALHKMIRLITMGLGGEGYLNFMGNEFGHPEWIDFPRGPQRLPSGKFIPGNNNSYDKCRRRFDLGDADYLRYRGMQEFDQAMQHLEQKYGFMTSDHQYISRKHEEDKMIVFEKGDLVFVFNFHCNNSYFDYRIGCRKPGMYKVVLDSDAGLFGGFGRIHHAAEHFTTDCSHDNRPHSFSVYTPSRTCVVYAPAE

SEQ ID NO: 20930 - DNA, 1938 bp, Sorghum bicolor
  misc_feature: Ceres ANNOT ID no. 8679405
  misc_feature: Up-regulated in root tissues in response to methyl jasmonate treatment
  misc_feature: Encodes the peptide sequence at SEQ ID NO 20931
atgatgtcattgcatattgggcggctttcccaagatgttcggcaaagttatcttgaacatctgttccagaggtttggtcgttgcactgtgaacctgaaagatggatatgggtttgctgtgtatgattctgatgatgatgcaactcgagccatgagggccctgcatgggaaatatgtttgtggggagcgcattactgttaattggtcaaagcagcagcccagattttctcagagtttcaggagaagttcgagatttgttgaattgtctcgcggaaggaacttcagagatgctagggacaacattaggttcagggatcctctagctcggaataatcaaccagcgaatcatgatcagagtcatgattctgatgctgtgctcaaaaaggaatctggtaaatttgctgagattgtcaatgatgctgaagaaaacattggtgatgatccaggggaggtgaagagggacgaaggtggtacaaatgatgaaggtccaggggaggtgaaaactgacgatggtggtacagctgatgcagatataatcgagcatgatagatgggctgggaaaggtacccctggtggagatggtgatgattttgaccgctatgagccttatcatggatatgaaaggcaagaagaaacggaaaatgtgattaaagcaagttcttatgattctcgtgaacacaaacatttttcagagaagtggcaagagcactctgacaagcatgttgacataagccatgataaatcaagatctcctccaacctgttacagttgtggtgttgctggccatattgcacgtaattgccctcgtggaatagatgataacttcataccaaggagagatggactgaactttaaggaaaaatggcagctgaggcagagaagatttgggtcaccctcgaggaggcgaccagaatttcctattcatccattggaccaaacaaatcataaagttcaagatggtaggaagccatttgctgagaggaatatgcaaatgcattggcccagagacagcaggagacatgcccactacagtgaaaacatgccacaaacaaacaaggaagggcgcaagagaagcagatctgaaaggtcacgggggtcatcgccctcttcagaaccttcaaggcgctctaaccatgctaatcttaagagatctcattccaacaggacttcctcagattcaagatctaaatccccccgatcccgacctcgatttaaagcacattcgccaacttattctgcacattctagttcaaaatcatctcaaccagctcagcatgaaggatcaaggtcaaatatcaaccatcctgttccattttcagtatctgcttcaccacagcacaagtcatctcctgatatagagaacaaaaatctagttggtctgatgaattctcaattggaggacaacttggagttcaggacaagatctgaagtaaaaaatctggatgataacaagcaagaaggaaatggtccggttttgaaaagcaaggtcctgaatggaggaacacttgttcgtaacaagaatgcaaatgttactggttacacagggtctgacttcgataagaactttgttgatgataatgctgccaatagagtgcaaagccagaatgctaaatttgaggactctttgtcagtgaaaccaaagcaggatgttctggccaaaaatgggagaagcaagtctttgaagctaacaactaacgaagtgatctcagctctgaagcactatggggttgaggcacaagagggagattcatcagatcaatctgtggagaagtactttggtgctgcacgcctgtggccttgggaaatcatttactatcgcaggcgtaagaaaggtccaatatctactgagaattatgctaagcgacttgagcagaacaaagaatttggtattgtggatcagtatgtcagaagcagcagtggttggtgggagtgtcattaa

SEQ ID NO: 20931 - protein, 645 aa, Sorghum bicolor
  misc_feature: Ceres ANNOT ID no. 8679405
  misc_feature: Up-regulated in root tissues in response to methyl jasmonate treatment
  misc_feature (4)..(66): Pfam ID: RRM_1 Pfam Description: RNA recognition motif. (a.k.a. RRM, RBD, or RNP domain)
  misc_feature (252)..(269): Pfam ID: zf-CCHC Pfam Description: Zinc knuckle
MMSLHIGRLSQDVRQSYLEHLFQRFGRCTVNLKDGYGFAVYDSDDDATRAMRALHGKYVCGERITVNWSKQQPRFSQSFRRSSRFVELSRGRNFRDARDNIRFRDPLARNNQPANHDQSHDSDAVLKKESGKFAEIVNDAEENIGDDPGEVKRDEGGTNDEGPGEVKTDDGGTADADIIEHDRWAGKGTPGGDGDDFDRYEPYHGYERQEETENVIKASSYDSREHKHFSEKWQEHSDKHVDISHDKSRSPPTCYSCGVAGHIARNCPRGIDDNFIPRRDGLNFKEKWQLRQRRFGSPSRRRPEFPIHPLDQTNHKVQDGRKPFAERNMQMHWPRDSRRHAHYSENMPQTNKEGRKRSRSERSRGSSPSSEPSRRSNHANLKRSHSNRTSSDSRSKSPRSRPRFKAHSPTYSAHSSSKSSQPAQHEGSRSNINHPVPFSVSASPQHKSSPDIENKNLVGLMNSQLEDNLEFRTRSEVKNLDDNKQEGNGPVLKSKVLNGGTLVRNKNANVTGYTGSDFDKNFVDDNAANRVQSQNAKFEDSLSVKPKQDVLAKNGRSKSLKLTTNEVISALKHYGVEAQEGDSSDQSVEKYFGAARLWPWEIIYYRRRKKGPISTENYAKRLEQNKEFGIVDQYVRSSSGWWECH

SEQ ID NO: 20932 - DNA, 1485 bp, Sorghum bicolor
  misc_feature: Ceres ANNOT ID no. 8679482
  misc_feature: Up-regulated in root tissues in response to methyl jasmonate treatment
  misc_feature: Up-regulated in shoot tissues in response to methyl jasmonate treatment
  misc_feature: Up-regulated in shoot tissues in response to salicylic acid treatment
  misc_feature: Encodes the peptide sequence at SEQ ID NO 20933
atggttgggagcgtgggcaacgggctggcggatctgggcgcagcaggggccgtctccatgaacggggtcgggaagccgctgcatcctgccgaggcggcggcggcggtggagacgctcccgatggagctggagccgccggaggccttagtggccgcggcggcggaggcgaagcgggaggaggctggtgcaaacgggaggaggagggtgatcgtgatggggaggaacgtgcacacctcctgcttcgccgtcaaggagcccgacgcggacgacgaggagaccggcgagcgggaggcgaccatggccagcgtcctcgcgctctaccgccgctcgctcgtcgaacgcaccaagcaccacctcggttacccatacaatctggactttgattatggtgcactggcccagctacagcacttctccattaataaccttggtgaccccttcattgagagcaactacggtgtccactccaggcagtttgaggttggagtgttggattggttcgctcgcctctgggagttagaaaaggatgagtactggggatatattactaactgtggtacagaaggaaatctgcatgggattcttgttgggcgggaggtgtttcctgatggaatattgtatgcttctcgcgagtcccattattcagtattcaaagcagcaagaatgtacagaatggattgtgtcaaagttgacacccttatgtctggggaaatagattgtgctgatttccatagaaagttattgcagaaccgagacaaacctgccatcattaatgttaacattggaacaactgtgaagggggcagttgatgatctagacttggttatcaaaacccttgaggaaaatggctttaaagatcggttctatattcattgtgatggtgccctttttggattgatgataccatttgttaagaaggcacctcaagtgacatttaaaaagcctattgggagtgtcagcgtctctgggcacaagtttgttggatgccccatgccatgtggtgtccagataacaagattggagcacataaatgccctttctagcaatgtggaatatctggcgtcaagggatgcaacgatcatgggaagcaggaatggccatgcgcctatcttcctctggtacaccctcaacaggaagggctacagaggctttcagaaagaagtccagaagtgcttgagaaatgcacactacctaaaagatcgcctcaaggaagcaggagttggagcaatgcttaacgagctcagcagcacagttgtatttgaaaggccgaaggatgaagaatttgtccgaaggtggcagctcgcttgtgaaggcaatatagctcacgttgtggtgatgcccagtgtcaacattgacaagctagattatttcctgaatgaattagtggagaaacgagcgacttggtaccaggatggaataagtcaacccccctgcattgccagagacgtaggcgtcgagaactgtctgtgtggccttcacaagtag

SEQ ID NO: 20933 - protein, 494 aa, Sorghum bicolor
  misc_feature: Ceres ANNOT ID no. 8679482
  misc_feature: Up-regulated in root tissues in response to methyl jasmonate treatment
  misc_feature: Up-regulated in shoot tissues in response to methyl jasmonate treatment
  misc_feature: Up-regulated in shoot tissues in response to salicylic acid treatment
  misc_feature (92)..(494): SWISSPROT Homolog: EC 4.1.1.22 Histidine decarboxylase
  misc_feature (86)..(424): Pfam ID: Pyridoxal_deC Pfam Description: Pyridoxal-dependent decarboxylase conserved domain
MVGSVGNGLADLGAAGAVSMNGVGKPLHPAEAAAAVETLPMELEPPEALVAAAAEAKREEAGANGRRRVIVMGRNVHTSCFAVKEPDADDEETGEREATMASVLALYRRSLVERTKHHLGYPYNLDFDYGALAQLQHFSINNLGDPFIESNYGVHSRQFEVGVLDWFARLWELEKDEYWGYITNCGTEGNLHGILVGREVFPDGILYASRESHYSVFKAARMYRMDCVKVDTLMSGEIDCADFHRKLLQNRDKPAIINVNIGTTVKGAVDDLDLVIKTLEENGFKDRFYIHCDGALFGLMIPFVKKAPQVTFKKPIGSVSVSGHKFVGCPMPCGVQITRLEHINALSSNVEYLASRDATIMGSRNGHAPIFLWYTLNRKGYRGFQKEVQKCLRNAHYLKDRLKEAGVGAMLNELSSTVVFERPKDEEFVRRWQLACEGNIAHVVVMPSVNIDKLDYFLNELVEKRATWYQDGISQPPCIARDVGVENCLCGLHK

SEQ ID NO: 20934 - DNA, 3405 bp, Sorghum bicolor
  misc_feature: Ceres ANNOT ID no. 8679610
  misc_feature: Down-regulated in root tissues in response to methyl jasmonate treatment
  misc_feature: Encodes the peptide sequence at SEQ ID NO 20935
atgggggtgccagaggcggtggcgctggacataccggcggtggaggaggggtcgccgacgccgctggccagggtgccacccaggatcaggcggaggctcctccgtgcggggggcagcggagaaaacggcggcaaggcgccgacggccgaggagatcgaggccaagctacaccaggcgcatctccggaggcagcaattccacgaagcattgtcctccaaagcaaggcgctcaattaagagtccttcagggtcatcacaggaggaggatcgagggcagcttcttgaggcaaagcttgtggctgccaagcagaagaggttgagcctcttggaaaaggaacagggccggttggctaagctggacaaactgcgacaggctgtgaagagtgatgcagagatgaggttcgagagggaaagggaagaactcggaatgaaagttgaatcgcgggttcagaaggctgagaacaatcgtatgcaactcctgcatgctcgtttgcagaggcaggctgcattagaggagaggacaaaaaggtacttcatgaaaagattggctggggaaaacaagtacagggagcgtgtacaatctgcaatgcagaagcataatgctgctgagaagagacgatcggggctgctggaatttgagaaaagacaggcacagggtaggctcttgcaggttcaacttgctgcgaggactgcctctaaccagagagaaactgagaggagcaagttaaaagagcaattagaagaaaagcttcagaagcttatgattcatttcattttttgggacttcagatgctggagaagattcagaacttctaggaaaacaacagtggtattggctagggcctttgatgtattggggataaatcagcgatcagttgtgtctatgccatttgaagagttagctctctgcattgaatctcctgcagttcttcagaccactaaggctttgcttaaccgtctggagagtcgtttcgtcttctctcagtcatcaagttcatcaaaaccagaaaatatcgaccaccttctaaaggatcttggatcaccgaagaggaggatcctaccgagcaatgtgagaagaagtaaggcaacactggaaaaggcagctggaaattatgactccagtaagttgtctagatattcacaaaggattgcactttgtgcttatatgatactaggtcatccaaaatctgttcttagtggacaaggtgagcaagagaaattgcttatggaatcagcaacaaactttgtgaaggaattcgaactgctggttaaaacagtgcttgatgccctagatggtgcatgcatattgagtcagtcagttctagatgatgccactcctggttgttctaactatgaggaatcttcatccattgttgctgatcagaagaaattcagaactcagctggttgcctttgacaaagcttggtgtgcttatctttaccattttgcggcgtggaaagcaaaagatgctaaatcattagaggatgatctcattagggctgcatgcaagctcgagctgtcaatgatccaaacttgcaaaataacggatgaagacaaatctgataacctcggcggtgatttgaaagccatatggaaacaggtcgcagaagaccagaaacttttaagggagaggattcaatacctgggcggtgaagctggtattggaaggatggaatctgctttatctgaaacacggtcaaagttctttcaagcaaaggagaacaggagttccattgcaactacagttgcaaatgttacatctccttcggttacatgttcttcaggacagtctaatgtctctgaaactggggagaattctaacatggatgctgaaaagacaagtcgaattgtcaaatctctgtttggagcttcctcttcacgatatgaaagtagcaaaggaggcaagctgatgagtaacgcagcaccagaaaaaatgcctactgaaaatgagcaaatagtcaatgagatactccataatacacatggttcttttgctgacatctccgatggtactggtactgttgaaggtgatttcaaggtaaaagtcaaggaaacaatggagaaagctttctgggatgtggttgcggattcaatgagaggggacatgccagactatggttatctggtcagcctggtaaaggaaatcagggaagcattggaagagttagctcctccagggtggaaagtagaaatcagtgacaatattaaccttgaaattttgacccaggacagaaaataccttggacaaattttgcagtactccctggataagcttcggaaactgtcttctcctgcgaaggaactcgagatgaagaagagtcatgataaattgttgggagaattgattgaaggctctgaatctaattatagagattcaaattcatttgttctttgtgttatcaagggtttgcgcttcactatggaggaattagaggctctaaaagcagaagtcaatagagcacgcatccaactattggaaccaatgatcaagggaccaggtggagtggagtacctgcataagtcttttgctgatcgctatggttccccttctgatgcgttagctactctcccttcaactgcccggtggatttcctccttgaaagatgttgtggaagaacaatggaatgaacatgtcagctcgttatcaattctgacagaagcagaccatgttcagccacttgttgccactctccgaactggccatgcagttccaggtcagctacaatctgtgatacctgcagcagacaatgcaggactaccagaatgtaggggagacatactcggcaagctcataaggattgggttattacagctcatcagcagcattgagggtgtgcaaagggaatcagttcctgagacctttatgctcaattggttgaggctgcggtctgttcagagtaaatttcaacaagtgattgtggtagcgacaagcatgcttgtcttgcatcaggtgttagtgagtgagaacccgaagatcactcctcctgagctggagaatgcgactttggaactgttcaacgtcctcacaaggctactagacaactttccagatgttggcactgagaaaatcattgaggccatgatgtattcatcaacctcaaggagctcatcgtcagatcatgaaatgatggatgccaggaaggagatattgactagggtcttccttaaaagcctccagaccgatgacaccatcttcaagaaggtctctcagtctgtgtactgtgcattccgtgcaatcactctgggcggcagtggggagaagggccggaagctcgccgatgcatccctgaggcgcatcggggcaacaaaactcactgcacggctagtgaaggcagctgaagtgcttctcaaagcagcaatggtgtcagagcaggtccatggcccatggtacacgcagctgctgtga

SEQ ID NO: 20935 - protein, 1134 aa, Sorghum bicolor
  misc_feature: Ceres ANNOT ID no. 8679610
  misc_feature: Down-regulated in root tissues in response to methyl jasmonate treatment
  misc_feature (663)..(1134): Pfam ID: Tcp11 Pfam Description: T-complex protein 11
MGVPEAVALDIPAVEEGSPTPLARVPPRIRRRLLRAGGSGENGGKAPTAEEIEAKLHQAHLRRQQFHEALSSKARRSIKSPSGSSQEEDRGQLLEAKLVAAKQKRLSLLEKEQGRLAKLDKLRQAVKSDAEMRFEREREELGMKVESRVQKAENNRMQLLHARLQRQAALEERTKRYFMKRLAGENKYRERVQSAMQKHNAAEKRRSGLLEFEKRQAQGRLLQVQLAARTASNQRETERSKLKEQLEEKLQKLMIHFIFWDFRCWRRFRTSRKTTVVLARAFDVLGINQRSVVSMPFEELALCIESPAVLQTTKALLNRLESRFVFSQSSSSSKPENIDHLLKDLGSPKRRILPSNVRRSKATLEKAAGNYDSSKLSRYSQRIALCAYMILGHPKSVLSGQGEQEKLLMESATNFVKEFELLVKTVLDALDGACILSQSVLDDATPGCSNYEESSSIVADQKKFRTQLVAFDKAWCAYLYHFAAWKAKDAKSLEDDLIRAACKLELSMIQTCKITDEDKSDNLGGDLKAIWKQVAEDQKLLRERIQYLGGEAGIGRMESALSETRSKFFQAKENRSSIATTVANVTSPSVTCSSGQSNVSETGENSNMDAEKTSRIVKSLFGASSSRYESSKGGKLMSNAAPEKMPTENEQIVNEILHNTHGSFADISDGTGTVEGDFKVKVKETMEKAFWDVVADSMRGDMPDYGYLVSLVKEIREALEELAPPGWKVEISDNINLEILTQDRKYLGQILQYSLDKLRKLSSPAKELEMKKSHDKLLGELIEGSESNYRDSNSFVLCVIKGLRFTMEELEALKAEVNRARIQLLEPMIKGPGGVEYLHKSFADRYGSPSDALATLPSTARWISSLKDVVEEQWNEHVSSLSILTEADHVQPLVATLRTGHAVPGQLQSVIPAADNAGLPECRGDILGKLIRIGLLQLISSIEGVQRESVPETFMLNWLRLRSVQSKFQQVIVVATSMLVLHQVLVSENPKITPPELENATLELFNVLTRLLDNFPDVGTEKIIEAMMYSSTSRSSSSDHEMMDARKEILTRVFLKSLQTDDTIFKKVSQSVYCAFRAITLGGSGEKGRKLADASLRRIGATKLTARLVKAAEVLLKAAMVSEQVHGPWYTQLL

SEQ ID NO: 20936 - DNA, 891 bp, Sorghum bicolor
  misc_feature: Ceres ANNOT ID no. 8679703
  misc_feature: Up-regulated in root tissues in response to salicylic acid treatment
  misc_feature: Up-regulated in shoot tissues in response to salicylic acid treatment
  misc_feature: Encodes the peptide sequence at SEQ ID NO 20937
atggggcaaggttccgacgaaggcgccgacggcgcagggcactcggcgtggccgagcggcggcgacgccgacacacccgtggcgcccacggcgggtgcggcggccgccatgacgctcggcagcatcctcaccgtcgcgggcatcctcctgctcttcgtcatcttcgccttcggcctcgcctccctccagtactgcttccaacggagcgagcggcggcgccgtggtccgcggacgcccgccggtggtagcaccaggggtggtgggacgatgcggaccagcaccagcgggggcgtcgacccggagctgctgcgctcgctgcctgtcacggtgtaccatctggcgacgcgaggtgcggacaaggagcggcaggacgcggtggtggagtgcgccgtgtgcctcgccgagctccaggacggcgaggaggcgcggttcctgccccgctgtggccacggcttccacgccgagtgcgtcgacatgtggctcgtctcccacaccacctgcccgctctgccggctcaccgtctccaagcccgacggcgtatctcctcatccggtgtcttccttggctcttccaccggtcccgccggagcccgcgagctacgccaccgccagcctccccgtcagcgtgcttcttggggtgtctggccatgacgtggtcaccgcggtgaccacgaacccatccaccttggtgatcgagatccccgagctggccgtgccgacgccgacgctgacaccgtgcgacgctgccaagtcaccggggtcggcgaggctgagatcgatcaggaggctctggagcttcggaaggcaaggcgccggagcgacttcttcatcctgctcatgtgccggtgcaggtgccagcgaaggagtcgacttggagcagggtatcagctag

SEQ ID NO: 20937 - protein, 296 aa, Sorghum bicolor
  misc_feature: Ceres ANNOT ID no. 8679703
  misc_feature: Up-regulated in root tissues in response to salicylic acid treatment
  misc_feature: Up-regulated in shoot tissues in response to salicylic acid treatment
  misc_feature (128)..(179): SWISSPROT Homolog: EC 6.3.2.19 Ubiquitin--protein ligase
  misc_feature (129)..(170): Pfam ID: zf-C3HC4 Pfam Description: Zinc finger, C3HC4 type (RING finger)
MGQGSDEGADGAGHSAWPSGGDADTPVAPTAGAAAAMTLGSILTVAGILLLFVIFAFGLASLQYCFQRSERRRRGPRTPAGGSTRGGGTMRTSTSGGVDPELLRSLPVTVYHLATRGADKERQDAVVECAVCLAELQDGEEARFLPRCGHGFHAECVDMWLVSHTTCPLCRLTVSKPDGVSPHPVSSLALPPVPPEPASYATASLPVSVLLGVSGHDVVTAVTTNPSTLVIEIPELAVPTPTLTPCDAAKSPGSARLRSIRRLWSFGRQGAGATSSSCSCAGAGASEGVDLEQGIS

SEQ ID NO: 20938 - DNA, 1944 bp, Sorghum bicolor
  misc_feature: Ceres ANNOT ID no. 8679719
  misc_feature: Up-regulated in shoot tissues in response to salicylic acid treatment
  misc_feature: Encodes the peptide sequence at SEQ ID NO 20939
atgcagcgcccgggacgacttcagcggtcggggtccaagcgtgggctggaccccaccggtagcggcgacgacgacgaccatgcgcccaagcgcccgcgcgtccccgccctggctagtgtcattgtggaagctctcaagatggacagtttgcagaagctctgttcatcgctcgagcccattctccgaagagtggtaagtgaagaagtagagcgtgctttagccaaactgggtcctgctattcaaggaagatcctcccccaaaagaattgaaggccctgatggaagaaatcttcagcttcagttcagaagtcagttggctcttccaatcttcactggtgggaaagttgaaggtgagcagggcgcagctatacatgtcgtgctgttggatgcaaacactggatgtgttgttacttcaggacctgagtcgtttgcaaaactggatatccttgtgcttgagggcgactttaataaagaggaagatgaggattggacagaagaagagtttgaaagtaatattgtcaaggagcgtgaagggaagaggcctcttttgacaggtgacctgcaagtgactcttaaagaaggtgttggaaccataggggagcttaccttcactgacaactccagctggataagaagcaggaaattcagacttgggctgaggattgctcctggcttttatgaaggcattcgtgtccgagaagccaagacagaagctttccccgttaaggatcacagaggagaattgtacaaaaagcactacccacctgcgctgaaggatgatgtttggagattagaaaagattggcaaggatggtgcattccacaagaagttaaatgctagtgggatctatacagttgaagattttctccggcttcttgttagggatcagcagagattacgtactattctgggcagtggaatgtcaaataagatgtgggacagccttgttgagcatgcaaagacatgtgtcttaagtggaaagcattatgtatactatgctagagactcgagaaacgtgggtgcaatattcaataacatctatgagttcactggtttgagtgccgatgatcagttcatttcagctgaaaatctcacagacaatcagaaggtctatgctgatgcattggtaaagaaagcatatgaggactggatgcaagttgtagaatatgatggcaaggcactcctgagtttcaagcagaaaaagaaatctgtcacaacacgaagcgatgctgcagctgcctcaacaagcaatcctgcttcatatggttcgaccaattcacagaaacaaatgtcccttccagcaaaagctggactaacttcctcggcgggtactatgaatgaagatggaactagaaatgcatacaatgcaaatggaaaccagtcagcaagatatgcagccaacacgaacattcctgcaaacatcaccatgcaatatgacaggagtgcagtgtctcctgaaagccagtttagtggttcatcccttcagagtcaagcttcaagagggtccaatatgctagcactgggcccttcgcagcaacatcaaagttttgaattcccagcacttggccagtccttgcagccaacaggcctgaatccttttgaagaatggccacagcaacaggagaactgtggtggtattgatgactacctgacggaggagatcaggatgaggagccatgagattctggaaaacgaagaaatgcagcaaatgttgcggcttctgagcatgggtggtgcaggaaccaacctaactgaagatgccttcaatttcccctcatacatgcctgcaccttcaccaaacttgagctatgaggatgaccgcacccgtgcacctgggaaagctgttgtcgggtggctcaagatcaaggctgctatgcggtggggcatctttgtcaggaagaaggcagctgagagaagagctcagcttgttgagcttgacgactag

SEQ ID NO: 20939 - protein, 647 aa, Sorghum bicolor
  misc_feature: Ceres ANNOT ID no. 8679719
  misc_feature: Up-regulated in shoot tissues in response to salicylic acid treatment
  misc_feature (95)..(398): Pfam ID: Calmodulin_bind Pfam Description: Calmodulin binding protein-like
MQRPGRLQRSGSKRGLDPTGSGDDDDHAPKRPRVPALASVIVEALKMDSLQKLCSSLEPILRRVVSEEVERALAKLGPAIQGRSSPKRIEGPDGRNLQLQFRSQLALPIFTGGKVEGEQGAAIHVVLLDANTGCVVTSGPESFAKLDILVLEGDFNKEEDEDWTEEEFESNIVKEREGKRPLLTGDLQVTLKEGVGTIGELTFTDNSSWIRSRKFRLGLRIAPGFYEGIRVREAKTEAFPVKDHRGELYKKHYPPALKDDVWRLEKIGKDGAFHKKLNASGIYTVEDFLRLLVRDQQRLRTILGSGMSNKMWDSLVEHAKTCVLSGKHYVYYARDSRNVGAIFNNIYEFTGLSADDQFISAENLTDNQKVYADALVKKAYEDWMQVVEYDGKALLSFKQKKKSVTTRSDAAAASTSNPASYGSTNSQKQMSLPAKAGLTSSAGTMNEDGTRNAYNANGNQSARYAANTNIPANITMQYDRSAVSPESQFSGSSLQSQASRGSNMLALGPSQQHQSFEFPALGQSLQPTGLNPFEEWPQQQENCGGIDDYLTEEIRMRSHEILENEEMQQMLRLLSMGGAGTNLTEDAFNFPSYMPAPSPNLSYEDDRTRAPGKAVVGWLKIKAAMRWGIFVRKKAAERRAQLVELDD

SEQ ID NO: 20940 - DNA, 1953 bp, Sorghum bicolor
  misc_feature: Ceres ANNOT ID no. 8679718
  misc_feature: Up-regulated in shoot tissues in response to salicylic acid treatment
  misc_feature: Encodes the peptide sequence at SEQ ID NO 20941
atgcagcgcccgggacgacttcagcggtcggggtccaagcgcgggctggaccccaccggtggcggcgacgacgacgagcatgcgcccaagcgcccgcgcgtccccgccctcgctagtgtcattgtggaagctctcaagatggacagtttgcagaagctctgttcatcgctcgagcccattctccgaagagtggtaagtgaagaagtagagcgtgctttagccaaactgggtcctgctagaattcaaggaagatcctcccccaagagaattgaaggccctgatggaagaaatcttcagcttcagttcagaagtcagttggctcttccaatcttcactggtgggaaagttgaaggtgagcagggagcagctatacatgtcgtgctgttggatgcaaacactggatgtgttgttacttcaggacctgagtcgtttgcaaaactggatatccttgtgcttgagggcgactttaataaagaggaagatgaggattggacagaagaagagtttgaaagtaatattgtcaaggagcgtgaagggaagaggcctcttttgacaggtgacctgcaagtgactcttaaagaaggtgttggaaccataggggagcttaccttcactgacaactccagctggataagaagcaggaaattcagacttgggctgaggattgctcctggcttttgtgaaggcgttcgtgtccgagaagccaagacagaagctttccccgttaaggatcacagaggagaattgtacaaaaagcactacccacctgcgctgaaggatgatgtttggagattagaaaagattggcaaggatggtgcattccacaagaagttaaatgctaatgggatctatacagttgaagacttcctccggcttcttgttagggatcagcagagattacgtagtattctgggcagtggaatgtcaaataagatgtgggacagccttgttgagcatgcaaagacatgtgtcttaagtggaaagcattatgtatactatgctagagactcgagaaacgtgggtgcaatattcaataacatctatgagttcactggtttgatcgccgatgatcagttcatttcagctgaaaatctcacagacaatcagaaggtctatgctgatgcattggtaaagaaagcatatgaggactggatgcaagttgtagaatatgatggcaaggcactcctgagcttcaagcagaaaaagaaatctgtcacaacaagaagcgatgctgcagctgcctcaacaagcaatcctgcttcatatggttcgaccaattcacagaaacaaatgtcccttccagcaaaagctggacaaacttcctctgtgggtactatgaatgaagcagatggaactagaaatgcatacaatgcaaatggaaaccagtcagcaagatatgcagccaacacacagaacattcctgcaaacatcaccatgcaatatgacaggagtgcagtgtctcctgaaagccagtttagtggttcatcccttcagagtcaagcttcaagagggtccaatatgctagcactgggcccttcgcagcaacatcaaagttttgaattcccagcacttggccagtctttgcagccaacaggcctgaatccttttgaagaatggccacagcaacaggagaaccgtggcggtgttgatgactacctgatggaggagatcaggatgaggagccatgagattctggaaaacgaagaaatgcagcaaatgttgcggcttctgagcatgggtggtgcaggaaccaacctaactgaagatgccttcaatttcccctcatacatgcctgcaccttcaccaaacttgagctatgaggatgaccgcacccgcgcacctgggaaagccgttgtcgggtggctcaagatcaaggctgctatgcggtggggcatctttgtcaggaagaaggcagctgagagaagagctcagcttgttgagctagacgactag

SEQ ID NO: 20941 - protein, 650 aa, Sorghum bicolor
  misc_feature: Ceres ANNOT ID no. 8679718
  misc_feature: Up-regulated in shoot tissues in response to salicylic acid treatment
  misc_feature (96)..(399): Pfam ID: Calmodulin_bind Pfam Description: Calmodulin binding protein-like
MQRPGRLQRSGSKRGLDPTGGGDDDEHAPKRPRVPALASVIVEALKMDSLQKLCSSLEPILRRVVSEEVERALAKLGPARIQGRSSPKRIEGPDGRNLQLQFRSQLALPIFTGGKVEGEQGAAIHVVLLDANTGCVVTSGPESFAKLDILVLEGDFNKEEDEDWTEEEFESNIVKEREGKRPLLTGDLQVTLKEGVGTIGELTFTDNSSWIRSRKFRLGLRIAPGFCEGVRVREAKTEAFPVKDHRGELYKKHYPPALKDDVWRLEKIGKDGAFHKKLNANGIYTVEDFLRLLVRDQQRLRSILGSGMSNKMWDSLVEHAKTCVLSGKHYVYYARDSRNVGAIFNNIYEFTGLIADDQFISAENLTDNQKVYADALVKKAYEDWMQVVEYDGKALLSFKQKKKSVTTRSDAAAASTSNPASYGSTNSQKQMSLPAKAGQTSSVGTMNEADGTRNAYNANGNQSARYAANTQNIPANITMQYDRSAVSPESQFSGSSLQSQASRGSNMLALGPSQQHQSFEFPALGQSLQPTGLNPFEEWPQQQENRGGVDDYLMEEIRMRSHEILENEEMQQMLRLLSMGGAGTNLTEDAFNFPSYMPAPSPNLSYEDDRTRAPGKAVVGWLKIKAAMRWGIFVRKKAAERRAQLVELDD

SEQ ID NO: 20942 - DNA, 657 bp, Sorghum bicolor
  misc_feature: Ceres ANNOT ID no. 8679784
  misc_feature: Up-regulated in root tissues in response to salicylic acid treatment
  misc_feature: Up-regulated in shoot tissues in response to salicylic acid treatment
  misc_feature: Encodes the peptide sequence at SEQ ID NO 20943
atggcggtgacaaagatctacgtcgtgtactactcgacgtacggccacgtggcgaggctggcggaggagatcaagaagggcgccgactccgtcgacggcgtcgaggcaaccatctggcaggtggcggagacgacgctgccggaggagtcgtcgtcgctggcgaagatgcgcgcgccagtcaagaccaagagcgacaacaagcacccagtgatctcgggcaagcagctggccgacgccgacggcgtcctgttcggcttcccgtcgcggctcggcatgatggcggcgcagatgaaggcgctgttcgactccaccacgggcgggctctggcggacgcaggcgctcgcgggcaagcccgcggggttcctcttctcgctgcgcacccagggcggcgggcaggaggaggcggcgctcacggccgtgtcgcagctcgcgcaccacgccatggtgttcgtgcccgtcgggtccacgttcggcgacggcatgttcgacatggacgaggtcaggtgctgcagcccctacggggccggcacgttcgccggcgccgacggcaggagcaggctgcccagcgacgccgagctccagatggccgtgcaccagggcacctactttgccgcattcgccaagaagctcaaggccggagcggccgtcgtcgcctga

SEQ ID NO: 20943 - protein, 218 aa, Sorghum bicolor
  misc_feature: Ceres ANNOT ID no. 8679784
  misc_feature: Up-regulated in root tissues in response to salicylic acid treatment
  misc_feature: Up-regulated in shoot tissues in response to salicylic acid treatment
  misc_feature (8)..(147): Pfam ID: Flavodoxin_1 Pfam Description: Flavodoxin
MAVTKIYVVYYSTYGHVARLAEEIKKGADSVDGVEATIWQVAETTLPEESSSLAKMRAPVKTKSDNKHPVISGKQLADADGVLFGFPSRLGMMAAQMKALFDSTTGGLWRTQALAGKPAGFLFSLRTQGGGQEEAALTAVSQLAHHAMVFVPVGSTFGDGMFDMDEVRCCSPYGAGTFAGADGRSRLPSDAELQMAVHQGTYFAAFAKKLKAGAAVVA

SEQ ID NO: 20944 - DNA, 1344 bp, Sorghum bicolor
  misc_feature: Ceres ANNOT ID no. 8679832
  misc_feature: Down-regulated in shoot tissues in response to salicylic acid treatment
  misc_feature: Encodes the peptide sequence at SEQ ID NO 20945
atgccagcacgctgctgggaatctccaacttgtggctcgtgttgctcggcgtccgccgtctgcagctggaaaaaggagacacgcacgcttgccgggcgtctactagcttctgggagggcgtcacgtgttctcaaaatgcagtcatctgtgatggcgttcttccctagtgttgccacagcaaaactggagctgaattctctgtacaggaaatatgtggacatgtttggtatatcgttaaacaactctaccgttggctgccatctcacccgcaaaatggcgcaccttcctgttctgttgatcgatcgtacatttttcagtactggttctgctattcagagtattgccaccagctacggagctcttattcgtaggtggttactgaacagaacttctgttgtacagcacacgctgatttccagtgctatgaactcactgtcttggtgtggctccttgccattctttgtcagcattggtgttctaatcaccaagctctgtgactgcactatgaccccgaaccgtttttgtggtcggcaatgcatccttagtcatagtgctaacctccgtggagaatcagttttggtcatggacaataatgaactgggcaatgatcagagcttcttatcaagtttccttgggcgcaagcgagattatgtcgtcctagcgcttcagtgcatctgttaccctgcttgtctgaaggttgttgatgtcccccacaagaagctcagcttcagcaggcagtggatacggactggccatgacacaagtgcaatttggaggatcatggcaaggaatgaacaatacttggcatgcatgatagtcctggcagccttgcaagttttcctgcggctaaccagagtgaatgttaccattctgttcttgccaatgctgtcccgagccataagttccaggagcagcccagcagtgatcggtaacatcgtgctggttttggtgaactcctgtggagttcttggatctgcactttcagtgaaacagcttggcagggaggtgacgttcgccatcagtgccatcgtgatggtaatttgccaggtcgcaattccattgatcctagaagttcagatcggagttggtggtggaactcgcatgccgatgggttacacaacagcgatgttcgtcctgacttgtgttgtctcctgcggcctcagctggtcatggggttcattcttctggaccttccctggtaggaaggttcactcggctggacaggttctggccatggctgtgaacctgggcgtctgcttcgcccagatgcagtacttcctgctggtgctatgcaggctgaagaacgccactcttgcctactatgcactgtggatctggtcatga

SEQ ID NO: 20945 - protein, 447 aa, Sorghum bicolor
  misc_feature: Ceres ANNOT ID no. 8679832
  misc_feature: Down-regulated in shoot tissues in response to salicylic acid treatment
MPARCWESPTCGSCCSASAVCSWKKETRTLAGRLLASGRASRVLKMQSSVMAFFPSVATAKLELNSLYRKYVDMFGISLNNSTVGCHLTRKMAHLPVLLIDRTFFSTGSAIQSIATSYGALIRRWLLNRTSVVQHTLISSAMNSLSWCGSLPFFVSIGVLITKLCDCTMTPNRFCGRQCILSHSANLRGESVLVMDNNELGNDQSFLSSFLGRKRDYVVLALQCICYPACLKVVDVPHKKLSFSRQWIRTGHDTSAIWRIMARNEQYLACMIVLAALQVFLRLTRVNVTILFLPMLSRAISSRSSPAVIGNIVLVLVNSCGVLGSALSVKQLGREVTFAISAIVMVICQVAIPLILEVQIGVGGGTRMPMGYTTAMFVLTCVVSCGLSWSWGSFFWTFPGRKVHSAGQVLAMAVNLGVCFAQMQYFLLVLCRLKNATLAYYALWIWS

SEQ ID NO: 20946 - DNA, 3312 bp, Sorghum bicolor
  misc_feature: Ceres ANNOT ID no. 8679959
  misc_feature: Up-regulated in shoot tissues in response to aminocyclopropane carboxylic treatment
  misc_feature: Up-regulated in shoot tissues in response to salicylic acid treatment
  misc_feature: Encodes the peptide sequence at SEQ ID NO 20947
atgttggaaaagattgggttgccgccgaagccgtccatgcgaggcgctacctgggtggtggatgcatcccactgtcagggttgttctgttcagttctccttgtttactaggaagcaccattgccaaagatgtgggggattgttctgcagcagctgcacccagcagaggatggttttacgtggacagggtgattcacctgttagaatttgtgatccttgcaaaaagcttgaggaagcagcacgccatgagttgagatatgggcacaaaaatagagctacaagagctaccaaatctggttcgaaaccagaggatgatattctaagtgaaattcttggaggtggagagcatatccaatctctggattctgagcttcctgggagaaccacaagcaatgccagtacctccagaagaacttcttctaatttcagtgcagactcaaatggagatgaaagcctttctgccgaagcacacaattatgaactcaacaatactgcatctatttttaccccagaggagttgcgccaacaagctgtagaagagaagaaaaggtacaaaactttaaaatcagaaggtaaaccagaggaagcactgcgggcgttcaagcatggtaaagaacttgagaggcaagctgcagcgctggaattagagttgagaaggagtaggagaatggctacaaaagcacctaatgtctctgctgctgttggtacttcgactactgctggttctgatgaggccgaaacaaaaaggtcttcaactgggaaaaggattaagaaagaaaagaatgatcttgcatctgagctccgagatctaggctggtcagatgcagaccttcgtgatgaaacaaaggctgcccctatgagtctggaaggagagttgtcacagcttcttagagaggtggcccccaaaccattggagggcaagagaacaggtggtgttgataaatctcaggttaatgctctgaagaggcaagctttactgctaaagcgggaaggtaggcttgctgaagcaaaggaagagctcaagaaggctaaaattttggaaaaacaacttgaggaacaggagattctgggtgaagcagaagactcagatgatgatttggctgctattattcggaacatggacggcgataagaatgatgacatatttgttgatgatccaaaattccctgctttcaactttgaacaaattctgggtgcctctaatgatcttgccactgatggtcactttgatgttacagatgatgacatgaatgacccagatatggctgctgccctaaaatcatttggctggagtgaggaggacgacaaacaattggaaaatcacgaacctgtttcttcaaatcaagaggtactaaaggagcaggtacttgctctaaaaagagaggctgttgcaaacagaaggtctggcaatgttgcagaagccatgttgttgcttaaaaaggcaaagctacttgaaaaggatcttgaaattgaagagccagtctcaaaggttccttctccagaaggacagaaaactacaaatgtagaagatgccacttttgcagggatgaatgcccggtctatatcagcgccaaaaagtaagcttgcaattcagagagaactgttggctctgaagaagaaggcactagctttgaggagggaagggaaggtggatgagtctgaggaagagctgaaaaaaggtagtgttcttggaaagcagcttgaagagcttgagaattcctccaaaccacctgtaccaaaggaaaccaggagcttgccatctaatcccccgtacaaggttgaacccccaaatatcagtcttgctgatgaggtatatgaacctgaggttacagacaatgatatgcaggatccagcattgctatcggtgctaaaaaatatgggatgggaagatgctggttcagattcggtggaaacaactgacaaaccatcaatttcttcacatgtagttcctcataaatcatcaaaaactaagggccagcttcagaaggaattgcttggtataaaaaggaaggctcttgcactcagacgggaagggaaaaccactgaagctgaggatgagctggagaaggctaaggtcttggagcagcaacttgcagagatcgaagaatcaaataacttgagtgctagtcaaggtgttactactgctggccatcaaattacagaaaataagtatgatgttcagcatgttcctggtgttgatgcaactgtacacccatcttcagtaagaaacgcaatgaagggggacgaaatattgccagtgcatgcatctgaatctggtacgtcagaggttactctatctggttcttcaatcaaacctggttcttcaatcaaaccgcagactgatacaaccaattctaaacaaggtgatgtgggagaagaaagtagagctggaaggtctctagccttgtcgcagccagcttttactgatcccttgggatctgaaaaagggtcacattcaccttctttagtacatgatcattatgagcatcagaaaacacaaggagatgatactcttaaagatgatatattgcttcataagagaaaagcagttgcctttaagagagaagggaagatggcagaagctagagaagaattgaaactggcaaaactcttagaaaaacgccttcaaggtgctcaacaagacagcatggatggtgtgggtgactccattactcctgctgtggaacagaacattgtggtccaacaacctgctagctccagcaatcacactgacgacgtaacttctgcccctcctgcacaagtgagcaagtcgacgcaacctcagaaagcaatgtccagccgagatcgtctcaaaatccagcgcgaatctctcgctcacaagcgcaacgccctcaagttgaggagagaaggaaagactgcagaagcagatgcagaattcgaactggccaaggagctagagagccaacttgaagagccagacaaccaaagttcaagctctgggggcaagtcaagtgaaccaaacgatgcgatagtcgagaatcttcttgatcctcagatcatgtctgccctaagatccattggttggagcgacatggatttatccatgcaatcttctagtgcacaacctcagaaacccatgcagccctcaacttctcaacctcctcaaaaagtggaagcgaagtcatctgtcacagggaccagcaaacctcagagcgagagaagtcaacttgaagaacagatcaaggtggagaaactgaaagcgcttaacttgaagcgggaagggaaacaagcagaggccctggaggcccttcgctcggcaaagcgactggagaagaagttgaactcaacttag

SEQ ID NO: 20947 - protein, 1103 aa, Sorghum bicolor
  misc_feature: Ceres ANNOT ID no. 8679959
  misc_feature: Up-regulated in shoot tissues in response to aminocyclopropane carboxylic treatment
  misc_feature: Up-regulated in shoot tissues in response to salicylic acid treatment
  misc_feature (18)..(73): SWISSPROT Homolog: EC 3.1.3.48 Protein-tyrosine-phosphatase
  misc_feature (16)..(79): Pfam ID: FYVE Pfam Description: FYVE zinc finger
MLEKIGLPPKPSMRGATWVVDASHCQGCSVQFSLFTRKHHCQRCGGLFCSSCTQQRMVLRGQGDSPVRICDPCKKLEEAARHELRYGHKNRATRATKSGSKPEDDILSEILGGGEHIQSLDSELPGRTTSNASTSRRTSSNFSADSNGDESLSAEAHNYELNNTASIFTPEELRQQAVEEKKRYKTLKSEGKPEEALRAFKHGKELERQAAALELELRRSRRMATKAPNVSAAVGTSTTAGSDEAETKRSSTGKRIKKEKNDLASELRDLGWSDADLRDETKAAPMSLEGELSQLLREVAPKPLEGKRTGGVDKSQVNALKRQALLLKREGRLAEAKEELKKAKILEKQLEEQEILGEAEDSDDDLAAIIRNMDGDKNDDIFVDDPKFPAFNFEQILGASNDLATDGHFDVTDDDMNDPDMAAALKSFGWSEEDDKQLENHEPVSSNQEVLKEQVLALKREAVANRRSGNVAEAMLLLKKAKLLEKDLEIEEPVSKVPSPEGQKTTNVEDATFAGMNARSISAPKSKLAIQRELLALKKKALALRREGKVDESEEELKKGSVLGKQLEELENSSKPPVPKETRSLPSNPPYKVEPPNISLADEVYEPEVTDNDMQDPALLSVLKNMGWEDAGSDSVETTDKPSISSHVVPHKSSKTKGQLQKELLGIKRKALALRREGKTTEAEDELEKAKVLEQQLAEIEESNNLSASQGVTTAGHQITENKYDVQHVPGVDATVHPSSVRNAMKGDEILPVHASESGTSEVTLSGSSIKPGSSIKPQTDTTNSKQGDVGEESRAGRSLALSQPAFTDPLGSEKGSHSPSLVHDHYEHQKTQGDDTLKDDILLHKRKAVAFKREGKMAEAREELKLAKLLEKRLQGAQQDSMDGVGDSITPAVEQNIVVQQPASSSNHTDDVTSAPPAQVSKSTQPQKAMSSRDRLKIQRESLAHKRNALKLRREGKTAEADAEFELAKELESQLEEPDNQSSSSGGKSSEPNDAIVENLLDPQIMSALRSIGWSDMDLSMQSSSAQPQKPMQPSTSQPPQKVEAKSSVTGTSKPQSERSQLEEQIKVEKLKALNLKREGKQAEALEALRSAKRLEKKLNST

SEQ ID NO: 20948 - DNA, 972 bp, Sorghum bicolor
  misc_feature: Ceres ANNOT ID no. 8679987
  misc_feature: Down-regulated in shoot tissues in response to salicylic acid treatment
  misc_feature: Encodes the peptide sequence at SEQ ID NO 20949
atggcgaagaagcggaagcgcaccgacgccccggcagaggcggccggcgcagagaagcccgacgactccgcgtcggcgcgcccggagcgcacgctcttcggcttcaaggacccggcctccgacgccgagcccgccgcctccgcgggcgacggggccgcggtggcgccgttccgcaacagggagaaggtgctcatcacctgctcccgccgcatcacgtacaggtatcggcatctgatgcaggacgtgctgtcgctgctcccgcacgcgaagaaggacagcaaggtcgagtcgaagcagagcaagggcagcgcgctgaacgagctgctcgagctcaggagctgctccagctgcctcttcttcgagtgcagaaaacagaaggatctttacctttggatggtcaagtctcctggaggaccatcagtgaaatttctagttaatgctgttcacaccatggaggagttgaagcttactggtaaccatctgaaagggtcaaggccacttcttacattttctacaaattttgatgagcaacctcattggaagcttgtgaaggaaatgataactcagatatttgctactcctaaagatcaccgtaaagcaaaacctttccatgatcatgtatttgccttctcaattgtggatggccatgtttggtttcgaaactatcagatttcggttccccacaatgagattgataaagttgataaaggtggtctggataaaatgacacttattgaggttggccccaggttctgtttgaatccaatcaaaatatttggtggtagttttggtggtcctacatggtatgagaacccatactacatttcccccaatcagatccgtgcactagagaagaggcagaaggcaggcaaatatgccaagaaggtgaaggccaaggtgaggaggaagatgcacgagatggagaacacgctggagcctgatgaatttgctgagctctggaaaggggagtaa

SEQ ID NO: 20949 - protein, 323 aa, Sorghum bicolor
  misc_feature: Ceres ANNOT ID no. 8679987
  misc_feature: Down-regulated in shoot tissues in response to salicylic acid treatment
  misc_feature (64)..(258): Pfam ID: Brix Pfam Description: Brix domain
MAKKRKRTDAPAEAAGAEKPDDSASARPERTLFGFKDPASDAEPAASAGDGAAVAPFRNREKVLITCSRRITYRYRHLMQDVLSLLPHAKKDSKVESKQSKGSALNELLELRSCSSCLFFECRKQKDLYLWMVKSPGGPSVKFLVNAVHTMEELKLTGNHLKGSRPLLTFSTNFDEQPHWKLVKEMITQIFATPKDHRKAKPFHDHVFAFSIVDGHVWFRNYQISVPHNEIDKVDKGGLDKMTLIEVGPRFCLNPIKIFGGSFGGPTWYENPYYISPNQIRALEKRQKAGKYAKKVKAKVRRKMHEMENTLEPDEFAELWKGE

SEQ ID NO: 20950 - DNA, 1302 bp, Sorghum bicolor
  misc_feature: Ceres ANNOT ID no. 8680080
  misc_feature: Up-regulated in shoot tissues in response to salicylic acid treatment
  misc_feature: Encodes the peptide sequence at SEQ ID NO 20951
atggacgccttgtcccgccccgctgtcgtcatcgacaacggcaccgggtacacgaagatggggttcgcggggaacgtggagccctgcttcatcacccccaccgtcgtcgccgtcaatgattccttctcctcctccggccagcccgcggcgaggggcgcccccgccagggggaactggctcgctcagcacagcgccggcgtcatggctgacctcgacttctacatcggcgaggaggcgctggcccgatcccgcgccagcacctcgcacagcttgagctatcccatccgcaacggccaggtggagaattgggatactatggagaggttctggcaacagtgcatcttcaattacctccggtgcgacccagaagatcattattttcttctaactgagagccctctgactgcccctgagacccgggagtatactggggagatcatgttcgagacgttcaatgtgcccggcctctatattgctgtccaacctgtccttgcgctcgctgctgggtacactaccaccaagtgtgaaatgacaggtgttgtagttgatgtgggtgatggggctacacacattgttccagttgctgatggatatgtcattgggagcagcatcagatctattccaattacaggcaaggatgttacccagtttgttcatcaacttctaaaggaaagaggtgagaacattccaccagaagaatcttttgatgtagcaaggaggattaaagaaatgtactgctatacttcttcagacattgtgaaggaatttaataaacatgacagggagccatcaaagtacgttaaacactggacgggcatcaaaccaaaaactggtgcgaaatacacatgtgacattggatatgaacgattcctggggcctgagatcttcttcaacccagagatatataacaatgacttcaccactcctttgcaagttgttattgacaagtgcatccaatcatccccaatcgacacaaggagggctctttataagaatattgtcttgtctggaggctcaactatgtttaaagatttccataggaggttacagcgggacctaaaaaagatagtggacgcacgagtccgtgcatctaatagtcggcttattagtggagatactaaggcccagcctatagaagtgaacgtggtcagtcatcctattcagagatatgcggtatggtttggcggctctgtgcttgcttcaactgccgaattctacgaggcttgtcacacaaaagcagagtacgaagagtacggtgcgagcatctgccgatcgaaccctgtgttcaaagggatgtactga

SEQ ID NO: 20951 - protein, 433 aa, Sorghum bicolor
  misc_feature: Ceres ANNOT ID no. 8680080
  misc_feature: Up-regulated in shoot tissues in response to salicylic acid treatment
  misc_feature (68)..(168): SWISSPROT Homolog: EC 2.7.10.2 Non-specific protein-tyrosine kinase
  misc_feature (3)..(428): Pfam ID: Actin Pfam Description: Actin
MDALSRPAVVIDNGTGYTKMGFAGNVEPCFITPTVVAVNDSFSSSGQPAARGAPARGNWLAQHSAGVMADLDFYIGEEALARSRASTSHSLSYPIRNGQVENWDTMERFWQQCIFNYLRCDPEDHYFLLTESPLTAPETREYTGEIMFETFNVPGLYIAVQPVLALAAGYTTTKCEMTGVVVDVGDGATHIVPVADGYVIGSSIRSIPITGKDVTQFVHQLLKERGENIPPEESFDVARRIKEMYCYTSSDIVKEFNKHDREPSKYVKHWTGIKPKTGAKYTCDIGYERFLGPEIFFNPEIYNNDFTTPLQVVIDKCIQSSPIDTRRALYKNIVLSGGSTMFKDFHRRLQRDLKKIVDARVRASNSRLISGDTKAQPIEVNVVSHPIQRYAVWFGGSVLASTAEFYEACHTKAEYEEYGASICRSNPVFKGMY

SEQ ID NO: 20952 - DNA, 1740 bp, Sorghum bicolor
  misc_feature: Ceres ANNOT ID no. 8680075
  misc_feature: Up-regulated in root tissues in response to methyl jasmonate treatment
  misc_feature: Up-regulated in shoot tissues in response to methyl jasmonate treatment
  misc_feature: Encodes the peptide sequence at SEQ ID NO 20953
atggcgctgcgcttcctccacgagtacgtgcgggcgtcggacctggccgtggccgccgcggtgctcttcgtctgcagcgcggtgaggagccggctgtcgtcccgtcctggcgagcccatgctgtggccggtggtgggcatcatcccgacgctgtccgcgcacatcgcgctcggcgacgtctacgactggggcgcggcgacgctgtcccggtgccgcggcacgttcccgtaccgcggcacctggggcgggggctcctcgggcgtcatcacctccgtgccggccaacgtggagcacgtcctcaaggccaacttcgacaactaccccaaggggccctactaccgtgagcggttcgcggagctgctcggcggcggcatcttcaacgccgacggcgactcgtggcgcgcgcagcggaaggcggccagcgccgagatgcactcggcgcggttcctccagttctcgtcggcgaccatccagcgcctggtgcgcggccgcctggtcccgctgctggagacgctgagcgagcaggagaggcatgcggtggacctgcaggacgtgctgctccgcttcgcgttcgacaacatctgcgccgccgcgttcggggtggaggccgggtgcctcgccgacgggctccccgacgtgccgttcgcgcgcgcgttcgagcgcgccacggagctctccctcaccaggttctacacgccgcctttagtctggaagcccaagcggctcctcggcgtcggcaccgagcgcgcgctcgtggacgccacccgcgccgtgcgggagttcgccgaccggaccgtcgccgaccgccgcgccgagctgcgcaaggtcggggacctggccggccgctgcgacctcctctcgcggctcatgtcgtcgtcgccgccgccgcaccctcccgccgacgccgcggcgggctactccgacgagttcctgcgcgacttctgcatcagcttcatcctcgcgggccgcgacaccagctccgtcgcgctcacctggttcttctggctcctcgcctcccgcccggacgtggaggcccgcgtcctggacgacatcgcccgcgccggcggcgacgtcggggccatggactacctccacgcggcgctgaccgagtccatgcgcctgtacccgccggtgcccgtggacttcaaggaggccctggaggacgacgtgctcccggacggcacgccggtgcgcgcgcggcagcgggtgatctacttcacgtacgccatggggcgggacaaggccacctggggccccgactgcctggagttccgcccggagcggtggctcaacgacaagagcggcgccttcgcgggcggcgccgagagcccctacaagtacgtggtgttcaacgcggggccccggctgtgcgtcggcaagcgcttcgcctacacgcagatgaagacggtggcggcggcggtgctggcgcggttccgcgtcgaggtggtgccggggcaggaggtgaagcccaagctcaacaccacgctctacgtgaagaacgggctcatggtgcgcttcgtcgccagggagcagcggcacgagctccgccaccctgtgcctgctgcagctcatcttgcaggcgtcgccagcgtcggcgtacgtgtggatagtgacaacactgtgctcccagtccctgtatctgtcacgcgatgcaacaacgacctgcaagtgctcatggatgatgcatcaagcagggttggttgcggacgtggcgatttatatgtaatcgcagtggaataa

SEQ ID NO: 20953 - protein, 579 aa, Sorghum bicolor
  misc_feature: Ceres ANNOT ID no. 8680075
  misc_feature: Up-regulated in root tissues in response to methyl jasmonate treatment
  misc_feature: Up-regulated in shoot tissues in response to methyl jasmonate treatment
  misc_feature (249)..(496): SWISSPROT Homolog: EC 1.14.13.98 Cholesterol 24-hydroxylase
  misc_feature (36)..(506): Pfam ID: p450 Pfam Description: Cytochrome P450
MALRFLHEYVRASDLAVAAAVLFVCSAVRSRLSSRPGEPMLWPVVGIIPTLSAHIALGDVYDWGAATLSRCRGTFPYRGTWGGGSSGVITSVPANVEHVLKANFDNYPKGPYYRERFAELLGGGIFNADGDSWRAQRKAASAEMHSARFLQFSSATIQRLVRGRLVPLLETLSEQERHAVDLQDVLLRFAFDNICAAAFGVEAGCLADGLPDVPFARAFERATELSLTRFYTPPLVWKPKRLLGVGTERALVDATRAVREFADRTVADRRAELRKVGDLAGRCDLLSRLMSSSPPPHPPADAAAGYSDEFLRDFCISFILAGRDTSSVALTWFFWLLASRPDVEARVLDDIARAGGDVGAMDYLHAALTESMRLYPPVPVDFKEALEDDVLPDGTPVRARQRVIYFTYAMGRDKATWGPDCLEFRPERWLNDKSGAFAGGAESPYKYVVFNAGPRLCVGKRFAYTQMKTVAAAVLARFRVEVVPGQEVKPKLNTTLYVKNGLMVRFVAREQRHELRHPVPAAAHLAGVASVGVRVDSDNTVLPVPVSVTRCNNDLQVLMDDASSRVGCGRGDLYVIAVE

SEQ ID NO: 20954 - DNA, 1014 bp, Sorghum bicolor
  misc_feature: Ceres ANNOT ID no. 8680101
  misc_feature: Up-regulated in root tissues in response to methyl jasmonate treatment
  misc_feature: Up-regulated in shoot tissues in response to salicylic acid treatment
  misc_feature: Up-regulated in root tissues in response to salicylic acid treatment
  misc_feature: Encodes the peptide sequence at SEQ ID NO 20955
atggccaagatcaagatcgggatcaatgggttcggcaggatcggaaggctggtggccagggtggccctgcagagcgacgatgtcgagctcgtcgccgtgaacgaccctttcatcaccaccgattacatgacctacatgttcaagtatgacactgtgcacggacagtggaagcaccatgaggtcaaggtcaaggactccaagacccttctctttggtgagaaggaggttgctgtgtttggctccaggaaccctgaggagatcccgtggggctcggttggtgctgattatgttgttgagtctactggtgttttcactgatcaggagaaggctgcagctcacttgaagggtggtgccaagaaggttgtcatttctgctcctagcaaggatgcccccatgttcgttgttggtgtcaacgagaaggagtacaagtctgacattaacattgtctccaatgctagctgcacaaccaactgccttgctcctcttgctaaggtcatcaatgacaagtttggtattgttgagggtctgatgaccactgttcatgccatcactgctacccagaagactgttgatgggccctcggccaaggactggagaggtggaagggctgcaagtttcaacatcattcccagcagcaccggagctgctaaggctgttggcaaagtgcttcctgtccttaatggaaagttgactggaatggctttccgtgttccaaccgtcgatgtttctgttgttgatctcactgttaggcttgagaagtctgctacctatgatgagatcaaggctgcagtcaaggctgaggcagagggtagcctcaagggcattctgggttatgttgacgaggaccttgtttccaccgacttccagggtgacagcaggtcaagcatctttgatgctaaggctggcattgccttgaatggcaacttcgtgaagcttgtgtcctggtacgacaacgagtggggatacagcacccgcgtggttgacctgatccgccacatgagcagcaccaactag

SEQ ID NO: 20955 - protein, 337 aa, Sorghum bicolor
  misc_feature: Ceres ANNOT ID no. 8680101
  misc_feature: Up-regulated in root tissues in response to methyl jasmonate treatment
  misc_feature: Up-regulated in shoot tissues in response to salicylic acid treatment
  misc_feature: Up-regulated in root tissues in response to salicylic acid treatment
  misc_feature (1)..(336): SWISSPROT Homolog: EC 1.2.1.12 Glyceraldehyde-3-phosphate dehydrogenase (phosphorylating)
  misc_feature (159)..(316): Pfam ID: Gp_dh_C Pfam Description: Glyceraldehyde 3-phosphate dehydrogenase, C-terminal domain
  misc_feature (4)..(154): Pfam ID: Gp_dh_N Pfam Description: Glyceraldehyde 3-phosphate dehydrogenase, NAD binding domain
MAKIKIGINGFGRIGRLVARVALQSDDVELVAVNDPFITTDYMTYMFKYDTVHGQWKHHEVKVKDSKTLLFGEKEVAVFGSRNPEEIPWGSVGADYVVESTGVFTDQEKAAAHLKGGAKKVVISAPSKDAPMFVVGVNEKEYKSDINIVSNASCTTNCLAPLAKVINDKFGIVEGLMTTVHAITATQKTVDGPSAKDWRGGRAASFNIIPSSTGAAKAVGKVLPVLNGKLTGMAFRVPTVDVSVVDLTVRLEKSATYDEIKAAVKAEAEGSLKGILGYVDEDLVSTDFQGDSRSSIFDAKAGIALNGNFVKLVSWYDNEWGYSTRVVDLIRHMSSTN

SEQ ID NO: 20956 - DNA, 2130 bp, Sorghum bicolor
  misc_feature: Ceres ANNOT ID no. 8680105
  misc_feature: Up-regulated in shoot tissues in response to methyl jasmonate treatment
  misc_feature: Up-regulated in root tissues in response to methyl jasmonate treatment
  misc_feature: Encodes the peptide sequence at SEQ ID NO 20957
atggagcagacctgctgctacttcccgctgcggtgggagagcacgggcgaccagtggtggtacgcgtcgccgatagactgggcggcggccgacggccactacgacatcgtccgccagctgctgcacctcgaccccaacctgctcatcaagctcacctccctccgccggatccgccgcctcgaggcgctgtgggacgacgacgcccgcttcgccgacgccgccaggaaccgcgcgtccgtcgcgcggagcctgctgctggagtgcgagtgcaggaacccgaaccaccaccgcgccggaggggagaacacgctgctccgggccgggtacggcgggtgggtgctctacacggcagcgtccgccggggacgcggcgttcgtgcgggagctgctggagagggacccgctgctcgtgttcggcgagggcgagtacggcgtcacggacatgttctacgcggcggccaggggccggagcgccgacgtgttcaggctgctgctcgaccacgccatgtcgccgaggtgctcgacggattgccggaacggccaaggcggtgctgggcgtggctccatgttccggcttgagatgatgagccgggccgtccacgctgcggcgagaggcgggagcgtggagatgctcagagagctgctcgaggaggggccgtccagcgtatcgacgtatctcgacatccgtggatccaccgtgctgcatgcggccgctgggagaggccagctgcaggtcgtcaagtaccttctggcctctttcgacatcatcaatttgacagataatcacgggaacacagcactgcatgtagcagcctatcgagggcaccaacctgttgtggaagtgttggttgctgcatctccatcaaccttgtcagctgtcaacaatgctggtgacacatttctccattcggcagttacaggattcaggaccccaggattccgacggcttgaccgccaattggagctgatgagatacctcatacgcgaaagaactgcagatatccagaagatcatcaatctgagaaacgatgcaggccttacagccctccacctggctgtggttggctgcgcacacccagatctggttgagctattgatgactgccccgtcaatcgacctgaatgctgaagacgcgaacggcatgactgcgctggcattgctaaaacagcagctgcgttcagcaacatccgaccggctcatcaggcagatagtttctgccggaggggtcttgaattccagcattctgagaacccgatcagccattgcttctcagattaagatgcagggtgggattgcaagcagtcccggtaccactttcaaggtatcagatgcagagatattcttgttctcgggtatgggggcagtggagtctctaaggccaagctcgtgctccagcaatgggaaggatgaccctactcatgcagatgcagattgcgccgaaaaccatggatcatcagagaagaggctgagctctgcgagccgggccaaagaccgtctcaagatgatgctgaggtggcctcgccacaagacacccaagaaatcagaggacagcagcccgctggactcgatcaagaagctgagccaacacgaggctgagacccctgctccactaaggcagaaatttaccaagacaacggcgctcaacggcaagcggaccctagcggtgaagagctccaccccaagctcctcgtccaccaagaagaagctcaacacaaagctcatacatggcatcatggaggccatgccacagctggcgccggctaccgtgcggtccgggtcgccaacggacatgcttcggaggtcctccatatcatccacacctcagccgctggcgaagctgaaggacatctgcctcgacgacgagatctccatggtgacgccgtccgtcggcaagctgaaggacatcgtcctggacagtgacgacaccacggaggacccctcgtgctccaactcgtccatggacgacggttgtggcaccgggacagcggagagcgcggcccggaagcacgggtgcggcaacgggaggctgatcaacatctgctttggcgcacagggactgaccgtggaggactcggcgagcgggcagcagacgagcaagatgttcaagcagcagtgcctgagggtgtcctga

SEQ ID NO: 20957 - protein, 709 aa, Sorghum bicolor
  misc_feature: Ceres ANNOT ID no. 8680105
  misc_feature: Up-regulated in shoot tissues in response to methyl jasmonate treatment
  misc_feature: Up-regulated in root tissues in response to methyl jasmonate treatment
  misc_feature (106)..(304): SWISSPROT Homolog: EC 2.7.11.1 Non-specific serine/threonine protein kinase
  misc_feature (262)..(295): Pfam ID: Ank Pfam Description: Ankyrin repeat
MEQTCCYFPLRWESTGDQWWYASPIDWAAADGHYDIVRQLLHLDPNLLIKLTSLRRIRRLEALWDDDARFADAARNRASVARSLLLECECRNPNHHRAGGENTLLRAGYGGWVLYTAASAGDAAFVRELLERDPLLVFGEGEYGVTDMFYAAARGRSADVFRLLLDHAMSPRCSTDCRNGQGGAGRGSMFRLEMMSRAVHAAARGGSVEMLRELLEEGPSSVSTYLDIRGSTVLHAAAGRGQLQVVKYLLASFDIINLTDNHGNTALHVAAYRGHQPVVEVLVAASPSTLSAVNNAGDTFLHSAVTGFRTPGFRRLDRQLELMRYLIRERTADIQKIINLRNDAGLTALHLAVVGCAHPDLVELLMTAPSIDLNAEDANGMTALALLKQQLRSATSDRLIRQIVSAGGVLNSSILRTRSAIASQIKMQGGIASSPGTTFKVSDAEIFLFSGMGAVESLRPSSCSSNGKDDPTHADADCAENHGSSEKRLSSASRAKDRLKMMLRWPRHKTPKKSEDSSPLDSIKKLSQHEAETPAPLRQKFTKTTALNGKRTLAVKSSTPSSSSTKKKLNTKLIHGIMEAMPQLAPATVRSGSPTDMLRRSSISSTPQPLAKLKDICLDDEISMVTPSVGKLKDIVLDSDDTTEDPSCSNSSMDDGCGTGTAESAARKHGCGNGRLINICFGAQGLTVEDSASGQQTSKMFKQQCLRVS

SEQ ID NO: 20958 - DNA, 2760 bp, Sorghum bicolor
  misc_feature: Ceres ANNOT ID no. 8680254
  misc_feature: Down-regulated in shoot tissues in response to methyl jasmonate treatment
  misc_feature: Down-regulated in root tissues in response to methyl jasmonate treatment
  misc_feature: Down-regulated in shoot tissues in response to salicylic acid treatment
  misc_feature: Encodes the peptide sequence at SEQ ID NO 20959
atgtctgaagtaaagccagtaattgatcacgctcgtggagatggattatctgttcaaaagatcatgtcagaattgaagaacattaccaatcctgttgaggaaaaacttggtgctgatgacaattcttcaagcagaaaatctaatgcaacatcattaaaaatgttattagagaaggagatgtctaaagaagcggagtcaaagagaagacctccaagtgtcattgccagattaatgggtcttgaggaggacttacctactaaagaaccaattgttcaccataccgtaagtgacttgagtagagatttaaatgccacaaacaacaccttacagggaaaagaacggcatcaattcataatgttgaagacacaaaatgaccaatcctgttatgaaaaaattgaatacaatgatgtttatgaagtatctgaaggtcaatcaggaacaggctattttcatgatcgaacttcacagaaaggatggtgtttggagaacaagagtaagcaattcgacattgcacaagacaagatcatggaaccagaacactttggcattgaagagaaggtcctttgtacaaaggagttacctgaagctcttgtttttccatgttcaaatagagatttatttcttgaatttcctgaagaacataaccccacattctcaagacagtcgagtgggcttcacacaaaccgagcaccgcctcagacaaaacgcattacagtgctgagaccaattagatctgttgatattaatagcataagacggtacagagcagaaattggtaagcaaaatgtattgaacatgagaagattccatcagattcctagtccaaaggaagagataccttcccagcacagtcgaatagtacttttgaggcctaccccagggaagcctggcatatcaaaggcaaagctgacctccagggcaacttcatttcagttaactaaccgtaacagtctcaatggatcattagatggtaaccaggcatccataggatctgcaggactagttcatggtatcatgcagtgccgggaagatggatgtcaccaaagagatgattctttattatcttctgcatactcaaatggatatgggggagatgaaagctcattcagtgattcagaagttgattataccagtggttctgaaatcaactatattgaagatggtgatgccctcagtgactctgagggaggtagccctctgtcaaaacattcatggaattacataagaagatacgaaggtcaatgctcaagctcatcctttagcaagatctcccacttttctgagtcatcagtaatcacggaagccaaaaaacagctttcagagcgatggtcaatggttacctgcgatgagaacagccaagtgcaaccgtcgaggagaaaatgcacattgggtgagatgctctccattaaggaagcaaagaaagatgaggccaccactgggatgttttctgtttccagtaaacagtcatgtggcctggaaaatgaactgactacacgttctacaaatgtaactatttctagaaagaatgataacaatggggagagatcttctaggaagttgccaagatcaaaatctgttccagtgatttcatccacgtctgataacatggtggtgaatgtgcaagcttcaaatcctgagagcctcaaactgaaggtggctgttgtgtcaaataaaggaaaatcagctttcaagggaagagtttcagattttttcttgtctaatagtaaaaggccaagaaggaagatgtccacttatcatccatctgattgctttgctgagaggcttgaaggttgtgtttttcatagtagacaggattgcaatcatgaaatggatgccattgagaaagcaatgcattgtgaggacagatttgatagtttttcgacacgaatatcaactagcacatctgatagaacaacgtctggtgcatctgtatcattggaatgttcaagtggaaacctggataaacaaggagtaaataaaggcctaaatagtaaccgtgatcaacccagccctacctcagttctcgatgcaccatctgaagatagcagttgtaatgaacctgaagcacctggaataactacttccaagaatgctacatcaagatcttcaacaattgaaactgtcacccgtttcttatcatgggatgacaccacctcagagtcacagtcaccttgtaacccaaggctgagttctcgtctccctgatgtagatgatgatgagtcagaatgccatgtccttgtgcaaaatataatgtcatcagctggattaggcacttcgcaatcatgtatggttttcaccggttggcatttacctgatcaccctcttgacccggtactgtgcaacaaattatcagagctgcaggagaaaagttcatacagaaggcttctatttgactgtgtgaatgttgctctaattgagatcggtgagaacactttactgagtgcattcccatggagtaaaagacactccaggacatggagaggcacctcatctcctgatctgggtgtagaagtctggagtatcctgaaggactggatatatggggccaggatgtttgtggtgagcaagagagataatgctgggatcatattggatagaattgtgaagcaggaggtcgaagcaagagggtgggtgaaactgatgatggcgcaggtggttgacatcactgaggagctcgaggggggagtaatggaggagctggttgaagaagcggtgctggattttcacagtttgttttcaatgatgagatatcgattgtaa

SEQ ID NO: 20959 - protein, 919 aa, Sorghum bicolor
  misc_feature: Ceres ANNOT ID no. 8680254
  misc_feature: Down-regulated in shoot tissues in response to methyl jasmonate treatment
  misc_feature: Down-regulated in root tissues in response to methyl jasmonate treatment
  misc_feature: Down-regulated in shoot tissues in response to salicylic acid treatment
MSEVKPVIDHARGDGLSVQKIMSELKNITNPVEEKLGADDNSSSRKSNATSLKMLLEKEMSKEAESKRRPPSVIARLMGLEEDLPTKEPIVHHTVSDLSRDLNATNNTLQGKERHQFIMLKTQNDQSCYEKIEYNDVYEVSEGQSGTGYFHDRTSQKGWCLENKSKQFDIAQDKIMEPEHFGIEEKVLCTKELPEALVFPCSNRDLFLEFPEEHNPTFSRQSSGLHTNRAPPQTKRITVLRPIRSVDINSIRRYRAEIGKQNVLNMRRFHQIPSPKEEIPSQHSRIVLLRPTPGKPGISKAKLTSRATSFQLTNRNSLNGSLDGNQASIGSAGLVHGIMQCREDGCHQRDDSLLSSAYSNGYGGDESSFSDSEVDYTSGSEINYIEDGDALSDSEGGSPLSKHSWNYIRRYEGQCSSSSFSKISHFSESSVITEAKKQLSERWSMVTCDENSQVQPSRRKCTLGEMLSIKEAKKDEATTGMFSVSSKQSCGLENELTTRSTNVTISRKNDNNGERSSRKLPRSKSVPVISSTSDNMVVNVQASNPESLKLKVAVVSNKGKSAFKGRVSDFFLSNSKRPRRKMSTYHPSDCFAERLEGCVFHSRQDCNHEMDAIEKAMHCEDRFDSFSTRISTSTSDRTTSGASVSLECSSGNLDKQGVNKGLNSNRDQPSPTSVLDAPSEDSSCNEPEAPGITTSKNATSRSSTIETVTRFLSWDDTTSESQSPCNPRLSSRLPDVDDDESECHVLVQNIMSSAGLGTSQSCMVFTGWHLPDHPLDPVLCNKLSELQEKSSYRRLLFDCVNVALIEIGENTLLSAFPWSKRHSRTWRGTSSPDLGVEVWSILKDWIYGARMFVVSKRDNAGIILDRIVKQEVEARGWVKLMMAQVVDITEELEGGVMEELVEEAVLDFHSLFSMMRYRL

SEQ ID NO: 20960 - DNA, 1107 bp, Sorghum bicolor
  misc_feature: Ceres ANNOT ID no. 8680258
  misc_feature: Down-regulated in shoot tissues in response to salicylic acid treatment
  misc_feature: Encodes the peptide sequence at SEQ ID NO 20961
atggatgctgctgctctcatgcctccgctcgtcgtctccctgctcctctgcctgctggcggcggctgccccggcggcgtccgcggcgcgggccttcttcgtcttcggcgactccctcgtcgacaacggcaacaacaactacctgctgaccacggcgcgcgccgacgcgccgccctacggcatcgactcccccacgcaccaagcgacggggcggttctccaacgggctcaacatccccgatatcatcagcgagcacctcggggcggaacctttgctgccgtacctgagccccgagctccgaggggagaagctgctcgtcggcgccaacttcgcgtctgccggcgtcgggatcctcaacgacacaggaatacagtttgtgaacatcatcaggatcggcgaccagctgcagtacttccggcagtaccagcagaagctgagagccctcatcggcgagccgcaggcgacgcagctcgtgaaccaggccctggtgctcatcacgctgggcggcaacgacttcgtcaacaactactacctggtccccatgtccgtgcggtcgcgccagtacgcgctcccggactacgtccgcttcatcatctccgagtacaggaagatcctctcgaggctgtacgagctgggcgcgcggcgcgtgatcgtgacggggacggggccgctggggtgcgtcccggcggagctggcgatgcacagccagaacggcgagtgcgcggtggagctgacgcgcgccgtcaacctcttcaacccgcagatggtggacatggtgcgcggcctcaaccgcgacatcggcgccgacgtcttcgtcaccgccaacacctaccgcatgaacttcgactacatcgcaaacccgcaggacttcgggttcacgaacgtgcaggtggcgtgctgcgggcagggcccgtacaacgggatcgggctgtgcacgccggcgtcgaacgtgtgcgccaaccgggacgtgttcgcgttctgggacgcgttccaccccacggagagggccaaccgcatcatcgtctcccagatcatgcacggcgacacggactacatgcacccaatgaatctcagcaccatcctcgccgtggaccgggagggcctgtag

SEQ ID NO: 20961 - protein, 368 aa, Sorghum bicolor
  misc_feature: Ceres ANNOT ID no. 8680258
  misc_feature: Down-regulated in shoot tissues in response to salicylic acid treatment
  misc_feature (33)..(347): SWISSPROT Homolog: EC 3.2.1.51 Alpha-L-fucosidase
  misc_feature (32)..(344): Pfam ID: Lipase_GDSL Pfam Description: GDSL-like Lipase/Acylhydrolase
MDAAALMPPLVVSLLLCLLAAAAPAASAARAFFVFGDSLVDNGNNNYLLTTARADAPPYGIDSPTHQATGRFSNGLNIPDIISEHLGAEPLLPYLSPELRGEKLLVGANFASAGVGILNDTGIQFVNIIRIGDQLQYFRQYQQKLRALIGEPQATQLVNQALVLITLGGNDFVNNYYLVPMSVRSRQYALPDYVRFIISEYRKILSRLYELGARRVIVTGTGPLGCVPAELAMHSQNGECAVELTRAVNLFNPQMVDMVRGLNRDIGADVFVTANTYRMNFDYIANPQDFGFTNVQVACCGQGPYNGIGLCTPASNVCANRDVFAFWDAFHPTERANRIIVSQIMHGDTDYMHPMNLSTILAVDREGL

SEQ ID NO: 20962 - DNA, 3273 bp, Sorghum bicolor
  misc_feature: Ceres ANNOT ID no. 8680470
  misc_feature: Up-regulated in shoot tissues in response to methyl jasmonate treatment
  misc_feature: Up-regulated in root tissues in response to methyl jasmonate treatment
  misc_feature: Encodes the peptide sequence at SEQ ID NO 20963
atggggatcgtggaggcatgggtgcgggagaagcccatccgcaccttcctagcccgactcgcccagcgccgggcggaggcggccgccgccttcctcgcctccccctccgccaccgcggtcatcgacggcgagggcggcggcgacgggagcatcccgcagctctcctccgtcgccaactccgtcgtctcccgctgctcaaggattcttgctctttcaattgagaacttacagcaaagctttgagactgattttccacacaattgtaatgaggctaatacatatgcaagagaccttttagagtattgctgccacaaagctcttcatgaagttactacacgtccagactatttggctgataagaatcttcgccgcttgatgtttgatatgatgcttgcatgggaaaccccaggcgctcaggatgcgtcagtagaaaatggttctattgtgcgtgattcccttgagattgaagatgaggatgaggggtcaattttttatgcaaattccacaagattggctgttcaagttgatgacaagaagacagtcgggttaagtgcttttgcacgaatagcaccttcatgcccaataatagctgacctggttactgtccacaatctgtttgatgcacttacaagttcatctggaggccgattgcactttcttgtttatgacaagtatctcaagagtttagacagttttcatcttgatgctggagaatgcatattagctattgatggagacaagcctattcatccggtactgcaacatattggaatatcggcgtggccaggaagattggtcctcacaacacatgctctttattttcagagtatcagagtgggatatggtgataagattgttaaatacgatctatcaacagattcaaatcaagtgattaagcgtgatttgactggaccgctgggtgtccgcctctttgataaagctgtgatgtacaaatcaagcactttgacagaaccaatttattttgatttccctgaattaggaggtccttcacgaagagactattggttagcaatcacctgtgaagtattgcaggtgaacagatttatcaggaagttcaatcttggagatgttcagagagcagaagcactctcaaaagctatcttgggcattttgagatactctgctgtcaaagaagcttttcatattgctccttcccactttaagacaacacttacttttagcttagcagaaaagcttccaaaaggagacatggtcttagaagccctgtataataactatttccaactcctggactcttcattgagacatttggcaattgattctgcagtcgataaaatgtcagagaaccattctgtaccattttctttgtatgctctctctagaatgggttttcttctgctgaagacaaaagatgaaactgaaaaggaaatgagcttttgtgctgtttgctttggtgtaacaaaatatctgcaggctgccctgaaagagtcaatttgttactctgagagaatagagtcagcacgtgctacagtcgatcaagtaaaggtggaaggcattgatgtaaatcttgccctcatgcaggagttactcttccctttcattcaagtaggcaagattgtttactctctcagccaatgggaagatccttttaaatcacttctattcttagcttttatgctgtatgttattcaaaggggtctggtcagttacattgtgccctttgttttcttaacttttgctattatcatgatttggcataagtatgttggagacggaaaattgttggaagtgcttgaagtgaaacctcctccaagtaaaaatgctgttgagcagattttgacattgcaggagggtatatccaagttagaagagtttctacaggctgcaaatattactcttctgaagttcagatctgtcttgtttgcctgtgttcctaaggccactgaagtagttgcagctgtacttattgtcacagctgcatttcttgtcttcgtaccttccaggcatctgctacagatgttactcctagagatgtatacaagggagatgcccctaaggaaacagaacactgaaaaattccgcaggcgaattagagagtggagggccgccgcccctgctccgacctccgagaaccgaatggctgccgccgctgcatcttcgtcgcctccggctgccatcacctgccgagctgcggtggcctgggggccgggccagccgctggtcatggaggaggtggaggtcgccccgccggggcccatggagatccgcgtcaaggtcgtctccacctccgtctgccgcagcgacgtcactgcctggcaatccaaggcgcaacctgatctgttccctagagtcttcggccacgaagcatccggagtagtagagagtgtcggtgaaggtgtgaccgagttccaagtcggagaccacgttctcactgtcttcattggggaatgcaagagctgtaagcattgcgtctcggggaaaagcaacatgtgccagaagctcggtttggagaggaagggtgtcatgcacagtgatcagaagacccgcttctctgtcaaggggaaacctgcgtaccattactgtgccgtgtcaagcttcagcgagtacacggttgtccattctggatgtgcggtgaaggttggcctgaccgtgccaatggacagggtgtgcctgctgagctgcggtgtgtctgcaggactcggtgcagtctggaacgtagctaatgtatcaaagggctcaagtgtagctatatttggtcttgggaccgtaggactttctgtcgctcaaggtgctaagcttcggggggcgtccaagattataggagttgacactaatgctgagaagcaagaaaaggggaaattatttggtgtcacggattttattaacccagatgaattgagtgaacctgttcaacaggtaatcaaaaggattactgatggaggggtggattactcttttgaatgtgttggtgatactggagtagtatccactgcacttcaatcatgttctgatggctggggagtaactgtaactcttggtgtaccaaaaacaaaaccagaagtgtctgctcattatgcatttcttctatccggaagaacactgaagggatctttgtttggaggatggagacctaaatctgatctaccttcattggtggataaatatgcagacaaggaaatccaagttgatggcctagtcacgcatgatataccattcagtgaaatcaacaaagcacttgagctcatgctagaaaacaagtgcttgagatgtgtgattcacatgccacagtaa

SEQ ID NO: 20963 - protein, 1090 aa, Sorghum bicolor
  misc_feature: Ceres ANNOT ID no. 8680470
  misc_feature: Up-regulated in shoot tissues in response to methyl jasmonate treatment
  misc_feature: Up-regulated in root tissues in response to methyl jasmonate treatment
  misc_feature (720)..(1090): SWISSPROT Homolog: EC 1.1.1.1 Alcohol dehydrogenase
  misc_feature (905)..(1047): Pfam ID: ADH_zinc_N Pfam Description: Zinc-binding dehydrogenase
  misc_feature (746)..(874): Pfam ID: ADH_N Pfam Description: Alcohol dehydrogenase GroES-like domain
MGIVEAWVREKPIRTFLARLAQRRAEAAAAFLASPSATAVIDGEGGGDGSIPQLSSVANSVVSRCSRILALSIENLQQSFETDFPHNCNEANTYARDLLEYCCHKALHEVTTRPDYLADKNLRRLMFDMMLAWETPGAQDASVENGSIVRDSLEIEDEDEGSIFYANSTRLAVQVDDKKTVGLSAFARIAPSCPIIADLVTVHNLFDALTSSSGGRLHFLVYDKYLKSLDSFHLDAGECILAIDGDKPIHPVLQHIGISAWPGRLVLTTHALYFQSIRVGYGDKIVKYDLSTDSNQVIKRDLTGPLGVRLFDKAVMYKSSTLTEPIYFDFPELGGPSRRDYWLAITCEVLQVNRFIRKFNLGDVQRAEALSKAILGILRYSAVKEAFHIAPSHFKTTLTFSLAEKLPKGDMVLEALYNNYFQLLDSSLRHLAIDSAVDKMSENHSVPFSLYALSRMGFLLLKTKDETEKEMSFCAVCFGVTKYLQAALKESICYSERIESARATVDQVKVEGIDVNLALMQELLFPFIQVGKIVYSLSQWEDPFKSLLFLAFMLYVIQRGLVSYIVPFVFLTFAIIMIWHKYVGDGKLLEVLEVKPPPSKNAVEQILTLQEGISKLEEFLQAANITLLKFRSVLFACVPKATEVVAAVLIVTAAFLVFVPSRHLLQMLLLEMYTREMPLRKQNTEKFRRRIREWRAAAPAPTSENRMAAAAASSSPPAAITCRAAVAWGPGQPLVMEEVEVAPPGPMEIRVKVVSTSVCRSDVTAWQSKAQPDLFPRVFGHEASGVVESVGEGVTEFQVGDHVLTVFIGECKSCKHCVSGKSNMCQKLGLERKGVMHSDQKTRFSVKGKPAYHYCAVSSFSEYTVVHSGCAVKVGLTVPMDRVCLLSCGVSAGLGAVWNVANVSKGSSVAIFGLGTVGLSVAQGAKLRGASKIIGVDTNAEKQEKGKLFGVTDFINPDELSEPVQQVIKRITDGGVDYSFECVGDTGVVSTALQSCSDGWGVTVTLGVPKTKPEVSAHYAFLLSGRTLKGSLFGGWRPKSDLPSLVDKYADKEIQVDGLVTHDIPFSEINKALELMLENKCLRCVIHMPQ

SEQ ID NO: 20964 - DNA, 564 bp, Sorghum bicolor
  misc_feature: Ceres ANNOT ID no. 8680568
  misc_feature: Down-regulated in shoot tissues in response to salicylic acid treatment
  misc_feature: Encodes the peptide sequence at SEQ ID NO 20965
atggccaagctcgccgtcttcctcctcctcctcgccgtggccgcatccgccaccgtgccggcgcacggccgcgatcccccgactgagatcaagctcatccgaggcgcggacgccagcggcgtgggcggcgacagcatggagtgcgtgtacacggtgttcatccggacggggtcgatctggaaggccgggacggacgcgaacatcacgctgcagctggccggcgcggacggcaacggcgtggggatctcggacctgccctcctggggcgggctcatggggcagggccacgcctacttcgagcgcggcaacctggacatcttcagcggccgcgggccctgcatggcgaagccgccgtgctggatgcggctcatctccgacggcaccggcgagcaccatggctggtactgcaactacgtcgaggtcaccgtcacgggcccgcacaaggggtgcacgcagcagctcttcaccgtcgagcagtggctcgccaccgacgccgcgccctacaagctcgaggccgttcgcgacctctgcagcgccgatggcaagagcgtcgcggcggcgtga

SEQ ID NO: 20965 - protein, 187 aa, Sorghum bicolor
  misc_feature: Ceres ANNOT ID no. 8680568
  misc_feature: Down-regulated in shoot tissues in response to salicylic acid treatment
  misc_feature (48)..(172): Pfam ID: PLAT Pfam Description: PLAT/LH2 domain
MAKLAVFLLLLAVAASATVPAHGRDPPTEIKLIRGADASGVGGDSMECVYTVFIRTGSIWKAGTDANITLQLAGADGNGVGISDLPSWGGLMGQGHAYFERGNLDIFSGRGPCMAKPPCWMRLISDGTGEHHGWYCNYVEVTVTGPHKGCTQQLFTVEQWLATDAAPYKLEAVRDLCSADGKSVAAA

SEQ ID NO: 20966 - DNA, 735 bp, Sorghum bicolor
  misc_feature: Ceres ANNOT ID no. 8680569
  misc_feature: Down-regulated in shoot tissues in response to salicylic acid treatment
  misc_feature: Encodes the peptide sequence at SEQ ID NO 20967
atgagcttgtcgcttctccagggctactcctccgctgaggaggacgacgaccccgccgccggcaccgagctaagcgagtccggtgattcgtcagccgaggaagccggatcggacggagacgaggggtccgctcctcaaaagccggcccccaagccccgccgccgaccaaaccctaaggggggagatgccggaggcggcgacggggactcctcgctgccctccgcgctggaggccttcgccgatgtctcgggaccaccggactttctgaggcatagggttgccgagcccgaggaagggacggaggccctcggtgtactcgatcgccgtgggaaagaggggagcaagcacccgcctccaggtgctgttgtggtggcgaaaccgcagttagttgccatccgcgagcgagttaccacaactggagccaacccctcaggttcagtgacatctggttctgttgatggaaaaagaataataggtgctgcaaatcctgggccagaagatgcagctgatcttctgaggatgtgtctccaatgtggtgtaccaaagacctattcacatggtaagggtatggtttgccctcagtgtggtgatagacctgtgcagacaaaagagcccgaaaagaaaaagggttccactgtcaaggacaaggagaagatcaagaggatgagggggcaatcgtcgcatgcatcctggaagagtgaaacggagatggctcttcggcagcaatttgactga

SEQ ID NO: 20967 - protein, 244 aa, Sorghum bicolor
  misc_feature: Ceres ANNOT ID no. 8680569
  misc_feature: Down-regulated in shoot tissues in response to salicylic acid treatment
MSLSLLQGYSSAEEDDDPAAGTELSESGDSSAEEAGSDGDEGSAPQKPAPKPRRRPNPKGGDAGGGDGDSSLPSALEAFADVSGPPDFLRHRVAEPEEGTEALGVLDRRGKEGSKHPPPGAVVVAKPQLVAIRERVTTTGANPSGSVTSGSVDGKRIIGAANPGPEDAADLLRMCLQCGVPKTYSHGKGMVCPQCGDRPVQTKEPEKKKGSTVKDKEKIKRMRGQSSHASWKSETEMALRQQFD

SEQ ID NO: 20968 - DNA, 1497 bp, Sorghum bicolor
  misc_feature: Ceres ANNOT ID no. 8680599
  misc_feature: Up-regulated in root tissues in response to salicylic acid treatment
  misc_feature: Encodes the peptide sequence at SEQ ID NO 20969
atgcttgcctgctcaagcacatcaacaccatggccgcagcggcagccgccgtccccgtgcccagtcgcgggcggcgccgccccgcgccatgtggcactcgcggccaggggcaagcggcggggtgcgggcgccgccggagaggagggggtggacgaggcggcggaggcagcggagctggtgcgctcggtgctgcggaggacggccggcggcaaggagcggctggtgccggtgctggaccgccacgtgcggggggtccgcaccgagcactgcttcctcctcttcgaggagctcggccgccgcgatgcctggctccagtgccttgaggttttcagatggatgcagaaacaacggtggtatgttgctgacaacggcatctactccaagttaatatctgtgatgggaaggaaaggccagatacggatggcaatgtggttgttctctcagatgcggaacagcgggtgcaagccggacacttctgtatataactctcttatcggcgcacatctgcattcacgggacaagagtaaggctttggccaaagctcttggatattttgagaagatgaagtgtatagcgagatgccaaccgactattgtgacctacaacattcttctaagggcttttgcacaggctggtgacacaaagcaggtagacatcttgttcaaggatctggatgaaagtgtagtctcccctgacatatatacttacaatggagtgcttgacgcatacgggaagaatggcatgatcaaagagatggaatctgtgttgctgcggatgaaaagcaagcaatgccgtccagatgtgatcacattcaatatactcatagattcatatgggcgaaagcagatatttgataagatggagcaggtgttcaagagcctactgcgatcaaaggagaggcctacacacccgacgtttaattccatgataacaaattatgggaaagcaaggctcagagagaaagcagagtatgtggttaagaagatggaagaattgggatacaaaccaaactatgtgacacaagaatgcctcatcatgatgtatgctcattgtgattgtgtctcaaaggcccggcaagtgtttgatgagcttgtgagctcacaaaacaaagtgcaactttcttcgttgaactcgatgcttgatgcctactgcatgaacggcttgcacacagaagcagatcagctgctggatactgcactgcagaaatgtgttgtgcccaatggttcgacctacaagctgctctacaaggcctacaccagggcaaacgataaggtactagtgcagaagttgctcaagagaatgaataaacaggggattgtcccgaataaaaagttcttcctggatgctttggaagcatttggcacctctgagaggaaacccaggacatcaccagccataaactctgcaagcaaactaggtgcagattctgctggtgattcagaatcaggtacttctaacaagccagaggtaagcgtttggcaagtagctgctacataa

SEQ ID NO: 20969 - protein, 498 aa, Sorghum bicolor
  misc_feature: Ceres ANNOT ID no. 8680599
  misc_feature: Up-regulated in root tissues in response to salicylic acid treatment
  misc_feature (234)..(268): Pfam ID: PPR Pfam Description: PPR repeat
  misc_feature (124)..(158): Pfam ID: PPR Pfam Description: PPR repeat
  misc_feature (199)..(233): Pfam ID: PPR Pfam Description: PPR repeat
  misc_feature (304)..(338): Pfam ID: PPR Pfam Description: PPR repeat
  misc_feature (374)..(408): Pfam ID: PPR Pfam Description: PPR repeat
  misc_feature (269)..(303): Pfam ID: PPR Pfam Description: PPR repeat
MLACSSTSTPWPQRQPPSPCPVAGGAAPRHVALAARGKRRGAGAAGEEGVDEAAEAAELVRSVLRRTAGGKERLVPVLDRHVRGVRTEHCFLLFEELGRRDAWLQCLEVFRWMQKQRWYVADNGIYSKLISVMGRKGQIRMAMWLFSQMRNSGCKPDTSVYNSLIGAHLHSRDKSKALAKALGYFEKMKCIARCQPTIVTYNILLRAFAQAGDTKQVDILFKDLDESVVSPDIYTYNGVLDAYGKNGMIKEMESVLLRMKSKQCRPDVITFNILIDSYGRKQIFDKMEQVFKSLLRSKERPTHPTFNSMITNYGKARLREKAEYVVKKMEELGYKPNYVTQECLIMMYAHCDCVSKARQVFDELVSSQNKVQLSSLNSMLDAYCMNGLHTEADQLLDTALQKCVVPNGSTYKLLYKAYTRANDKVLVQKLLKRMNKQGIVPNKKFFLDALEAFGTSERKPRTSPAINSASKLGADSAGDSESGTSNKPEVSVWQVAAT

SEQ ID NO: 20970 - DNA, 1851 bp, Sorghum bicolor
  misc_feature: Ceres ANNOT ID no. 8680740
  misc_feature: Down-regulated in shoot tissues in response to salicylic acid treatment
  misc_feature: Encodes the peptide sequence at SEQ ID NO 20971
atgggcaccacagcgcggcgcgagccgctgaagcagcgcgtgaaccgctgcctcctcaagctttccgaccgcgacacagaggccatggcggccgccgagctcgaggccatcgcgcgcgcgctcgagcccgacgagctcccggccttcgtctcggccgtctccgacgcgcgccccaccgacaagaccccgctccgccgccacgcgctgcgcgccctggcgctcgtcgcggcgtcccacccgcgcgacgccgtggccccgctcgtcccgcgcatcctcgccgccgcgctccgccgcgtccgggaccaggactcctccgtccgcgccgcgctcgtcgacaccgcgcgcgccgcggcggcggcctccgcctccgcctccgccgcgctccggcccctcacggacgcgctccttcacgagcaggaccagtgcgcgcagctggcggccgcgctcgccacggccgccgccgtcgaggcgtccgccgtcaccgccgacctcgcttcctacctccacaagctccaaccgcgcctcctcaagttacttcgcagcaatgccttcaaggccaagcccgcgctcatcaccctcatcggcgcctccgcggccatggccggcgatgccgaagtcaccgcctccatcccgtgcctccgcgatgcaatcgctagcgatgactgggcagcgagaaaggcggcggcggaggcgcttgctgcattggccctggagcacacggatcttctcacgacctacaaatcctcttgcgttaccttcttcgaggccagaaggtttgacaaggtcaagattgtgcgagagtcgatgaaccggatgattgaggcgtggaaggagatcccgggtgctgaagaggacgagtgctcctccgctccgccaccagcgtcccaatcacaacgaagatcttctcttacagggagtgcaagtgatgggcgatatccagctgcttcgctgggctcaaactctgttccatcatcaacaaggaggagcagattacctgtgagcagatcatctccgcctgatgtgtcacccagtgtcaccaaaacaaatagtccttcgtccatcaggaacaagaagctgtcaccaccttcatatcgcaaagtgcgccaagcaaataattgtgactacaaggttgagattgctgttgctccggatgctaccccaatcaaagtggtgactgaggagaagctactgaaaggaggcaatgtgagagacagactggaggctaggagaacactcttccaaggcagcgaggataggtcagccaagctggctggacacaaagcagggtcacgagttgttccgtacgagggcggtggtaatttggaagagatttcagaagttgaaggtggatcagaaaggtatacagttcataaggatgagagcttgtcagaaataaggacgcagctccttcagattgaaaatcagcaaagcagtttactggatcttctccagaaatttatgggtaagtccgagaatggtatgaattctttggagacaagggtgcatgggctggagatggctttggatgagatctctcgtgatttggccttctcttcaggaaggatgtcaaacagggagcctgatgtaaagacgtgctgcattctgagtccaaaattctggagaaggcacaatggtggtaggtcttcctcaaggttttctgcctcagacccagcaaacagctcagacgagagcagaacttcttacaaatgggagagacagaagtttgggcttcagggtggctttgtcacaaacccattagccgagccaaacatttcttcagtagggaaaacaatggttactcaagaaggcaggaagaaggatacaactttacaaaagtcaaggatgggttag

SEQ ID NO: 20971 - protein, 616 aa, Sorghum bicolor
  misc_feature: Ceres ANNOT ID no. 8680740
  misc_feature: Down-regulated in shoot tissues in response to salicylic acid treatment
MGTTARREPLKQRVNRCLLKLSDRDTEAMAAAELEAIARALEPDELPAFVSAVSDARPTDKTPLRRHALRALALVAASHPRDAVAPLVPRILAAALRRVRDQDSSVRAALVDTARAAAAASASASAALRPLTDALLHEQDQCAQLAAALATAAAVEASAVTADLASYLHKLQPRLLKLLRSNAFKAKPALITLIGASAAMAGDAEVTASIPCLRDAIASDDWAARKAAAEALAALALEHTDLLTTYKSSCVTFFEARRFDKVKIVRESMNRMIEAWKEIPGAEEDECSSAPPPASQSQRRSSLTGSASDGRYPAASLGSNSVPSSTRRSRLPVSRSSPPDVSPSVTKTNSPSSIRNKKLSPPSYRKVRQANNCDYKVEIAVAPDATPIKVVTEEKLLKGGNVRDRLEARRTLFQGSEDRSAKLAGHKAGSRVVPYEGGGNLEEISEVEGGSERYTVHKDESLSEIRTQLLQIENQQSSLLDLLQKFMGKSENGMNSLETRVHGLEMALDEISRDLAFSSGRMSNREPDVKTCCILSPKFWRRHNGGRSSSRFSASDPANSSDESRTSYKWERQKFGLQGGFVTNPLAEPNISSVGKTMVTQEGRKKDTTLQKSRMG

SEQ ID NO: 20972 - DNA, 1173 bp, Sorghum bicolor
  misc_feature: Ceres ANNOT ID no. 8680745
  misc_feature: Up-regulated in root tissues in response to salicylic acid treatment
  misc_feature: Encodes the peptide sequence at SEQ ID NO 20973
atggccgcggccgccctccttcgccgcatccccgccgcgcgggccccggccacggccttcatggcggcgcgcccgatctccgattccacggcggcgctcaccatcgagacatctgtccctttcacctcccacctcgtcgacccaccctcgcgcgatgtcaccaccacccccgccgagctcgtcaccttcttccgcgacatgtccctcatgcgccgcatggagatcgccgccgactccctctacaaggccaagctcatccgcgggttctgccacctctacgacggccaggaggccgtcgccgtcggcatggaggccgccatcacccgctccgattccatcatcaccgcctaccgcgaccactgtacctacctcgcccgcggaggggacctcgtctccgccttctccgagctgatgggccgcgagggcggctgctcccgcgggaagggcggatccatgcatttctataagaaggatgccaatttctacggcggccacggcatcgtcggcgcgcaggtgcccctaggatgcggcctcgccttcgctcaaaagtacaagaaggaggacacggccacgttcgcgctctatggagacggtgcggctaaccagggacagctctttgaggctctcaacatttcggccctctggaagctgcctgccatattggtgtgcgagaacaaccattatgggatgggaacagcagagtggagggcagccaagagccctgcctactacaagcgtggcgactatgtgcctggattgaaggttgatggaatggatgttcttgctgtgaaacaagcatgcaaatttgcaaaagatcatgctgttgcaaatggcccaattgtccttgagatggatacctacaggtaccatggccactctatgtcagatccaggaagcacttaccgcaccagagatgagatttctggtgttaggcaggaacgggacccaattgaaagggttagaaaattgcttttgactcacgacctggcaactgctgctgagctcaaggatatggagaaagaaatcaggaaacaagtagatgacgccattgctaaagcaaaggaaagttctatgcctgatacttctgagctcttcacaaatgtttataagaagggcttcggtgtggagtcatttgggccagacaggaaggagttgagagcttcccttccttag

SEQ ID NO: 20973 - protein, 390 aa, Sorghum bicolor
  misc_feature: Ceres ANNOT ID no. 8680745
  misc_feature: Up-regulated in root tissues in response to salicylic acid treatment
  misc_feature (27)..(390): SWISSPROT Homolog: EC 1.2.4.1 Pyruvate dehydrogenase (acetyl-transferring)
  misc_feature (65)..(362): Pfam ID: E1_dh Pfam Description: Dehydrogenase E1 component
MAAAALLRRIPAARAPATAFMAARPISDSTAALTIETSVPFTSHLVDPPSRDVTTTPAELVTFFRDMSLMRRMEIAADSLYKAKLIRGFCHLYDGQEAVAVGMEAAITRSDSIITAYRDHCTYLARGGDLVSAFSELMGREGGCSRGKGGSMHFYKKDANFYGGHGIVGAQVPLGCGLAFAQKYKKEDTATFALYGDGAANQGQLFEALNISALWKLPAILVCENNHYGMGTAEWRAAKSPAYYKRGDYVPGLKVDGMDVLAVKQACKFAKDHAVANGPIVLEMDTYRYHGHSMSDPGSTYRTRDEISGVRQERDPIERVRKLLLTHDLATAAELKDMEKEIRKQVDDAIAKAKESSMPDTSELFTNVYKKGFGVESFGPDRKELRASLP

SEQ ID NO: 20974 - DNA, 1164 bp, Sorghum bicolor
  misc_feature: Ceres ANNOT ID no. 8680977
  misc_feature: Down-regulated in shoot tissues in response to salicylic acid treatment
  misc_feature: Encodes the peptide sequence at SEQ ID NO 20975
atggcggaccaggctaaccaacccactgtccttcataagcttggtggccagttccacctgagctccagcttctctgaaggtgttcgggcccgtaacatctgcccttctgtctcttcgtatgaaaggagttttgccacaaggaactacatgacacagagccttttcagcccttcaatgtctgttactggtggcatcaatgtcccagtgatgcgtaccccgctttttgccaatgctccagctgagaagggaggcaaaaacttcatgattgatttcatgatgggcggtgtttcagctgctgtttcgaagactgctgctgctcccattgagcgtgtgaagctgcttattcagaaccaggatgagatgatcaagtctggtaggctgtcagagccatacaagggtattggtgactgcttcaaacgtaccatcaaggatgagggtttctcttccttgtggaggggtaacactgcaaatgttattcgttacttccctactcaggctttgaactttgcatttaaggactacttcaagaggttgttcaacttcaagaaggacaaggatggttactggaagtggtttgctggcaacctggcctctggtggagctgctggtgcttcctctttgttttttgtgtactccctggactatgccaggacaaggttggccaatgacgccaaggctgccaagggaggaggtgataggcaattcaatggtcttgtggatgtctaccgcaagacactcaaatctgatggtatcgctgggctttaccgtggatttaacatctcttgtgttggaatcatcgtttaccgtggtttgtacttcgggctctatgattctatcaagccagttgtcctcaccggcaaccttcaggacaatttcttcgcaagtttcgctctgggttggctgatcaccaacggtgctggtcttgcatcttaccccattgatactgtccgcagaaggatgatgatgacttctggtgaggctgtcaagtacaagagctccttggatgcgttccagcagatccttaagaaggaaggccccaagtccctgttcaagggtgctggtgctaacattcttcgtgccattgctggtgctggtgtgctttctggctatgaccagctccagatcctcttcttcgggaagaagtacggctctggcggtgcttaa

SEQ ID NO: 20975 - protein, 387 aa, Sorghum bicolor
  misc_feature: Ceres ANNOT ID no. 8680977
  misc_feature: Down-regulated in shoot tissues in response to salicylic acid treatment
  misc_feature (86)..(183): Pfam ID: Mito_carr Pfam Description: Mitochondrial carrier protein
  misc_feature (191)..(287): Pfam ID: Mito_carr Pfam Description: Mitochondrial carrier protein
  misc_feature (291)..(381): Pfam ID: Mito_carr Pfam Description: Mitochondrial carrier protein
MADQANQPTVLHKLGGQFHLSSSFSEGVRARNICPSVSSYERSFATRNYMTQSLFSPSMSVTGGINVPVMRTPLFANAPAEKGGKNFMIDFMMGGVSAAVSKTAAAPIERVKLLIQNQDEMIKSGRLSEPYKGIGDCFKRTIKDEGFSSLWRGNTANVIRYFPTQALNFAFKDYFKRLFNFKKDKDGYWKWFAGNLASGGAAGASSLFFVYSLDYARTRLANDAKAAKGGGDRQFNGLVDVYRKTLKSDGIAGLYRGFNISCVGIIVYRGLYFGLYDSIKPVVLTGNLQDNFFASFALGWLITNGAGLASYPIDTVRRRMMMTSGEAVKYKSSLDAFQQILKKEGPKSLFKGAGANILRAIAGAGVLSGYDQLQILFFGKKYGSGGA

SEQ ID NO: 20976 - DNA, 1362 bp, Sorghum bicolor
  misc_feature: Ceres ANNOT ID no. 8681110
  misc_feature: Up-regulated in root tissues in response to salicylic acid treatment
  misc_feature: Encodes the peptide sequence at SEQ ID NO 20977
atgccgaccatcacgaccatcacgcactacgtgctggatcccttgcttgagacgcggtctcctgcgcaggtccagaaagccacgcccaagccgctgccctcgcctccggacaaggccacacccgtgccggtggctcctgtgaggacgcagacgtcgccggcgtcactctatgccacgcctgagagcaccactctgcctgactcgccttcctcgttccccggaacctggtcgccgtacatcatcaaccataagaggcggggggcctcccttgccaagacattctctcagggtgatgatggaaatgagggcagccagccgaagctcccagtggtgatgctgcctgctttgcccaaaggggctcaacccactgcagtgcaggagcctgagtttgcgtttcagcaatcatggaatggtcaagctgaatgtgacattggtgtggaagaggctcccatcaatggaaaaaatgaaatactactgaagggcaagggatctgtgtcagccaaaaatgagcaggagcagcctgagtttgagtttcagcgtggaagttctgaagcactagtgaagcctgttaatgttgggaggcctttgattggtgaagcacctaaaaatgatgagatcgatgccttccttgaacttcaggattcgatgagtgtggctagcaatactgaagctgatgatgctggtatgcaagagcggtggtggaagcccagttcgccttttgggacctctgttggcacacctggtgctgaattctatgatgcatttgaagaaatatcaagtgatggtggaactcgatcttcacgagccatggatgatgaccttcgtgaaatgaggttaagtctgttgatggaaattgagaggaggaagcaagcagaagaagcacttgagatctggcagaaggaatggaagaagctgagtcaccacctatcacatgttgccttatcacttccatctccaagtatagctgaggatactgatgattcaagcgtggatcctggagctgagttgtgccagcaaataactgtttcacaacttgtagctgctgctattgcccagggttttgctcgtgctgaagttgaatcagagatggaaactgtgattgcagcaaagaactttgagattgcaaggctgtcggatagggtccagtactatgaagctgcaaacagggaaatgtcccaaagaaaccaagaagctatcgagatgtcaaggcaacaacgcaaggagcgtaagaagcgacagaagtggttctggggatcagttgggcttgcagtcacccttggtgccacagctattgcctggtcttatttaccttcatcgcagccccaagctagtgcagattcaaagagtactgccaacaactag

SEQ ID NO: 20977 - protein, 453 aa, Sorghum bicolor
  misc_feature: Ceres ANNOT ID no. 8681110
  misc_feature: Up-regulated in root tissues in response to salicylic acid treatment
MPTITTITHYVLDPLLETRSPAQVQKATPKPLPSPPDKATPVPVAPVRTQTSPASLYATPESTTLPDSPSSFPGTWSPYIINHKRRGASLAKTFSQGDDGNEGSQPKLPVVMLPALPKGAQPTAVQEPEFAFQQSWNGQAECDIGVEEAPINGKNEILLKGKGSVSAKNEQEQPEFEFQRGSSEALVKPVNVGRPLIGEAPKNDEIDAFLELQDSMSVASNTEADDAGMQERWWKPSSPFGTSVGTPGAEFYDAFEEISSDGGTRSSRAMDDDLREMRLSLLMEIERRKQAEEALEIWQKEWKKLSHHLSHVALSLPSPSIAEDTDDSSVDPGAELCQQITVSQLVAAAIAQGFARAEVESEMETVIAAKNFEIARLSDRVQYYEAANREMSQRNQEAIEMSRQQRKERKKRQKWFWGSVGLAVTLGATAIAWSYLPSSQPQASADSKSTANN

SEQ ID NO: 20978 - DNA, 1626 bp, Sorghum bicolor
  misc_feature: Ceres ANNOT ID no. 8681138
  misc_feature: Down-regulated in shoot tissues in response to aminocyclopropane carboxylic treatment
  misc_feature: Encodes the peptide sequence at SEQ ID NO 20979
atgggtggctataagcctcgcctcagcctgcataattcactgttccgtgcacttgtgagtaaaacaggaggcactgcgaagcacaatctcaggcaggctgagtttgtctaccacaatatagtcacaagtaaccttgcggtgcacaaggatatttatgcagggctcatctggctccacagctatcaagatgtcattgacagagacaggatcaaagctcttagggatgagatgaagcgagctgggtttgaggagagcactgatgtgctggtgtcatggatgagggccttctccaaggaaggagatattaaagaaactgaggcaacatggcattggcttcttcggagtggttgtgagcttcctgtgcaagcttatatctgccgcatggagctgtatgcacgctctggtgagcctatgaaatccctagaaattttcaaggaaatgaagaatcagaacattcctcctaatgttgcatcatatcataagattattgagataatggcaaaagctagagagatagagattgcagaaaaactcatggatgagtttgttgaaagtgatatgaaacatctgatgccagcctttcttgacttgatgtatttgtatctggatctggatatgcatcacaaactggaacagactttcacaaaatgccttggccgatgtcgtccaaatagaatattgtacaccatttatctggaatcacttgtgaggattgggaatgtcacaaaggccgaggagatctttggggaaatgcataaaaatgggatgataggtactaatgctaagtcttgcaacatcatgcttagaggctatctttcggcagaggactatctgaaagctgagagcatttatgagttaatgtgtaaaaagaagtatgatataccagtggattctttggagaaacttcaaagtggcctcctcagtaacaagaaagttgtgaagccaccaaaacctgtgagcatgaagttggatgaagagcagcgtgagattttgattggcttgctccttggaggcacccaaatagaatctcatgcacagaaaggggtctacattgtcaactttaagttccaggaagattctaatgctcattcagttctaagggtgcatattcatgaacgtttctttgaatggctgccttcagcatgcagatcactgaatagggagagcgagatcccttatcgattttcaaccatacctcatgcacattttggcttctttgcagatcagttctttcagaaaggccagcctgttctcccaaaacttgttcataggtggctttccccacgggttctggcatattggttcatgtttgggggcttcagactgcaatcaggtgatattgttcttaaggtcagtggcgggaacatcgatggtgttgagagaattgtgaaatccttgcaaacacaatctttaacatgtaaagtgaagaggaaaggaagattcttttggataggttttcagggaagcaatggcgactctttctggaaaatagttgaaccttatgtgttggacagttttgcaagttctactgaggaaagtcacaatgtaggttctgatggcttgcaagatagtgatacatattatgatgatgatacacagaggcatgatagagaaagtgatgagtga

SEQ ID NO: 20979 - protein, 541 aa, Sorghum bicolor
  misc_feature: Ceres ANNOT ID no. 8681138
  misc_feature: Down-regulated in shoot tissues in response to aminocyclopropane carboxylic treatment
  misc_feature (327)..(495): Pfam ID: LAGLIDADG_2 Pfam Description: LAGLIDADG DNA endonuclease family
  misc_feature (122)..(156): Pfam ID: PPR Pfam Description: PPR repeat
MGGYKPRLSLHNSLFRALVSKTGGTAKHNLRQAEFVYHNIVTSNLAVHKDIYAGLIWLHSYQDVIDRDRIKALRDEMKRAGFEESTDVLVSWMRAFSKEGDIKETEATWHWLLRSGCELPVQAYICRMELYARSGEPMKSLEIFKEMKNQNIPPNVASYHKIIEIMAKAREIEIAEKLMDEFVESDMKHLMPAFLDLMYLYLDLDMHHKLEQTFTKCLGRCRPNRILYTIYLESLVRIGNVTKAEEIFGEMHKNGMIGTNAKSCNIMLRGYLSAEDYLKAESIYELMCKKKYDIPVDSLEKLQSGLLSNKKVVKPPKPVSMKLDEEQREILIGLLLGGTQIESHAQKGVYIVNFKFQEDSNAHSVLRVHIHERFFEWLPSACRSLNRESEIPYRFSTIPHAHFGFFADQFFQKGQPVLPKLVHRWLSPRVLAYWFMFGGFRLQSGDIVLKVSGGNIDGVERIVKSLQTQSLTCKVKRKGRFFWIGFQGSNGDSFWKIVEPYVLDSFASSTEESHNVGSDGLQDSDTYYDDDTQRHDRESDE

SEQ ID NO: 20980 - DNA, 2400 bp, Sorghum bicolor
  misc_feature: Ceres ANNOT ID no. 8681156
  misc_feature: Up-regulated in root tissues in response to aminocyclopropane carboxylic treatment
  misc_feature: Up-regulated in root tissues in response to salicylic acid treatment
  misc_feature: Encodes the peptide sequence at SEQ ID NO 20981
atggtggggagctcggtggagggaggagcggacggagatggaggctgctgcggcgtcggggacacctctcccgggaccatcgtgtgggtgcggcggaggaacgggtcctggtggcccggcaggatcctgggccccgaggagctcccaccgtcgcagatcatgtcgccgaggtccggcacgccggtcaagctcctcggccgggaagacgcaagcgtggattggtacaaccttgagaaatcaaaacgtgttaaagcattcaggtgtggagagtttgatgcctgtattgagaaggcagaggccactcaagggactgttgtgaagaaaagagagaaatatgcacggagagaagatgctattcttcatgcacttgaattggagaggaaacagcttgcatcaaagtatcaaactcaaggtttcagacctggacctcctggtaatatttctgcttgcacaaaacatcgcaaagaccttggaagtactcgctacaagagtaaaaagagcaagaagcgcaaagatgcatctgttcctcctgatgtaaagaaagaagtgggacaatgttttctacatgctggttcaaagagaaacttttcagaatctcttactgaaggaaatgttgtcagtaatcacatgggtgatttctcccattcgagacattctcatggaggtgccactttagagaacaaggagaggagtacaattgtgaagaaaaatagatcggacggaagtgattttgaagattctcttgtttcaaaatcagacagacgaagaccactttctcaagtattgcagagcagtgaaaacttgcctcctcacttaaagcaaaatgatgattttggggctttgttaattggggagaataataatccttcacttgctacctcccggtccagaagaagtaaatatacatacatggctagtgattctggtgaaactcagagtcatagtgatttaccttctataaagatgtcttctactggagctgattttgagaatgaaagctatcttcagcatcctggttatttttctgaggagcacacttcttctgacttcgttgagaagcaaataaccgagtcttcagagagggaatgctcagaaagtgagactgaagatgatgctgaacttctgcaaacttctgacaagttcaaacatgtgcattatgatgacaatgaggtgacatattctacttatgtgccccaaaatgaatctgaggaagaggatggttcttctgagctgggtgtctctcagtggcacatgaaaggtaaacgtaacaatcgtaatgccgcaaaaagattagtggatatgagagatggaaatacatggttaaacaaatacaatggaccattaaaagggtctttgcataacacaaatggtgggaatcccagaaaagaaggtatgcacacatctggtgagcagttttttgaggaaagcttttaccaaattaaagaggagcccaattatgattctgaggaaactaatttgtttgaggacatgagccattcagaggctaacttgtactatggtaaaaaataccattcagccttgagaatcacaaaagatcttagccgaggctacggttactttaatgactatgagaatgactcttcaaatctttctcacttagatatggacgctgaacagtatcatgttgatcggaatgcatattgggatggaccttcattttaccaaaggaagttgacttcacgttttggtggcatgggaccaatgttgttcaatgttaaccttaaagttcaggccagctaccaaggagagcatgtccctcttgtctccttaatgagcagacttaatggcaaagcaattgttggacaccctatccaaattgaaatagttgaagatggttccacagatcatctggtattctgcggtgacagtggtatgcaagagagcacagctactccacctgcttggccaacaggtagaagaactgccatgcaaagagttccccgttcaaatccgtcaggagcactgttggatggcgataatgaaggtggtcttgtgtattctgattatgagatgaaaccaaccttaagaaagtactcgtcttcttcgaatcaccaggttaaggtgaataagaaaagcagttcggatgctaggaggtcatcagctaagtcccataagaagtcatccaagaaaacaaaccttagagctctctcttccatttccgccgcaaaaaaacaccacggagaaggtggccgagcaaaggcacattggcgcaatgacatatttggtggtttaatcaaatcagagggagcagttcctctagtgacatgtgtcccaacgaaggttgtgttcactaggatattggaagcagttggcaggccacctccatctgtcgctcatcgtgttagaatggctagtccttcagtgcgagatcctccatag

SEQ ID NO: 20981 - protein, 799 aa, Sorghum bicolor
  misc_feature: Ceres ANNOT ID no. 8681156
  misc_feature: Up-regulated in root tissues in response to aminocyclopropane carboxylic treatment
  misc_feature: Up-regulated in root tissues in response to salicylic acid treatment
MVGSSVEGGADGDGGCCGVGDTSPGTIVWVRRRNGSWWPGRILGPEELPPSQIMSPRSGTPVKLLGREDASVDWYNLEKSKRVKAFRCGEFDACIEKAEATQGTVVKKREKYARREDAILHALELERKQLASKYQTQGFRPGPPGNISACTKHRKDLGSTRYKSKKSKKRKDASVPPDVKKEVGQCFLHAGSKRNFSESLTEGNVVSNHMGDFSHSRHSHGGATLENKERSTIVKKNRSDGSDFEDSLVSKSDRRRPLSQVLQSSENLPPHLKQNDDFGALLIGENNNPSLATSRSRRSKYTYMASDSGETQSHSDLPSIKMSSTGADFENESYLQHPGYFSEEHTSSDFVEKQITESSERECSESETEDDAELLQTSDKFKHVHYDDNEVTYSTYVPQNESEEEDGSSELGVSQWHMKGKRNNRNAAKRLVDMRDGNTWLNKYNGPLKGSLHNTNGGNPRKEGMHTSGEQFFEESFYQIKEEPNYDSEETNLFEDMSHSEANLYYGKKYHSALRITKDLSRGYGYFNDYENDSSNLSHLDMDAEQYHVDRNAYWDGPSFYQRKLTSRFGGMGPMLFNVNLKVQASYQGEHVPLVSLMSRLNGKAIVGHPIQIEIVEDGSTDHLVFCGDSGMQESTATPPAWPTGRRTAMQRVPRSNPSGALLDGDNEGGLVYSDYEMKPTLRKYSSSSNHQVKVNKKSSSDARRSSAKSHKKSSKKTNLRALSSISAAKKHHGEGGRAKAHWRNDIFGGLIKSEGAVPLVTCVPTKVVFTRILEAVGRPPPSVAHRVRMASPSVRDPP

SEQ ID NO: 20982 - DNA, 2238 bp, Sorghum bicolor
  misc_feature: Ceres ANNOT ID no. 8681215
  misc_feature: Up-regulated in root tissues in response to salicylic acid treatment
  misc_feature: Encodes the peptide sequence at SEQ ID NO 20983
atggcggagcaggacggcgccgcggggcagagcccgcccgactccgttccgggtggtgctgctgaaaatggggatcagaatactaagcagcatcagccatttttctcgatgtgccagccacttcgcactgttagctactcgaattcgtgggatggggtttgtgctcctgctgctaatgaaaataaccacactagtggcttgaactcaatggcggatgaacacaccataactgcatctactccccttggaagcaagcaacctcaatctgagggcatatctggtacatcgtacagggaagacaattcatgttcaccacattcaattaataaggaagtcagtttggtgcaagatgtcatggaaatggaacaatcaatggatggagttgatgtgccacatggaggaacaagtgagcagccagagccccttgccacagagcagcctgattcatttgatgaaatagacatatggggtgcccaagataatcagcaagtgttgccccttaacagcaagcaatggaactctaatattggtgaaacttgtgatgctgaagatatgcatattcctttgtccgtttcttatagaaggcaacctaaatctgtgggagctggtcttagcaatatggggaacacatgcttcctaaatgcaactcttcagtgtatcactcacactgtaccgctttttcgcaagcttcactcaactgatcatttcactccatgctcatataataaggatgggttctgttctttctgtgcccttaaagaacatgctgatgaatcaattcgaaggtctggatctgttatagcgccaacaaagttcagagatagtttaagaaagttatcttcggattttagaccaggacagcaagaagatgcacacgaattcctacgttgcttgcttgataacttgcataagtgtactcttgatcccaagtcaaagggcaaggactcatcctttgacgaagaaagtatagttaaggagatttttggaggacaactaagaagccatttatcttgctgcgagtgtggtcacagctcagagacatttgagcccttcctggatctaagcttggagattgatcaggtcgatcacctggtagatgctttgcaatcttttaccaaggtagagcatattggggactctgaaaacaagctcacttgtgaaagttgcaatgctcaagtttgtaagaacaagcagcttacacttcatagagcaccggatgttattgcatttcatctcaagcgttttacaacccttgacaattccgttgagaagattgacaaacatgtggtgtaccctctggaggttgatttgaagccgttctacagcaacccagatgctgcgggggagctgaaatatgatctttatggtgttgttgagcattctggattacccaactatggccattatgtctgtgccattcgttcttcaccaagcacatggtacttgatgaatgactcaaatgttgattctattactgattcaagtgcactaaaccaagaagcatatattctattctatgttaggcagggcaaatttccatggttctcgagtttgttagaaggcaaggatgccctacaagttgagaatacccgtggcacatctcctgtgtcagttttggaaaatatagatgcaaactgttcaaattcttctggaggaggcagtagcagtagttctggtgacaagttggagaaaaatgaagccagccaattagaggagacagagaaagatgaaatgagtcggtacaaaacaccattccttcctgagaaaccatctaagagaagtccacttggtgcttccaacagcaataataaaatagatgaaaataagccatccagggcttctctccaaaatgatgcggctagatgtctccgcagtctagaaactaccaatctggataagccctctactccacggtgctccaaacgactggcactgtcctctgataatgagtctagcgtgtttgagtttgaggactttgatgaggaagtggagactttacatccaaacatgaaattgcaaccgaaggtgaagaaagctaaggctgcatctgcatctaaagctgtgaagggtccgtgtattgatcagaatgcattacatttgatgaggggcatgacatccacacgaagaaaagatctaatggagtgcataaaacagcaaaatgcaaagcacgagtctcgcagatgccctgcaagtgaccctctggacaaaaagaaaagaaaggtggttcttcagtactag

SEQ ID NO: 20983 - protein, 745 aa, Sorghum bicolor
  misc_feature: Ceres ANNOT ID no. 8681215
  misc_feature: Up-regulated in root tissues in response to salicylic acid treatment
  misc_feature (188)..(541): SWISSPROT Homolog: EC 3.1.2.15 Ubiquitin thiolesterase
  misc_feature (199)..(506): Pfam ID: UCH Pfam Description: Ubiquitin carboxyl-terminal hydrolase
MAEQDGAAGQSPPDSVPGGAAENGDQNTKQHQPFFSMCQPLRTVSYSNSWDGVCAPAANENNHTSGLNSMADEHTITASTPLGSKQPQSEGISGTSYREDNSCSPHSINKEVSLVQDVMEMEQSMDGVDVPHGGTSEQPEPLATEQPDSFDEIDIWGAQDNQQVLPLNSKQWNSNIGETCDAEDMHIPLSVSYRRQPKSVGAGLSNMGNTCFLNATLQCITHTVPLFRKLHSTDHFTPCSYNKDGFCSFCALKEHADESIRRSGSVIAPTKFRDSLRKLSSDFRPGQQEDAHEFLRCLLDNLHKCTLDPKSKGKDSSFDEESIVKEIFGGQLRSHLSCCECGHSSETFEPFLDLSLEIDQVDHLVDALQSFTKVEHIGDSENKLTCESCNAQVCKNKQLTLHRAPDVIAFHLKRFTTLDNSVEKIDKHVVYPLEVDLKPFYSNPDAAGELKYDLYGVVEHSGLPNYGHYVCAIRSSPSTWYLMNDSNVDSITDSSALNQEAYILFYVRQGKFPWFSSLLEGKDALQVENTRGTSPVSVLENIDANCSNSSGGGSSSSSGDKLEKNEASQLEETEKDEMSRYKTPFLPEKPSKRSPLGASNSNNKIDENKPSRASLQNDAARCLRSLETTNLDKPSTPRCSKRLALSSDNESSVFEFEDFDEEVETLHPNMKLQPKVKKAKAASASKAVKGPCIDQNALHLMRGMTSTRRKDLMECIKQQNAKHESRRCPASDPLDKKKRKVVLQY

SEQ ID NO: 20984 - DNA, 570 bp, Sorghum bicolor
  misc_feature: Ceres ANNOT ID no. 8681240
  misc_feature: Up-regulated in shoot tissues in response to methyl jasmonate treatment
  misc_feature: Up-regulated in root tissues in response to methyl jasmonate treatment
  misc_feature: Encodes the peptide sequence at SEQ ID NO 20985
atggcctcactccaccccacgacggccatgctgccccatcgccattcccctgctccctctctcagcgcatcgtcgctctcatggtccgccgccatcgccgtctcccgcatcccgccggcccgtggcctcgcgctccacccatcggttccgcctcccgcctccggcaaccgtcagagcccggtggtgtgcgcggcgtggacgcggcggtcgcgcggggaggcggagcagcggcccaaccgcaagtcgtggaagcagcgcacggacatgtacatgcgccccttcctgctcaatgtttttttctccaagcgcttcgtgcacgcgaaggtcatgcacaggggaaccagcaaggtcatagccgtcgccaccaccaacgccaaggacctccggctcaccctcccgtcccttgtcgacgacaatgcctgcaggaccatcgggaggctcatcgccgagaggtcaatggacgccgacgtctttgctctggcctatgagcccaagaagaacgagaggatcgagggcaagctcgggatcgtgattgacactattaaggagcacggcatcatcttcgtctag

SEQ ID NO: 20985 - protein, 189 aa, Sorghum bicolor
  misc_feature: Ceres ANNOT ID no. 8681240
  misc_feature: Up-regulated in shoot tissues in response to methyl jasmonate treatment
  misc_feature: Up-regulated in root tissues in response to methyl jasmonate treatment
MASLHPTTAMLPHRHSPAPSLSASSLSWSAAIAVSRIPPARGLALHPSVPPPASGNRQSPVVCAAWTRRSRGEAEQRPNRKSWKQRTDMYMRPFLLNVFFSKRFVHAKVMHRGTSKVIAVATTNAKDLRLTLPSLVDDNACRTIGRLIAERSMDADVFALAYEPKKNERIEGKLGIVIDTIKEHGIIFV

SEQ ID NO: 20986 - DNA, 1317 bp, Sorghum bicolor
  misc_feature: Ceres ANNOT ID no. 8681229
  misc_feature: Down-regulated in root tissues in response to salicylic acid treatment
  misc_feature: Encodes the peptide sequence at SEQ ID NO 20987
atgccggtggcagcgtcggccatctacttcctcaacctccgcggggacgtcctcatcaaccgcctctaccgtgacgatgtcgggggaaatatggttgatgcattcagaatgcatatcatgcaaacaaaagaacttggcacgtgtcctgttcgccagataggaggctgctccttcctttatatgaggatcagtaatgtttacattgtgattgttgttagcagcaatgctaatgttgcttgtgctttcaaatttgttgtcgaggcagtggctctcttcaagtcctacttcggtggagcttttgatgaagacgctatcaggaataattttgttttgatatatgaacttcttgatgagatcatggattttggttatcctcaaaatctgtcacctgaaatcttgaagttgtatataactcaagaaggtgttcggtcaccattttcctcaaagccctcagacaagcctgttccaaatgcaactcttcaagtcactggtgctgttggttggagaagagagggacttgtgtacaagaagaatgaggttttcttggacatagttgagagtgtaaaccttcttatgtcttcgaaagggagtgttctaagatgtgatgtgacgggaaagattcttatgaaatgcttcctttctggaatgcctgatctgaagctgggactaaatgacaagattggacttgaaaaagaggcccaactaaagtccagaccagcaaagagtgggaagaccattgaacttgatgatgtcacattccaccagtgtgtcaacttaacaagatttaactcagaaaagacagtcagttttgtaccaccagatggtgaatttgaattgatgaagtatcgaatcacagagggtgtaaacctcccattccgtgttctaccaacaatcaaggaattgggccgaacacgcatggagatcaatgtgaaagtcaagagtgttttcggtgctaagatgtttgcacttggtgtcgtcgttaaagttccggttccaaagcagacggctaagactagtttccaaacaacgtcaggcaaagcaaaatacaatgcttcgattgattcactggtgtggaagatcaggaaattccctggacagactgaggcaactatgagcgcagaggtggagttgatctctaccatgggtgaaaagaagtcttggaacagaccacctatccagatggaattccaggttccaatgttcactgcttctggtttacgtgttcggttccttaaggtctgggagaagagtggttacaacactgttgagtgggttcgctacatcacgagagctggttcatatgagataaggtgttag

SEQ ID NO: 20987 - protein, 438 aa, Sorghum bicolor
  misc_feature: Ceres ANNOT ID no. 8681229
  misc_feature: Down-regulated in root tissues in response to salicylic acid treatment
  misc_feature (166)..(438): Pfam ID: Adap_comp_sub Pfam Description: Adaptor complexes medium subunit family
MPVAASAIYFLNLRGDVLINRLYRDDVGGNMVDAFRMHIMQTKELGTCPVRQIGGCSFLYMRISNVYIVIVVSSNANVACAFKFVVEAVALFKSYFGGAFDEDAIRNNFVLIYELLDEIMDFGYPQNLSPEILKLYITQEGVRSPFSSKPSDKPVPNATLQVTGAVGWRREGLVYKKNEVFLDIVESVNLLMSSKGSVLRCDVTGKILMKCFLSGMPDLKLGLNDKIGLEKEAQLKSRPAKSGKTIELDDVTFHQCVNLTRFNSEKTVSFVPPDGEFELMKYRITEGVNLPFRVLPTIKELGRTRMEINVKVKSVFGAKMFALGVVVKVPVPKQTAKTSFQTTSGKAKYNASIDSLVWKIRKFPGQTEATMSAEVELISTMGEKKSWNRPPIQMEFQVPMFTASGLRVRFLKVWEKSGYNTVEWVRYITRAGSYEIRC

SEQ ID NO: 20988 - DNA, 1176 bp, Sorghum bicolor
  misc_feature: Ceres ANNOT ID no. 8681254
  misc_feature: Up-regulated in shoot tissues in response to methyl jasmonate treatment
  misc_feature: Down-regulated in root tissues in response to methyl jasmonate treatment
  misc_feature: Up-regulated in shoot tissues in response to salicylic acid treatment
  misc_feature: Encodes the peptide sequence at SEQ ID NO 20989
atggccggcgacgacggcagcatcgggagcgggagcggcggcggcggcggaggcatcagggacagggaggatgaggtccacgtacagatcgcaggatcgtccaaacctgaaacttcatctactaacggaacagctcctcaaaactcccataccaggcattggcattggtggttgatggtagctctgaacattttcttcctcgttgctggtcagacagcatcgacactccttggtaggttctactacaaccaaggtggaaacagcaaatggatgtccacatttgtccaaaccgctggctttccagtattgtttgtcgccctatatctgttccgttcaaagtcgccttctactcaaacaaccaccagtaaccctgagacttctgtcaccaaaattactcttatatacattgtcttgggcctcatcattgctgccgatgacttgatgtattcctatggcctcttgtaccttcctgtatcaacatattcgctcatatgcgctagtcagctggccttcaatgctgtcttctcttatgtcctgaatgctcaaaagttcactgcattgatcctcaactcggtaatcctccttaccttttctgctgcacttcttggagtcgacgaagattctcagggtactaatggtttgtcgcgtgggaagtacatattgggtttcacattgaccctaggagcctcagccacatactcactaatactctctctaatgcaagtcacatttgagaaggttattaagaaggaaacgttctcagtcgtgttgaatatgcagatatatacagcactagtggcaacaatagcttctcttgttgggttatttgcaagcggtgagtggaagactttagagggagagatgcatgccttcagctcagggaggttgtcatatgtgatgacacttctatggactgctgtatcttggcagatagcttctgtaggagtggtgggtttgatctttgttgtgtcatcactcttttcaaatgtgataagcacactagctctacccatcattccagtttttgctgtgattttcttccacgacaagatgaatggagtgaagattattgctatgttgatggccatctggggatttgtttcatatggataccaattatatattagtgacaagaaagctaggaagacttcagtaagtgtggaggagaattcctaa

SEQ ID NO: 20989 - protein, 391 aa, Sorghum bicolor
  misc_feature: Ceres ANNOT ID no. 8681254
  misc_feature: Up-regulated in shoot tissues in response to methyl jasmonate treatment
  misc_feature: Down-regulated in root tissues in response to methyl jasmonate treatment
  misc_feature: Up-regulated in shoot tissues in response to salicylic acid treatment
  misc_feature (222)..(371): Pfam ID: TPT Pfam Description: Triose-phosphate Transporter family
MAGDDGSIGSGSGGGGGGIRDREDEVHVQIAGSSKPETSSTNGTAPQNSHTRHWHWWLMVALNIFFLVAGQTASTLLGRFYYNQGGNSKWMSTFVQTAGFPVLFVALYLFRSKSPSTQTTTSNPETSVTKITLIYIVLGLIIAADDLMYSYGLLYLPVSTYSLICASQLAFNAVFSYVLNAQKFTALILNSVILLTFSAALLGVDEDSQGTNGLSRGKYILGFTLTLGASATYSLILSLMQVTFEKVIKKETFSVVLNMQIYTALVATIASLVGLFASGEWKTLEGEMHAFSSGRLSYVMTLLWTAVSWQIASVGVVGLIFVVSSLFSNVISTLALPIIPVFAVIFFHDKMNGVKIIAMLMAIWGFVSYGYQLYISDKKARKTSVSVEENS

SEQ ID NO: 20990 - DNA, 2910 bp, Sorghum bicolor
  misc_feature: Ceres ANNOT ID no. 8681396
  misc_feature: Down-regulated in root tissues in response to salicylic acid treatment
  misc_feature: Down-regulated in shoot tissues in response to salicylic acid treatment
  misc_feature: Encodes the peptide sequence at SEQ ID NO 20991
atggagcaggcgcggagcaagagcggcctgaggtcgcacgggtccggcggcaaggcatcgtcgcggccggggtcggggacgctgggatccccggaggaggaaccgatgctggccgaccgcggcggcggcggccgagaggtggtcgtgaagatcgggcgcgcgccgttctctttccatggcgcggacgcaggccgcgacggtgggaaggcggggaatgcgacctccggcaccaactccacggcgaccacgccgcggaccgagagcaggccgaggtcgagcgagaccagctcgcctcggtcaccggccaaggtgtggcgggaggggagctacgagttctggaacaatgatggtggcggcgccggcaccaacggacgacccgccgccgccgaggcgttcagcttcaagaaccgtccgccgcaggcgccgcaggcgtcgtcgccttcgatgtcgccgcccccgcagcagcagcagccgccgccggagggcggcggcgtggacccgcccacgcggctcatcggcaacttcctccggaagcaggcggcgtccggtggggagatgtcgctcgacctcgacctggagatggaggagctcgggaggacggcgcaactgcgcgagcagccatccttctccagctcgctagaaagggacggccgcgtctcgttccaggaaccccagaagcggcactcaacgtcgtccggttcctccgattccgacaccgacgacggccggaagcgccgcggcgacgacggcgaggtcgttcggtgcacgtcctcctctactgcggcgggagcggggccgttgctgcgggtcaagacgcgttccaggctaatggacccgccgccgcagtcgcagcccgcgccggcgccggcatcggcacctgcagcatctcctgtcttcgacgaggagcggaaatcttcaggcttgcggactcctacaaagtccggccgcctcttctccgggcttatgtccggcaacaagtccggccccatgggtggcaagtcaggtcccatcgacgaggaggaggacgacccattcgtggacgaggacatccccgatgaattcaagcgtgggaagcttgacgctttgaccgtcttgcagtggctcggcttgttcctcatcatcgcggccttggcttgcagtctcagcataaagatcttgtccacgaagaaagtgctgggtttgcacctctggaagtggttgctcctcgtgttcgtgctcatctgtggccgtcttgtctccggatgggtcatcaggattgccgtcttcggtgtcgaacgcaacttcttgctgaggaagcgtgtgctctacttcgtgtatggcgtgcgcagcgccgtgcagaacgcgctctggctcggcctggtgcttgcctcttggcacttcttgtttgacaagaacgtccagcaggagacgaactctgcggtgctgccctatgtgacgaagatcttattctgcttccttgttgccacgctcatccgccttgtcaagacattgctggtcaaggtactggcctcatccttccatgtctccacatattttgatcggattcaagaggcattgttcaaccagtacgtcatcgagacactctctgggccgccactagtggatgaaaaccatgtgcttgaggaggtgcatgagctgcaacgtgcaggcgcaactataccaaaggagctgcgtgatgcagtaccaaccaagcatgtgtctgggcaaaggaacattcagttatcaggggtcatgcctaagggagaaggtagcaagcagctgtcaaaggagaaaggggaggggatctctattgatgcacttcataaactcaaccagaaaaacatctcagcttggaacatgaagaggctgatgaggattgttcgatttgggacattaacgactatggatgagcagatacagcaggcaacaggtcagggggatgaatcagcaacacagatacgaagtgaatatgaggcaaagatagctgccaagaagatctttcacaatgtagcaaagccaggttccaagtacatatacttgtcggacatgatgagattcatgaggcaggaagaggctgttaaagcaatggatctttttgaaggagcacaggagcacaacagggtcagcaagaggtctctcaagaactgggtggtgaatgcatttagagagcgtaaagctcttgcccttacacttaatgatacaaaaactgcagtaaacaagctgaaccagatggctaatgtcgttgtggggatcatcgtgtttgctctctggcttcttattctgggaatagcaacaacacatttctttgtcttcctcagttcacagcttctcctggcagttttcgtatttgggaatacattgaagacagtttttgaggcaattgtcttcttgtttgtgatgcatccatttgatgttggtgatcgatgtgaaattgaaggtgttcagatggttgttgaggaaatgaatatcatgacaacggtgtttctccgatatgataacctgaagatatattatccaaacagcgtgcttgcaacaaaaccaattatgaattactacagaagtcctgatatgggagaagcaattgacttctccattcatgttgcaactcctgttgagaaactggccctcatgaaggaacgactactgcgctatattgataacaagaaggaacactggtacccgggtgcgatggttgtactccgagacgtcgatgacaccaacaaactgaaagtatcaatatggctgcggcacacgctcaactggcaggacatgggtatgcggttcgtgaggcgagagctagtgctccaggagatgatcaaagtcctgagggacctcgagattgagtatcggatgctgccacttgatgtgaatgttcgcaatgcgcctgcaattcagtccacaaggatgcctacaacatggagctattcgtga

SEQ ID NO: 20991 - protein, 969 aa, Sorghum bicolor
  misc_feature: Ceres ANNOT ID no. 8681396
  misc_feature: Down-regulated in root tissues in response to salicylic acid treatment
  misc_feature: Down-regulated in shoot tissues in response to salicylic acid treatment
  misc_feature (735)..(935): Pfam ID: MS_channel Pfam Description: Mechanosensitive ion channel
MEQARSKSGLRSHGSGGKASSRPGSGTLGSPEEEPMLADRGGGGREVVVKIGRAPFSFHGADAGRDGGKAGNATSGTNSTATTPRTESRPRSSETSSPRSPAKVWREGSYEFWNNDGGGAGTNGRPAAAEAFSFKNRPPQAPQASSPSMSPPPQQQQPPPEGGGVDPPTRLIGNFLRKQAASGGEMSLDLDLEMEELGRTAQLREQPSFSSSLERDGRVSFQEPQKRHSTSSGSSDSDTDDGRKRRGDDGEVVRCTSSSTAAGAGPLLRVKTRSRLMDPPPQSQPAPAPASAPAASPVFDEERKSSGLRTPTKSGRLFSGLMSGNKSGPMGGKSGPIDEEEDDPFVDEDIPDEFKRGKLDALTVLQWLGLFLIIAALACSLSIKILSTKKVLGLHLWKWLLLVFVLICGRLVSGWVIRIAVFGVERNFLLRKRVLYFVYGVRSAVQNALWLGLVLASWHFLFDKNVQQETNSAVLPYVTKILFCFLVATLIRLVKTLLVKVLASSFHVSTYFDRIQEALFNQYVIETLSGPPLVDENHVLEEVHELQRAGATIPKELRDAVPTKHVSGQRNIQLSGVMPKGEGSKQLSKEKGEGISIDALHKLNQKNISAWNMKRLMRIVRFGTLTTMDEQIQQATGQGDESATQIRSEYEAKIAAKKIFHNVAKPGSKYIYLSDMMRFMRQEEAVKAMDLFEGAQEHNRVSKRSLKNWVVNAFRERKALALTLNDTKTAVNKLNQMANVVVGIIVFALWLLILGIATTHFFVFLSSQLLLAVFVFGNTLKTVFEAIVFLFVMHPFDVGDRCEIEGVQMVVEEMNIMTTVFLRYDNLKIYYPNSVLATKPIMNYYRSPDMGEAIDFSIHVATPVEKLALMKERLLRYIDNKKEHWYPGAMVVLRDVDDTNKLKVSIWLRHTLNWQDMGMRFVRRELVLQEMIKVLRDLEIEYRMLPLDVNVRNAPAIQSTRMPTTWSYS

SEQ ID NO: 20992 - DNA, 1251 bp, Sorghum bicolor
  misc_feature: Ceres ANNOT ID no. 8681505
  misc_feature: Up-regulated in root tissues in response to methyl jasmonate treatment
  misc_feature: Up-regulated in shoot tissues in response to methyl jasmonate treatment
  misc_feature: Up-regulated in root tissues in response to salicylic acid treatment
  misc_feature: Up-regulated in shoot tissues in response to salicylic acid treatment
  misc_feature: Encodes the peptide sequence at SEQ ID NO 20993
atgccaaggaagagcagtaacaataccaagtattacgaggttcttggtgtgtctaagaccgcaagtcaggatgagctaaagaaagcatacagaaaagctgccataaaaaaccatcctgataagggtggagaccctgagaagtttaaagagttgtctcaagcttatgatgttcttagcgacccagagaagagggagatctatgaccagtatggagaagatgcccttaaggagggaatgggaggcggcggcagcagtgatttccatagcccatttgacatttttgagcaactttttccgggttctagcggctttggtggtggctcaagaggacgcagacaaaagcgtggtgaagatgtggtacatactatgaaggtttccttagaagatctgtataacgggacaaccaagaaactatctttatcgcggagtgctttgtgctccaagtgtaagggtaaaggatccaagagtggggcatcaggaacttgccatggttgccgtggtgctggaatgaggacaatcacaagacagataggccctggcatgatccaacagatgaacactgtttgccctgaatgcaaaggatcaggcgagatcataagtgacaaggataaatgcccaagctgtaaaggaagcaaggtagtccaggagaagaaggtcttggaggttcatgtggagaaaggaatgcaacatagccaaaagattgtattccagggtcaagctgatgaagctcctgatacggttacaggagacattgtttttgtcttgcaacttaaagaccatccaaagtttaagaggaagtatgatgacttatatgttgagcacacaatctctctcactgaggcactgtgtggcttccagtttgttcttactcatcttgatggccggcagcttctgatcaaatctaaccctggggaggttattaaaccaggtcaacacaaggccattaatgacgagggtatgcctcagcatgggcgtcctttcatgaagggtcgtctgtttgttgaattcaacgtcgagtttcctgagcctggtgtgctctccactgcccagtgccgatcattggagaagatccttccaccgaaaccagggagccaactgtcagacatggagctggaccagtgtgaggagaccaccctgcatgatgtcaacatagaagaggagatgaggcgcaggcagcagcagaggcggcaggaggcctatgatgaggacgaggaggaggctggaccaagggtgcaatgtgcccagcagtaa

SEQ ID NO: 20993 - protein, 416 aa, Sorghum bicolor
  misc_feature: Ceres ANNOT ID no. 8681505
  misc_feature: Up-regulated in root tissues in response to methyl jasmonate treatment
  misc_feature: Up-regulated in shoot tissues in response to methyl jasmonate treatment
  misc_feature: Up-regulated in root tissues in response to salicylic acid treatment
  misc_feature: Up-regulated in shoot tissues in response to salicylic acid treatment
  misc_feature (133)..(219): Pfam ID: DnaJ_CXXCXGXG Pfam Description: DnaJ central domain (4 repeats)
  misc_feature (10)..(68): Pfam ID: DnaJ Pfam Description: DnaJ domain
  misc_feature (232)..(358): Pfam ID: DnaJ_C Pfam Description: DnaJ C terminal region
MPRKSSNNTKYYEVLGVSKTASQDELKKAYRKAAIKNHPDKGGDPEKFKELSQAYDVLSDPEKREIYDQYGEDALKEGMGGGGSSDFHSPFDIFEQLFPGSSGFGGGSRGRRQKRGEDVVHTMKVSLEDLYNGTTKKLSLSRSALCSKCKGKGSKSGASGTCHGCRGAGMRTITRQIGPGMIQQMNTVCPECKGSGEIISDKDKCPSCKGSKVVQEKKVLEVHVEKGMQHSQKIVFQGQADEAPDTVTGDIVFVLQLKDHPKFKRKYDDLYVEHTISLTEALCGFQFVLTHLDGRQLLIKSNPGEVIKPGQHKAINDEGMPQHGRPFMKGRLFVEFNVEFPEPGVLSTAQCRSLEKILPPKPGSQLSDMELDQCEETTLHDVNIEEEMRRRQQQRRQEAYDEDEEEAGPRVQCAQQ

SEQ ID NO: 20994 - DNA, 1725 bp, Sorghum bicolor
  misc_feature: Ceres ANNOT ID no. 8681590
  misc_feature: Up-regulated in root tissues in response to salicylic acid treatment
  misc_feature: Encodes the peptide sequence at SEQ ID NO 20995
atggccgacgaggcgaaggcgaagggtaatgcggcgttctcggccggccgcttcgaggaggcggcgcggcacttcacggacgccatcgcgctcgccccgggcaaccacgtcctctactccaaccggtcggcggcgctcgcctcgctccaccgctactccgatgcgctcgccgacgcgcacaagaccgtcgagctcaagcccgactgggccaagggctactcccgcctcggcgcggcgcacctcggtctcggcgacgccgccagcgccgtcgcggcgtacgagaagggcctcgcgctcgaccccagcaacgacggcctcaaggcggggctcgacgacgctaagaaggcggccgccgccccgccccgccgcgggccgtccggccccgacggcctcggccagatgttccagggccccgagctgtggagcaagatcgcgtccgaccccaccacgcgcgcctaccttagcgagcccgattttatgcagatgctgcgcgaggtgcagaggaatcccagcagcatcagtatgtacctctccgatccccggatgatgcaggtgctcagcctcatgcttaacgtcaagatccagagacccgaggcctccgagtcgtcgcagtctactccatcgcagccgccgccgcagcagcagcagacgccgcctcctgagacaaaggcgagggaggtagagccggaaccggagccagagccaatggatttaactgatgaggaaaaggatcgcaaggagaagaaagctgctgctcagaaggagaaggagttaggtaacacagcttacaagaagaaggacttcgagacggcaatccagcattacaccaaagccttggaacttgacgatgaggatatttcctatctgactaaccgagcagcagtctacattgagatgggaaagtacgatgaatgcatcaaggattgcgataaggctgtggagaggggaagagagctccgtgctgatttcaagatgatttcaagggcactgacaagaaaaggaacagctctggtcaaacttgctaagacctctaaggattttgatattgccatcgagaccttccagaaggctctaactgagcatcggaacccagacactcttaaaaagttaaatgaggctgagagagcaaagaaagatttggagcaacaagagtattatgatccaaaattagcagatgaggagagagagaaaggtaacgagttcttcaaggagcaaaaatacccagaagcaataaaacactacacagaggctctcaggaggaacccaaaggatcctagggtttacagcaatagggccgcctgctacaccaagttaggagccatgcctgaaggtcttaaagacgcagagaagtgtcttgatctagaccccaccttcaccaaagggtatacaaggaaaggtgcaattcaattcttcatgaaagaatatgacaaggccatggaaacctaccaggctggcttgaagcatgacccaaacaacccggaactgcttgatggtgttaggaggtgtattgaacagatcaacaaggccaacagaggtgaaataagtcaggacgaattgcaagaaagacagaacaaagctatgcaagacccagagatccagaacattcttaccgaccctatcatgcgacaggagaacccaagggcagcccaggagcacctgaagaaccccggagttatgcagaagattcagaagcttgtaagtgctgggatagttcaaatgagatga

SEQ ID NO: 20995 - protein, 574 aa, Sorghum bicolor
  misc_feature: Ceres ANNOT ID no. 8681590
  misc_feature: Up-regulated in root tissues in response to salicylic acid treatment
  misc_feature (391)..(522): SWISSPROT Homolog: EC 3.1.3.16 Phosphoprotein phosphatase
  misc_feature (2)..(35): Pfam ID: TPR_1 Pfam Description: Tetratricopeptide repeat
  misc_feature (70)..(103): Pfam ID: TPR_1 Pfam Description: Tetratricopeptide repeat
  misc_feature (252)..(285): Pfam ID: TPR_1 Pfam Description: Tetratricopeptide repeat
  misc_feature (286)..(319): Pfam ID: TPR_1 Pfam Description: Tetratricopeptide repeat
  misc_feature (391)..(424): Pfam ID: TPR_1 Pfam Description: Tetratricopeptide repeat
  misc_feature (425)..(458): Pfam ID: TPR_1 Pfam Description: Tetratricopeptide repeat
  misc_feature (459)..(492): Pfam ID: TPR_1 Pfam Description: Tetratricopeptide repeat
MADEAKAKGNAAFSAGRFEEAARHFTDAIALAPGNHVLYSNRSAALASLHRYSDALADAHKTVELKPDWAKGYSRLGAAHLGLGDAASAVAAYEKGLALDPSNDGLKAGLDDAKKAAAAPPRRGPSGPDGLGQMFQGPELWSKIASDPTTRAYLSEPDFMQMLREVQRNPSSISMYLSDPRMMQVLSLMLNVKIQRPEASESSQSTPSQPPPQQQQTPPPETKAREVEPEPEPEPMDLTDEEKDRKEKKAAAQKEKELGNTAYKKKDFETAIQHYTKALELDDEDISYLTNRAAVYIEMGKYDECIKDCDKAVERGRELRADFKMISRALTRKGTALVKLAKTSKDFDIAIETFQKALTEHRNPDTLKKLNEAERAKKDLEQQEYYDPKLADEEREKGNEFFKEQKYPEAIKHYTEALRRNPKDPRVYSNRAACYTKLGAMPEGLKDAEKCLDLDPTFTKGYTRKGAIQFFMKEYDKAMETYQAGLKHDPNNPELLDGVRRCIEQINKANRGEISQDELQERQNKAMQDPEIQNILTDPIMRQENPRAAQEHLKNPGVMQKIQKLVSAGIVQMR

SEQ ID NO: 20996 - DNA, 1005 bp, Sorghum bicolor
  misc_feature: Ceres ANNOT ID no. 8681633
  misc_feature: Up-regulated in shoot tissues in response to salicylic acid treatment
  misc_feature: Up-regulated in root tissues in response to salicylic acid treatment
  misc_feature: Encodes the peptide sequence at SEQ ID NO 20997
atggcgtggaagaaattgtctgcttttgaatttgctgcaccaatatcttgtcgctgtcagaaacttattagtagaggccgattttcacgttgtcacatttttggatatcaaagggttgccgttgttacaggagggaatagaggaattggattagaaatatgcaggcaacttgcttccaaaggagtcactgtggtattgacagcgagagacgagaaaaggggtgcagaagcggtcaaaaatcttgtagcgcaggggctatccaacatcctgtttcatcaactggtggttggagatctctcaagcactgcacgtctcgctgattttatccgggagaaatttggcaaactggatatattggtcaacaatgcagcagttgttgggtccataacagaaatcagtgatccagatgcttttaagttagagcttgcaagcatgaatgctcaggaaaggctagaaaggatcaggaggtacaccacagacccttacgaccaagcagaggaggtcttgagaacaaactaccacggcaccaaaattgtcactgaagcacttcttcctctcctagagttctcatcccatggaagagttgtaaatgtaacatctattgttgggctactcaggtttttcagtggtgaggaacttaaaaaggagctcaacaacatcgataacctatctgaagagagattagatgagctgtcagaattgttcctcaaggacttcaagaatggccaactggaaccccatgggtggccagttgaaggagggtaccctgcatataaagtgtccaaggctctcggcaatgcctattcgagaatcattgcaaagaagcacccaacactatgcataaattgtgtgcatccgggctatgtcgacacagacatgaacttccacactggagttctcacggttgaggagggcgcgagaggagcgctgattctggctctcctacccaagggaggcatgaccggagcatacttggactgcacagaggttgcttccttcgtgtaa

SEQ ID NO: 20997 - protein, 334 aa, Sorghum bicolor
  misc_feature: Ceres ANNOT ID no. 8681633
  misc_feature: Up-regulated in shoot tissues in response to salicylic acid treatment
  misc_feature: Up-regulated in root tissues in response to salicylic acid treatment
  misc_feature (38)..(141): SWISSPROT Homolog: EC 1.1.1.184 Carbonyl reductase (NADPH)
  misc_feature (38)..(213): Pfam ID: adh_short Pfam Description: short chain dehydrogenase
MAWKKLSAFEFAAPISCRCQKLISRGRFSRCHIFGYQRVAVVTGGNRGIGLEICRQLASKGVTVVLTARDEKRGAEAVKNLVAQGLSNILFHQLVVGDLSSTARLADFIREKFGKLDILVNNAAVVGSITEISDPDAFKLELASMNAQERLERIRRYTTDPYDQAEEVLRTNYHGTKIVTEALLPLLEFSSHGRVVNVTSIVGLLRFFSGEELKKELNNIDNLSEERLDELSELFLKDFKNGQLEPHGWPVEGGYPAYKVSKALGNAYSRIIAKKHPTLCINCVHPGYVDTDMNFHTGVLTVEEGARGALILALLPKGGMTGAYLDCTEVASFV

SEQ ID NO: 20998 - DNA, 1917 bp, Sorghum bicolor
  misc_feature: Ceres ANNOT ID no. 8681694
  misc_feature: Up-regulated in root tissues in response to salicylic acid treatment
  misc_feature: Encodes the peptide sequence at SEQ ID NO 20999
atggcttcttccgggaccacagcccctggcattccgccctccacaagcgccccgcccggcgccggcgcggttgtgacgacctccgccggcgccctgatcactgccaccacgccgccgccggctgcgtcctccacaccgccagccccaatgctggtcatcccttccgatgcgcttatggccttcaccagcgccatccagggcctccagaaccagatggccctcatgagcttccagatgggcgatctggccacgcgtgtgtcggccctggacggtcgggatctgcctacagccgcgcagttcccacagctgctgatgtcaagcgcgggttatcttccctcgctgcaggcaccgtccttaccgctgggcgtgcatccatctgccccggttcccatccagcagccatggatgctggtgcacacgatggcaagcaccccggcggccacgacaacggttgctccagcaccctccaccagcgctgttatcctccccggtgtatcaaccatccagcatccattcaccgatgggatcttctataggggtgccagcttccagcaggtccgagatgagggcgacatgctgcagcagaccgagcagccgatggcgacggagctgacagggaagatgcttcgctgccaggtgtcggcgacagtgcagctgcaagctgctgtgcgtggcctccttgcacgtcggcgggtgcagaagatgcgcgatctgccgctgattcagccctgcacctatttgcagctccaccatgtggaggactgcgatctcatccgctgcgtcggggattttcagaatgtggttccgcccacgggcagcgtgcatgttgtttttcccgcgggtggtggactcaaagtcttcggcgtcggcagttggaagccctatgctcttctatgtgcggtgcagaccagcagccgtccagcaaggagaaggcatggtgtcatcggtgggagcgcactgcctagcgccgccagattccgccaccgaccaccgcgagggcgccttcgctggtccctgttgcgaccacttcctggaggccacacacaagcacgtatttcatccagatggtctccatgggatccaggtggatggtgtccgctttatgtgcaagggttaaaattatttctagttgagaataataaaacaagccgagatgtaaaaggcttgtttttaggtgttatgtttgtgtcttgcagagtcattcttagtgtcgtcgttaagttgcagctcgaggacgagctgcatgtccaggtggggtgtagtgttagaagagtcaaggacctactgggccttagcccattagggttaattagtcgctttcttaggggtcaaggttctttgattgaaatgacaggccctaagagaggtatcgaaatgagttctattgttctaatagaatttgacatgaggattaagactggaatacaggaggacaatgatcttcaactgattgatggagcattagtatgctcagacggtatttataaaccatggaaaccaattagagagcggattattggcagttcttgtgcagttgatgtaactttagcagttcttgcacatgcggtggaggccacaatagaagttgttgtttcagaactgcagagtggtttaggtttgtctctaagctccttccttgatgacatggatgcctatgaagaaatccagctttttgatggcatcattgctcagtcggggcctctaagaaggttcgtggttgctgtcccgatttataaagtgatgcttttgaaggttaaggttggtaacgttttcaaacatactcaatatggatctgccagtcgagagatcaagtttcaacctaagctacatggatgtacaagacgacagataagacttaaggttgctacgatctcgttgaaggtgacttggtctggtgttcctggtgttgccttatga

SEQ ID NO: 20999 - protein, 638 aa, Sorghum bicolor
  misc_feature: Ceres ANNOT ID no. 8681694
  misc_feature: Up-regulated in root tissues in response to salicylic acid treatment
MASSGTTAPGIPPSTSAPPGAGAVVTTSAGALITATTPPPAASSTPPAPMLVIPSDALMAFTSAIQGLQNQMALMSFQMGDLATRVSALDGRDLPTAAQFPQLLMSSAGYLPSLQAPSLPLGVHPSAPVPIQQPWMLVHTMASTPAATTTVAPAPSTSAVILPGVSTIQHPFTDGIFYRGASFQQVRDEGDMLQQTEQPMATELTGKMLRCQVSATVQLQAAVRGLLARRRVQKMRDLPLIQPCTYLQLHHVEDCDLIRCVGDFQNVVPPTGSVHVVFPAGGGLKVFGVGSWKPYALLCAVQTSSRPARRRHGVIGGSALPSAARFRHRPPRGRLRWSLLRPLPGGHTQARISSRWSPWDPGGWCPLYVQGLKLFLVENNKTSRDVKGLFLGVMFVSCRVILSVVVKLQLEDELHVQVGCSVRRVKDLLGLSPLGLISRFLRGQGSLIEMTGPKRGIEMSSIVLIEFDMRIKTGIQEDNDLQLIDGALVCSDGIYKPWKPIRERIIGSSCAVDVTLAVLAHAVEATIEVVVSELQSGLGLSLSSFLDDMDAYEEIQLFDGIIAQSGPLRRFVVAVPIYKVMLLKVKVGNVFKHTQYGSASREIKFQPKLHGCTRRQIRLKVATISLKVTWSGVPGVAL

SEQ ID NO: 21000 - DNA, 1446 bp, Sorghum bicolor
  misc_feature: Ceres ANNOT ID no. 8681706
  misc_feature: Down-regulated in shoot tissues in response to salicylic acid treatment
  misc_feature: Encodes the peptide sequence at SEQ ID NO 21001
atggcggcggcgccgacggcggaagccatggacgtcgatgcgccggctaggccgctgactacctcctcggcgaccaagtcgcgctcccctcacgacgtcctcgccgagacccgcgcctccatcgagaaggtcgccgcccggatcctcgccatcaagaaagacggcgcccccaagtcggagctccgcgagctcgtcactcagatgtcgctgctcctcgtcacgctacgccaagtgaacagggagatcctgatggaggaggacaaggtcaaggcggagacggaggccgcgaaggcgccggtggactccacgaccctgcagctgcataacctgttgtacgagaagaaccactacgtgaaggccataagggcgtgtctcgactttcagacgaagtacccggggatagagcttgtgcccgaggaggagttccagcgttccgcgccggcagacatccttgagaagaccctcgctgccgatgcctcccacgacgtcatgctcaagcgcctcaactttgagctcgtccagaggaaagagttatgcaagctgcatgagaaattagaacaacagaagagcagcttgctggaaacaattgctaatcagaaaaagttcctttcaagccttccatcacatttgaaatcattgaagaaagcatcattgccagtgcagcaacagttggggatgcaacataccaagaaactaaagcagcaccatgctgctgagttacttcctactccgctttatatagcatacactcagttgctagggcagaaagaagcatttggagagaatattgaagtagagatctcaggaagcacaaaggatgcccaaatatttgctcagcaacaagccaagaaggaaaatgcaggcactctttcaaatggcgacagcagaatggatgatgatgtgattgatgatgaagaagatgctcagagaagaaggtcaagatccaaaaagaatgtggtgaaggaagctaataatccagcagtggcctatcaacttcacccacttaaaattatcctccatgtatatgatactgaagattctggtagcagacgccgtaaactgatcaccctgaggtttgagtacttggcaaagttgaatgttgtttgtgttggaattgaagattcagagggtctagacaataatgtcttgtgcaacctatttccagatgacactggtttagatctgcctcaccagatggctaagatttacgctggggaggttccaaacttcagcgacaaggattcaaggccatacaagtgggcacagcatttaggtggtatcgactttttgcctgaagtgcctccatctgctggggatgattctagcagagcattaagcagtgctgatttgtcatccaggcttgctctatatcgtcagcagaaccgtgcacaggctattttgcagagaatccgcttgcggaaagttgcccagatggctcttatgtga

SEQ ID NO: 21001 - protein, 481 aa, Sorghum bicolor
  misc_feature: Ceres ANNOT ID no. 8681706
  misc_feature: Down-regulated in shoot tissues in response to salicylic acid treatment
MAAAPTAEAMDVDAPARPLTTSSATKSRSPHDVLAETRASIEKVAARILAIKKDGAPKSELRELVTQMSLLLVTLRQVNREILMEEDKVKAETEAAKAPVDSTTLQLHNLLYEKNHYVKAIRACLDFQTKYPGIELVPEEEFQRSAPADILEKTLAADASHDVMLKRLNFELVQRKELCKLHEKLEQQKSSLLETIANQKKFLSSLPSHLKSLKKASLPVQQQLGMQHTKKLKQHHAAELLPTPLYIAYTQLLGQKEAFGENIEVEISGSTKDAQIFAQQQAKKENAGTLSNGDSRMDDDVIDDEEDAQRRRSRSKKNVVKEANNPAVAYQLHPLKIILHVYDTEDSGSRRRKLITLRFEYLAKLNVVCVGIEDSEGLDNNVLCNLFPDDTGLDLPHQMAKIYAGEVPNFSDKDSRPYKWAQHLGGIDFLPEVPPSAGDDSSRALSSADLSSRLALYRQQNRAQAILQRIRLRKVAQMALM

SEQ ID NO: 21002 - DNA, 2955 bp, Sorghum bicolor
  misc_feature: Ceres ANNOT ID no. 8681827
  misc_feature: Up-regulated in shoot tissues in response to salicylic acid treatment
  misc_feature: Encodes the peptide sequence at SEQ ID NO 21003
atggtggacaagaatgatgggtcagagggtcttaaattcaacacgtcaaacctcattcaaacaaccgaagaggttgcaagagcgtttattgctgcggcttcggctgccactgcacagtctgcacggccatctgtagtgtattcatccaaagatgagagtggcagcccaatgcagaagcttcagcagcaattctcgaaaatcatgaaagggtttacgtcctcaccggacctgtcaggaacttacaatccagaagtgcttacaactcaaaagcggcagtggtcgaggtaccagctgaagtcattgggtgataggtgcatcagagaaccatcacatctgttcgagagcatagtgattgttgggcttccacctaacgcagatatccaggagctggaaaacattgcactagggagaaatgatgaagatggaaagagatcaagaaatttatttagcaatagccaccaccaagttcacgcaatatcaaatttggaaccacaggttctttttgcgtaccctccagagaagcctcttccactcaagtacaaggataccctctctttctgccttcccggaggtgtacaggcggtgaccagcgtgccaccacccacgcagccgcccttccttctcctgtgtcacccttgcctgagggagccgctgaaggtctgcgaggatggtggtggcggggtcttcacagctgggcgttcgttggggagcgcttgccccaccccagtgacctggaaggtggcagtgacatggtgggccacatcctcactggggaagggtggatccggtgagccggcgtccgaacccatctgtttctttggcctcagcggcggcgacgacatcgacatgggcggcacagttgagtgtgctgtggcggttttatggccgcggttgtgggggtcaccagttcatgctgtcgaacgtactccttcattcagtgagctgaatgaaatcctcctgggacaggttgctgataactctgcattatatggatgctgtgtgctggttgaagagattgtacagagaccatcaaagttggtatcgatgctaatgaatgacaaacccatctttccacgccggagtcgatacgtggtaactacgccccggtgttattgcatcctgtccaggcttccgttctttgaactgcattttggggtgttgcagagtattcttatggaagaacgtctggagtggctcactgatggtgttagcatgctaacttccttatcgcttgaggaatcctgtgagaacgatatctgtgaaggaactgaagttacagcacagaaacagtatttagatagtaacacaattgatgtggataaatcatctgaatctagcatgggagtttcatcaaaggagctatctgacactgacagcagttttgggtgtagagagaaccagcttgactttgtttctaaagaacaacagcaaaatagttcttgtgataaagagcagagtgatcgtaaaagagaaattatcacttgtgatgcttctgaagtgtctgatcattttgttcctgaagatacatcatctgatcagtctggagctaagcatcatgaacttgattctgcatcaggtatccaggatgaatctggtgcaaagaactgtgatgattctccgaagggaaatgtggatgatgaggagcttgatctcttcattaccgatactattttaccacttatgcgatctcgcctttgtgaagattgtgaatcatctccaagttcacagggttctccttctagaaatttcgacacccaggaatcggattcagaggagccatcttccatcggtgatggggacttagttagacacaacaacatactgcagtgggctaaggcaaaaaaatatggttctttgcaagttgtctgtcaatactaccagttacagtgtcctgctaggggttcatcacttacttttcatcccttggagcatttgcatcctttgagttttcaccggccaggtgaaacagttcttcacattgctggttctactattgagcttaggtcacgcgatacaagcttagaagttgctgagatgcgtaattcactcttcgctgaggaggaatcgactgctttatccacatgggcggtggcatccatttgtggatgcctaaggttggaacatgtcttgcctaatgacatgatggattttctggatgccccagttccatacatagtgggtgtacaaaacaagacatctgatgtgctcaacaggctaccaaatgccgtggtcattgatgccaacaggaatcagatcgacaatggggagaggaagatgaagtgtggggaccggggagcaaagaaatcatgcagcatcttacgaactgaagaagaagaggagatcgatgggatttactcacaggatctggatcgggaagaactgaagaagaggagcagacgcgcggctccgcggctgagcagggacagtgctcgtcgccgtcgagcgggcgtcgcggccttgtggcttcacccgtcgcggaagaggtggcgcgagtcaggcgactgcgcgtccgtcccagttagggcgatagaaacagacatatgggcctccttagtgcttgatacgtatctggcaaacattaaatcttcttcagttccgcaactaccacagcacagagagttgctttctgccttgcgcccgtatcattcaatacttgttggcgaaagttatcttgcaagaaaacgtcctgtttacgaatgcacagatgcccaggtggaagcggccaaaggtttcttggcagtgcttagagactaccttgacacactatgctcgaacttgagatctcatacaattaccaatgtgcaatctaacaatgacaaggtttccttacttttaaaagagagctttatcggttctttcccaatccgggataggccttttatgaagctttttgtggacacgcagttgttctcagtacagacagacctagttctctccttttatcagaaggactaa

SEQ ID NO: 21003 - protein, 984 aa, Sorghum bicolor
  misc_feature: Ceres ANNOT ID no. 8681827
  misc_feature: Up-regulated in shoot tissues in response to salicylic acid treatment
MVDKNDGSEGLKFNTSNLIQTTEEVARAFIAAASAATAQSARPSVVYSSKDESGSPMQKLQQQFSKIMKGFTSSPDLSGTYNPEVLTTQKRQWSRYQLKSLGDRCIREPSHLFESIVIVGLPPNADIQELENIALGRNDEDGKRSRNLFSNSHHQVHAISNLEPQVLFAYPPEKPLPLKYKDTLSFCLPGGVQAVTSVPPPTQPPFLLLCHPCLREPLKVCEDGGGGVFTAGRSLGSACPTPVTWKVAVTWWATSSLGKGGSGEPASEPICFFGLSGGDDIDMGGTVECAVAVLWPRLWGSPVHAVERTPSFSELNEILLGQVADNSALYGCCVLVEEIVQRPSKLVSMLMNDKPIFPRRSRYVVTTPRCYCILSRLPFFELHFGVLQSILMEERLEWLTDGVSMLTSLSLEESCENDICEGTEVTAQKQYLDSNTIDVDKSSESSMGVSSKELSDTDSSFGCRENQLDFVSKEQQQNSSCDKEQSDRKREIITCDASEVSDHFVPEDTSSDQSGAKHHELDSASGIQDESGAKNCDDSPKGNVDDEELDLFITDTILPLMRSRLCEDCESSPSSQGSPSRNFDTQESDSEEPSSIGDGDLVRHNNILQWAKAKKYGSLQVVCQYYQLQCPARGSSLTFHPLEHLHPLSFHRPGETVLHIAGSTIELRSRDTSLEVAEMRNSLFAEEESTALSTWAVASICGCLRLEHVLPNDMMDFLDAPVPYIVGVQNKTSDVLNRLPNAVVIDANRNQIDNGERKMKCGDRGAKKSCSILRTEEEEEIDGIYSQDLDREELKKRSRRAAPRLSRDSARRRRAGVAALWLHPSRKRWRESGDCASVPVRAIETDIWASLVLDTYLANIKSSSVPQLPQHRELLSALRPYHSILVGESYLARKRPVYECTDAQVEAAKGFLAVLRDYLDTLCSNLRSHTITNVQSNNDKVSLLLKESFIGSFPIRDRPFMKLFVDTQLFSVQTDLVLSFYQKD

SEQ ID NO: 21004 - DNA, 2583 bp, Sorghum bicolor
  misc_feature: Ceres ANNOT ID no. 8681859
  misc_feature: Down-regulated in shoot tissues in response to salicylic acid treatment
  misc_feature: Encodes the peptide sequence at SEQ ID NO 21005
atggtaatagatggactacctgctgaatttgtacttgggagaggcaggaaacctccaagcaaagaaatgatggagtctatgccatacactcagtctttgttagctggttgcaaagcagcagcttaccatgccaaggctgcacctcccactgtcacaatgccccgactaaaagctatggtatctggggcaattggcggttttctagacgtagcatttaatttcaatactcaagccttcttagaggacaatcttcttgatcagcttcatatgattggtttgaagttagtgatgctgggagatgagacatggatcaaattgttcccaacactattcactagacaagatggagtgagcagtttttatgtgaaagatacagttgaggttgatttcaacgtttcacgccacttagaatttgagcttgctgcaaaagactggagtgtcttggttcttcactatctaggcttagaccatgttggacatataggtggccgccggagtgttttgatgacccaaaagatgaaggagatggatgatgtcattagacgggtgcatgctgcgagccttctggataatatgaacagaacacttttcgttgtggttagcgatcatggcatgactgaagggggtaatcatggaggatcttcatatgaagaaactgattcacttgccctttttataggacacagtgttgagagcccatattgttcaccctatgaccagaatgaagcacttcaagtggatcttgccccgactcttgctcttctacttggtgtaccaattccgaagaataattttggtgttgtgcttccagagcctttaaactcgttgacagatgaccagaaactaaggatgttagagcttaactcatggcaaatcttaagattgctgcaagcacaagtacctgccttctgccttgaagaatgtattaattcggagggcagcattgtacttgacatccttcatgaatctattgagaaaaaattgtgccatttactttctaaagccttttcttctcatcaatcctcacgtcttcatcgaggttctgatttcaagtctgttcaagctgggtactatggaactgctgcagataactactatggcttcttaagatatgcgagtgagtggttgtctcacagagcaaccgataaaccattatatttactggtctctgcaatcctgctgatgacggtgtcatgccttttcctcatgagcactgtgtcttgcctacttaagggacggtctctgagtcaagttgatcaacattcagagtcatatttggatcaacgctgccaccttgatgaggttcttgttcttgctgggatgtttctctatgtcatcagtcttggttcaagttcttttgtggaagaagagcagtatacatggcactttctcacttctactctgtatttaatatttctgaccaaggcaatccattcaatgctaaaaggatcaaatccaacacttggtcataaagcagaagagagctttgacaaaagtaacttttcctatgctacaagctttgaattaaccccgggcaagagaaatgtttacaagttatgtactatccttattgttcttgttgctgggagagttataagagcttggcatcaaggtgggatcaactgggttcactttcctgatatttcaaagttactggcgcaagctgactcttctgttgtgaagtctctgcagattatctcatttcttgcagttgtggtattgttttcagtttcactcactttactcagagcaagatcaaagtttgttataggagtatggttgacccacattttttgtggatttttggttctgctgcatatctgcgcaaatcaaatcagtacttcattaccaattaaccatagcacagcatcaatagctcgacagttttatgtgattgctagtgtttcaatatctgccactgttcttgcttcaccttgggtatttccaatattttccacggaagcagaatcagcatcctctggttctagtcctgtaaaggctatacatggcatcagaaattcactttttctcactggaataacatatacagcgttctggggccttctgcagttgcttcttcaacaaccaatcaatttcttgggaatggctggtcactttggtcttgggaatacaaatagccttgccagcattgatgttgctggagcattcattggcatttcaagttactccacagttctttctggtatactgatgtttatgataacatatgcatcacctctgatgttataccttgggttggtccttcatgtatcggtgaaagatattgatgatatctctactctacggcacttgaaatggagctatattctagacaaaatggtcacattgccatgtttgtttcctttgctcattaattctcttgcgttgacttcatacaccattgttttgctactcatgaggaatcacttatttgtttggagcgtattttcaccaaagtacctctatgtctgcgcagcaacagtgtgcacgtatgtcggagtattcgtcatagctatgactgcagtctacaattgcgctgtttttaagttcagggcgcgaagctacagggataaatcccagtga

SEQ ID NO: 21005 - protein, 860 aa, Sorghum bicolor
  misc_feature: Ceres ANNOT ID no. 8681859
  misc_feature: Down-regulated in shoot tissues in response to salicylic acid treatment
MVIDGLPAEFVLGRGRKPPSKEMMESMPYTQSLLAGCKAAAYHAKAAPPTVTMPRLKAMVSGAIGGFLDVAFNFNTQAFLEDNLLDQLHMIGLKLVMLGDETWIKLFPTLFTRQDGVSSFYVKDTVEVDFNVSRHLEFELAAKDWSVLVLHYLGLDHVGHIGGRRSVLMTQKMKEMDDVIRRVHAASLLDNMNRTLFVVVSDHGMTEGGNHGGSSYEETDSLALFIGHSVESPYCSPYDQNEALQVDLAPTLALLLGVPIPKNNFGVVLPEPLNSLTDDQKLRMLELNSWQILRLLQAQVPAFCLEECINSEGSIVLDILHESIEKKLCHLLSKAFSSHQSSRLHRGSDFKSVQAGYYGTAADNYYGFLRYASEWLSHRATDKPLYLLVSAILLMTVSCLFLMSTVSCLLKGRSLSQVDQHSESYLDQRCHLDEVLVLAGMFLYVISLGSSSFVEEEQYTWHFLTSTLYLIFLTKAIHSMLKGSNPTLGHKAEESFDKSNFSYATSFELTPGKRNVYKLCTILIVLVAGRVIRAWHQGGINWVHFPDISKLLAQADSSVVKSLQIISFLAVVVLFSVSLTLLRARSKFVIGVWLTHIFCGFLVLLHICANQISTSLPINHSTASIARQFYVIASVSISATVLASPWVFPIFSTEAESASSGSSPVKAIHGIRNSLFLTGITYTAFWGLLQLLLQQPINFLGMAGHFGLGNTNSLASIDVAGAFIGISSYSTVLSGILMFMITYASPLMLYLGLVLHVSVKDIDDISTLRHLKWSYILDKMVTLPCLFPLLINSLALTSYTIVLLLMRNHLFVWSVFSPKYLYVCAATVCTYVGVFVIAMTAVYNCAVFKFRARSYRDKSQ

SEQ ID NO: 21006 - DNA, 2364 bp, Sorghum bicolor
  misc_feature: Ceres ANNOT ID no. 8681847
  misc_feature: Up-regulated in shoot tissues in response to methyl jasmonate treatment
  misc_feature: Up-regulated in root tissues in response to methyl jasmonate treatment
  misc_feature: Up-regulated in root tissues in response to salicylic acid treatment
  misc_feature: Up-regulated in shoot tissues in response to salicylic acid treatment
  misc_feature: Encodes the peptide sequence at SEQ ID NO 21007
atggcgaggatcaggggcccgcgcctcgccgtcctgctcgctctcgccgtcctcgccgccgtggccgtggccgcggtcgccgcggcggcggcggcagaggagcgcgcgcagtccacctacatcatccacctgtcaccaggccacccggcgctgtccgccgcgcgcgccaacggcggcggcgaggcggtgctccgccgcctcctcccgcgccgcctgcgggcgccgaggccgcgcgtgctctactcctaccagcacgctgccacgggcatcgccgcgcggctgacgcccgagcaggctgcgcacgccgcggctggggagggcgtcctggccgtgtaccccgacaaggtgcggcagctgcacaccactcacaccccgtcgttcctaggcctgaccgagaccgccgggctcctcccagccgcggcgggaggcgcgtcgtctgccgtcgtcggcgttctcgacaccggcctctaccccatcggccggggctcgttcgcggcaactgctgggctcggcccgccgcccgcgtccttctccggcggatgcgtctccgcggcctccttcaacgcgtccgcctactgcaacagcaagctcatcggcgcaaagttcttctaccagggctacgaggctggtctcggccaccccatcgatgagaccaaggagtccaagtcgccgctggacactgagggccatggcacgcacaccgcctccacggcggctggctcgccggtgcccggcgccggattcttcgactacgccaaggggcaggccgtgggcatggaccccggcgcgcgcatcgcggtgtacaagatctgctgggcgtccggatgctacgactcggacattctcgccgccatggacgaggccgtcgccgacggcgtcgacgtcatctcgctctccgtcggcgccaacgggtacgcccctcgcttctacaccgattccatcgccatcggcgctttccacgcggtgcgcaagggcatcgttgtctcctgctccgccggcaactccggccccggcgagtacaccgccgttaacattgcgccgtggatcctgaccgtcggcgcgtccaccatcgaccgcgagttccccgccgatgtggttctcggcgacggccgcgttttcggcggcgtgtctctgtacgccggcgaccccctggactccacccagttgccgctggtgttcgccggggactgtggttcccgcctgtgcctgataggagagctcgacccgaagaaggtggccggcaagatcgtgctatgtcttcgtggtaacaatgctcgcgttgagaaaggtgcggctgtcaagctcgccggtggggtcggaatgatcctcgccaacaccgaggagagcggcgaggagctcatcgccgactcccacctcgtgccggcgactatggtcgggcagaagttcggcgacaagatcaggtattacgtccagacggacccgtcgccgacggcgaccatcatgttccgcggcacggtcatcggcaagtcgccgtcggcgccgcaggtggcggcgttctcgagccgaggccccaactaccgcgcgccggagatcctcaagcccgacgtcatcgcccccggcgtcaacatactcgcggcgtggaccggcgccgcctccccaaccgatctggacatcgacacgaggcgcgtcgagttcaacatcatctccgggacgtccatgtcctgcccgcacgtgagcggcctcgccgcgctgctccgccaggcgcacccggagtggagccccgcggcgatcaagtcggcgctcatgaccacggcgtacaacctggacaactcaggggagaccatcaaggacctcgcgacgggcgtggagtcgacgccgttcgtccgtggcgccggccacgtcgaccccaacgccgccctcgacccggggctggtgtacgacgccggcatcgacgactacgttgccttcctctgcacgctcgggtactctccgtcgttgatctccatcttcacacaggacggctcggtcgccaactgctcgaggaaattcgctcgctccggcgacctcaactaccctgccttcgccgccgtcttctcctcctaccaagactcggtcacctaccaccgggtggtgcgcaacgttggcagcaactccagcgcggtgtacgagcccaagatcgtcagcccgtccggcgtggatgtcacggtgagcccgagcaagctcgtgttcgacgggaagcagcagagcctaggctacgagatcaccatcgcggtgtcaggcaacccggtgatcgtggacgtcagctactcgttcgggtccatcacctggagcgacggtgcgcacgacgtcaccagccccattgccgtgacctggccgtccaacggtggagcagcagccatgtag

SEQ ID NO: 21007 - protein, 787 aa, Sorghum bicolor
  misc_feature: Ceres ANNOT ID no. 8681847
  misc_feature: Up-regulated in shoot tissues in response to methyl jasmonate treatment
  misc_feature: Up-regulated in root tissues in response to methyl jasmonate treatment
  misc_feature: Up-regulated in root tissues in response to salicylic acid treatment
  misc_feature: Up-regulated in shoot tissues in response to salicylic acid treatment
  misc_feature (81)..(592): SWISSPROT Homolog: EC 3.4.21.25 Cucumisin
  misc_feature (382)..(477): Pfam ID: PA Pfam Description: PA domain
  misc_feature (38)..(120): Pfam ID: Subtilisin_N Pfam Description: Subtilisin N-terminal Region
MARIRGPRLAVLLALAVLAAVAVAAVAAAAAAEERAQSTYIIHLSPGHPALSAARANGGGEAVLRRLLPRRLRAPRPRVLYSYQHAATGIAARLTPEQAAHAAAGEGVLAVYPDKVRQLHTTHTPSFLGLTETAGLLPAAAGGASSAVVGVLDTGLYPIGRGSFAATAGLGPPPASFSGGCVSAASFNASAYCNSKLIGAKFFYQGYEAGLGHPIDETKESKSPLDTEGHGTHTASTAAGSPVPGAGFFDYAKGQAVGMDPGARIAVYKICWASGCYDSDILAAMDEAVADGVDVISLSVGANGYAPRFYTDSIAIGAFHAVRKGIVVSCSAGNSGPGEYTAVNIAPWILTVGASTIDREFPADVVLGDGRVFGGVSLYAGDPLDSTQLPLVFAGDCGSRLCLIGELDPKKVAGKIVLCLRGNNARVEKGAAVKLAGGVGMILANTEESGEELIADSHLVPATMVGQKFGDKIRYYVQTDPSPTATIMFRGTVIGKSPSAPQVAAFSSRGPNYRAPEILKPDVIAPGVNILAAWTGAASPTDLDIDTRRVEFNIISGTSMSCPHVSGLAALLRQAHPEWSPAAIKSALMTTAYNLDNSGETIKDLATGVESTPFVRGAGHVDPNAALDPGLVYDAGIDDYVAFLCTLGYSPSLISIFTQDGSVANCSRKFARSGDLNYPAFAAVFSSYQDSVTYHRVVRNVGSNSSAVYEPKIVSPSGVDVTVSPSKLVFDGKQQSLGYEITIAVSGNPVIVDVSYSFGSITWSDGAHDVTSPIAVTWPSNGGAAAM

SEQ ID NO: 21008 - DNA, 4701 bp, Sorghum bicolor
  misc_feature: Ceres ANNOT ID no. 8681991
  misc_feature: Down-regulated in shoot tissues in response to salicylic acid treatment
  misc_feature: Encodes the peptide sequence at SEQ ID NO 21009
atgcaggtgagagtttgtaatgggaaaccagtgaccattgtggcatcccaagaaggattctatcctgcagggaagcgtgcactcatcagccgctcccttgttggactgttgcagcagacaagccgtgcatttgatggagcctacaagtctctgatgaaggcatttgtcgagcacaacaagtttggaaatcttccttatggattccgatcaaacacatgggtagttccccctgttgttgccgattcaccatcagtgttcccacctctcccaactgaagatgaaacctggggtggcagtggtggtggtcaaggaagagatggaaagcacgatcatagaccatgggtgaaagaattttccatccttgctgcaatgccttgcaaaacagctgaggagaggcaagtcagagatagaaaggctttcctactccacagtttatttgtggatgttgcagtcctcaaagctgttgcatctattcagcaactgatttccaaccatgcgagtttacatgaaacaacaaatggcaccatcggttctgttttgcacaccgagcaagtaggtgatatgaaaataatgatcacaaaggacaaaacagatgcaagctccaagctagatgttaaattggatggaagtcaggctccagggatgtcttctgatgagcttgctcagagaaacttgttgaaaggcatcactgctgatgagagtgcaatagtacatgacacagccactcttggtgtggttattgtaaagcattgtgggtatacagctgttgtccaagttccagtaaatactgaactgacaacttctgtcgcacaacaggagatccacattgaagaccagcctgaaggaggtagcaatgctcttaatgtcaatagcttaaggatgctgcttcataaatcatgtgctcaagtacctggagttcaacggttgcagaccagtgatcctcaagacaatgcgactactcaaacttttgtccggaagatattgacggacagcctgcagaagcttgaaagtgaggctccgatagtaacaagacctatcagatgggaacttggtgcttgttgggtacaacatctacagaacccaacttccgaaaagacagagactaagaaaagtgacgagactaaggatgtccctacagtaaagggtctgggtaaacaatttggtcagttaaaggagataaaaaagaagacagatgacaagggtggaaaaaatacatatgtaaaagaaaacacttcacctaatacagataatgggcatacagacaacactgccaacataaaggatgataaggatgttgttcttcagaaactgcttccagaagcagctttccaaaggctgaaggaatcagaaactggacttcatgctaagtcactggatgaactgattgagatgtcacacaagtattatgatgataccgcgctgcccaaattggtcgcagattttggctcacttgagctttcccctgttgatggaaggacattaacagactttatgcacactaggggcctccagatgcggtcactgggacgagtggttgagctttctgataagcttccacatatacagtccctgtgtatacatgagatggtagttcgagcatttaagcacattgttcgggctgttattgcagctgttgatgatgtaaatgacatggcagactcggttgcatcatgtttaaatattttgctgggaccattcctggaggaaaataatgacggtgattgtggtgaggatcataatctcaggaaaaggtggctggaggtctttttgataaagagatttggttggaagtggaaagatgaatattgtcttgatctaagaaaatatgccattctccgtggtctctgccataaggtaggacttgagttagtaacaaaagattatgacatggatatgccacatccattcagaaagtcggatattatcagtgttgttcctatctacaagcatgttgcatgctcatcagctgatggccgcaccctgctggagtcatccaagactttcctggataaagggaaacttgaggatgctgttaactatggcacaaaggctcttgcaaaacttgttgctgtttgtggtccttatcatagaatgacggcaggagcgtacagccttcttgcagtagtgctttatcatactggggatttcaaccaggcaaccatctatcagcagaaggctttagatattaatgagagggaacttggacttgaccatccagatacaatgaaaagctacggagatcttgctgttttctactatcgtctgcaacatacagaactggcattaaagtatgtcaaccgtgccctatatcttttgcaccttacatgtggcccttctcatcctaacaccgctgcaacttatatcaatgttgcaatgatggaagaagggttgggcaatgtccatgttgcactccgttacctgcacgaagctctaaaatgtaaccaacggttgcttggcgctgatcacatacagacggcagcaagttatcatgctattgctattgctttgtctttaatggaagcatactcattgagtgtccaacatgaaaagactactctacggatacttcaagcaaagcttggatcagaggatcttcggacccaggatgcttctgcttggctggaatactttgaatccaaggcactagagcagcaggaagcagcacgtaatggtactccaaagcctgatgcttcaatagcaagcagaggacatctgagtgtatcagatcttttggattatatcaacccggatgatgaactcaaggctaaggaaatgcaaaggaaacaagcccgtgctaagatcaaaggtcgcattgggcaaaaccactctgaacttgttgatgatgaagatcgaaggagccccccacctaaaaatgataatttgttaaccgagaatgaaaactctggagtaaaagagaatggaacctttgttgagtatgtgaaagtgaatgataaaatatcaagtgacactgcaatccgcatacctcaagatgattttactgaagagtacacatctgatgaggggtggcaagcggctgttccaaagggacgatccactggaagccgcagaactggtgcaggcacgaggaggccaaatctggcaaaaattaatactaattcactacacagtgagaatggaagatacaaaggaagaggtacatccaacttctcttcccctcgagtttcacctagtgaggctacagttcctatgggttctagtcctcttgcgaagaaattagcgaagagttcaagcttcaattccaaagcaggtagcccttctgtctcatcgaacagtggtgataattcttccaatcccaactccaagccagcaagccctgccattgccacagctgctgtcaaggtgataccatccacagcaccaagtgccagtcaaacagtaaggaagtcactttcatacaaggaggtagcaatagctgcaccagggactcttgtcaaagcatttagtgatgtacacacagaagaaaaagatgcaggtggccgaggtgcaagtcctgaaagtgccaagtcccaaaaagaaatcaatggtcacccttctggagagaaagatggggcaatagaagtgtcaccaaaggctgatacttcacaagtgactaaatcatctgatggaggtaaaccagagcaaactgatgttttgattggttcaaatcaaccagaaacaggacataaaaagacctcagatccagcagagacatctgtagcacagaagtacacagatcttcctgccccagtcacatcatctgcagcacaaactgaggaggttggcaccccaaatgaggaagcaccaactgtaattgaggcaaatgattcttcctccaatgacgatgaaagagattcaggagaggatacaccaggacagctgtcgagtggaggtgaaaatgagaaatcttcactatctgagagtgaaaagaatgatacaccaagagaaggtgctaaagagacaagtaaactttctgctgctgcggttccattcaatccatccactgtaccagcttttggttcaatggctgtcccaggtttcagagaacatggagggctgttgccatcaccagctaatgtgccccctatgttgtccatccctctacgtaagcaccctcaccaatctgcaactgcaagggtaccttatggtccacgtctggctggaggctacaatagatcagggcaccgaggacttcgtaagaagcctgtgttgacaagtggtgaagcccctacagaaacaaacacgtctgcccccaaggttatgaaccctaatgccccggagtttgttccaggtcaatctcggagtcctaatggtcatccagcatctccaaatggtcctttatcatcaccaggtggtattccatcttcaccacaagaccttctatcatctccagatagtactgtggagtcaccagtaactccatccccacaagtttctgaatgtagccagattagtcctgaaggaaatgatgcatctagtggaataaatgttgagggtgggggtgtaaagcagaacgtggatgacacgaaccacacaaaaagtaaagatggtgaagtggagcctgatcaaaccaaagctcctgaagttacagaagaaggggcggcggtaaaagatgctactgaagagtcgattgcagccgagcagcccaaatcctgggctgactacagcgatggagaggctgaggtcgttgaggttgcaagctaa

SEQ ID NO: 21009 - protein, 1566 aa, Sorghum bicolor
  misc_feature: Ceres ANNOT ID no. 8681991
  misc_feature: Down-regulated in shoot tissues in response to salicylic acid treatment
  misc_feature (700)..(733): Pfam ID: TPR_2 Pfam Description: Tetratricopeptide repeat
MQVRVCNGKPVTIVASQEGFYPAGKRALISRSLVGLLQQTSRAFDGAYKSLMKAFVEHNKFGNLPYGFRSNTWVVPPVVADSPSVFPPLPTEDETWGGSGGGQGRDGKHDHRPWVKEFSILAAMPCKTAEERQVRDRKAFLLHSLFVDVAVLKAVASIQQLISNHASLHETTNGTIGSVLHTEQVGDMKIMITKDKTDASSKLDVKLDGSQAPGMSSDELAQRNLLKGITADESAIVHDTATLGVVIVKHCGYTAVVQVPVNTELTTSVAQQEIHIEDQPEGGSNALNVNSLRMLLHKSCAQVPGVQRLQTSDPQDNATTQTFVRKILTDSLQKLESEAPIVTRPIRWELGACWVQHLQNPTSEKTETKKSDETKDVPTVKGLGKQFGQLKEIKKKTDDKGGKNTYVKENTSPNTDNGHTDNTANIKDDKDVVLQKLLPEAAFQRLKESETGLHAKSLDELIEMSHKYYDDTALPKLVADFGSLELSPVDGRTLTDFMHTRGLQMRSLGRVVELSDKLPHIQSLCIHEMVVRAFKHIVRAVIAAVDDVNDMADSVASCLNILLGPFLEENNDGDCGEDHNLRKRWLEVFLIKRFGWKWKDEYCLDLRKYAILRGLCHKVGLELVTKDYDMDMPHPFRKSDIISVVPIYKHVACSSADGRTLLESSKTFLDKGKLEDAVNYGTKALAKLVAVCGPYHRMTAGAYSLLAVVLYHTGDFNQATIYQQKALDINERELGLDHPDTMKSYGDLAVFYYRLQHTELALKYVNRALYLLHLTCGPSHPNTAATYINVAMMEEGLGNVHVALRYLHEALKCNQRLLGADHIQTAASYHAIAIALSLMEAYSLSVQHEKTTLRILQAKLGSEDLRTQDASAWLEYFESKALEQQEAARNGTPKPDASIASRGHLSVSDLLDYINPDDELKAKEMQRKQARAKIKGRIGQNHSELVDDEDRRSPPPKNDNLLTENENSGVKENGTFVEYVKVNDKISSDTAIRIPQDDFTEEYTSDEGWQAAVPKGRSTGSRRTGAGTRRPNLAKINTNSLHSENGRYKGRGTSNFSSPRVSPSEATVPMGSSPLAKKLAKSSSFNSKAGSPSVSSNSGDNSSNPNSKPASPAIATAAVKVIPSTAPSASQTVRKSLSYKEVAIAAPGTLVKAFSDVHTEEKDAGGRGASPESAKSQKEINGHPSGEKDGAIEVSPKADTSQVTKSSDGGKPEQTDVLIGSNQPETGHKKTSDPAETSVAQKYTDLPAPVTSSAAQTEEVGTPNEEAPTVIEANDSSSNDDERDSGEDTPGQLSSGGENEKSSLSESEKNDTPREGAKETSKLSAAAVPFNPSTVPAFGSMAVPGFREHGGLLPSPANVPPMLSIPLRKHPHQSATARVPYGPRLAGGYNRSGHRGLRKKPVLTSGEAPTETNTSAPKVMNPNAPEFVPGQSRSPNGHPASPNGPLSSPGGIPSSPQDLLSSPDSTVESPVTPSPQVSECSQISPEGNDASSGINVEGGGVKQNVDDTNHTKSKDGEVEPDQTKAPEVTEEGAAVKDATEESIAAEQPKSWADYSDGEAEVVEVAS

SEQ ID NO: 21010 - DNA, 1563 bp, Sorghum bicolor
  misc_feature: Ceres ANNOT ID no. 8681971
  misc_feature: Up-regulated in shoot tissues in response to methyl jasmonate treatment
  misc_feature: Encodes the peptide sequence at SEQ ID NO 21011
atggcgtgtggggcggtggccaacatcgtgaaatcctcgctcggccccgtcggactcgacaagatgctagtggacgatattggtgatgttacaatcactaatgatggagcaaccatacttaagatgttggaagttgagcacccagctgccaaggttcttgttgagttggctgagctccaagaccgtgaggtaggagatggaacaacttctgttgttatcatagcagcggagttgctcaagagaggcaacgatcttgtgaagaataagatccatccaacctctataatcagtggctacaggcttgctatgcgtgaagcctgcaaatatgttgaggaaaagttggcagtcaaggttgacaaacttggaaaagactcccttatcaactctgcaaaaactagcatgtcttcgaaattgattaatagtgacagtgatttctttgcaactctggttgttgaagctgtccaggctgtgaagactacaaatgccaagggagaagtgaaatatccaatcaagagcatcaatattttgaaagctcatggtaaaagcgccaaggatagttacctgctaaatggctacgcactaaacacaggccgtgcagctcaaggaatgcctacaagagtaactcctgctagaattgcttgtcttgattttaatcttcagaagacaaaaatgcaacttggtgtccaagttctcgtaactgatccaagggagcttgagaagattcgtcagagagaatctgacataatgaaggagcgaattgagaaaattctcaaggctggagctaatgttgtgttgaccaccaagggaattgatgatatgtccttgaagtactttgttgaggctggagcgattgcagtaaggcgtgtgcgcaaggaagatttgcgccatgttgccaaagccactggtgcaactatggtgagtacatttgcagacatggagggtgaagaaacatttgatgcatcattccttggacatgctgatgaagttgtggaggaaagaattgctgatgatgatgttattctggtgaaaggcacaaagaacactagcgcggtctctataatacttagaggtgcaaatgacttcatgcttgatgagattgaccggtccttgcatgatgccctgtgcattgtgaagagaaccctggaatcaaatatggttgttgctggtggtggtgcagttgaggctgcgttgtcagtttacctggagaaccttgcaacgaccctaggttctcgggaacaactggcaattgctgaatttgctgaatctttgttaatcataccaaaggtactatctgttaatgctgcaaaagatgcaactgagcttgtagcaaagcttagggcatatcatcatactgctcaaacaaaggccgataagcaacattattcaagtatgggtcttgacctctccaaaggtatcattcgcaacaaccttgagtatggcgtgatagagccatcaatgagtaaagtgaagattattcagtttgctacggaggctgccattacaatcctgaggattgacgacatgatcaagcttaccaaggaagagggtaacgaagaagagtaa

SEQ ID NO: 21011 - protein, 520 aa, Sorghum bicolor
  misc_feature: Ceres ANNOT ID no. 8681971
  misc_feature: Up-regulated in shoot tissues in response to methyl jasmonate treatment
  misc_feature (6)..(513): Pfam ID: Cpn60_TCP1 Pfam Description: TCP-1/cpn60 chaperonin family
MACGAVANIVKSSLGPVGLDKMLVDDIGDVTITNDGATILKMLEVEHPAAKVLVELAELQDREVGDGTTSVVIIAAELLKRGNDLVKNKIHPTSIISGYRLAMREACKYVEEKLAVKVDKLGKDSLINSAKTSMSSKLINSDSDFFATLVVEAVQAVKTTNAKGEVKYPIKSINILKAHGKSAKDSYLLNGYALNTGRAAQGMPTRVTPARIACLDFNLQKTKMQLGVQVLVTDPRELEKIRQRESDIMKERIEKILKAGANVVLTTKGIDDMSLKYFVEAGAIAVRRVRKEDLRHVAKATGATMVSTFADMEGEETFDASFLGHADEVVEERIADDDVILVKGTKNTSAVSIILRGANDFMLDEIDRSLHDALCIVKRTLESNMVVAGGGAVEAALSVYLENLATTLGSREQLAIAEFAESLLIIPKVLSVNAAKDATELVAKLRAYHHTAQTKADKQHYSSMGLDLSKGIIRNNLEYGVIEPSMSKVKIIQFATEAAITILRIDDMIKLTKEEGNEEE

SEQ ID NO: 21012 - DNA, 1785 bp, Sorghum bicolor
  misc_feature: Ceres ANNOT ID no. 8682014
  misc_feature: Up-regulated in shoot tissues in response to salicylic acid treatment
  misc_feature: Down-regulated in root tissues in response to salicylic acid treatment
  misc_feature: Down-regulated in shoot tissues in response to salicylic acid treatment
  misc_feature: Encodes the peptide sequence at SEQ ID NO 21013
atggccaccgccgcatccaccacttccgccgccgtgctcgcctccaggctcctcctccgctgctcgccgcgcctgctgcgccgcctcagcgtgtcccgcgcgccgcacgcggcactcgcgtcgtcgtcgggccgcggcctcccgcccctcgtccgccactcgctcggtcaccgcgcccggatggggcacaccgccgccgctgcggccgtggccgccgaacccgctctcggcctcaccaagcccaacgccatcgagccgcctcaggtcaccttttccgctaaagacgtcgaattctccgagtggaagggcgatattctcgccgtcgcggtcacggagaaggatctgtccaaggatgccgactccaagttcgagaatgccgtcttgaagaagctggacggccagctcggcggcctcctgtcggaggctgcggcggaggaagatttcaccgggaagacggggcagtcggtggttctccgcctcgcggggcagggcttcaagagggtgggcctgatcggtcttggccagaacgccccgtccaccgctgccgctggccgaggtctcggcgagtcggtcgcgtcggttgccaaggccgcccaagctagcaccgctgcaattgttcttgcctcccccagtgggatccaggaagagttcaagctgactgctgcagctgcaattgcttccggaaccgtgctggggctgtatgaggacagcagatacaagtctgaatcaaaaaaggtgcacctgaagcaggttgatattattggactgggttctggtgctgatgtggatcagaaacttaagtatgctaatgacctttcgtcgggtgtgatattcggaagagagcttgtgaactctcctgcaaatgtccttacccctgctgtgcttgcggaggaggcgtcaaagatcgcttctacttacagtgatgtgttcacagccacaatactagatgtagagaaatgcaaagaattaaagatgggttcctacttgggagttgctgcagcttctgctaaccctccccacttcatccatttgtgttacaaaccgactgatgggaacgtcaagagaaagctggctattgttgggaagggtttaacttttgacagtggtggctacaacattaagaccggaccaggctgcagcatcgaactgatgaaatttgacatgggtggctctgcagctgtatttggtgcagctaaagctttgggacaaatcaagcctcctggagtagaggttcactttatagtcgctgcctgtgaaaatatgattagtggcacaggcatgagacccggtgacattgtaactgcttctaatgggaagacaattgaggtaaataacactgacgcggagggaaggctaacacttgctgatgctttggtctatgcttgcaaccaaggtgttgaaaagattattgatttggcaacactgactggcgcttgtgttatcgcacttgggcctagcattgccggggttttcacgccaagcgatgagctagccaaggaggttaccgctgcttctgaggtatcaggtgagaagttttggagactgccactggaggagagctactgggaatctatgaagtccggtgtggctgatatggtcaacactggcggtaggcagggaggttctattaccgctgccctgttcctgaaacagttcgttgacgagaaggtccagtggatgcacatcgacatggccgggccagtgtggaacgacaagaagcgggctgccaccggcttcggcgtttcgaccctggtggagtgggtcctcaagaactcctcgtcatga

SEQ ID NO: 21013 - protein, 594 aa, Sorghum bicolor
  misc_feature: Ceres ANNOT ID no. 8682014
  misc_feature: Up-regulated in shoot tissues in response to salicylic acid treatment
  misc_feature: Down-regulated in root tissues in response to salicylic acid treatment
  misc_feature: Down-regulated in shoot tissues in response to salicylic acid treatment
  misc_feature (147)..(589): SWISSPROT Homolog: EC 3.4.11.1 Leucyl aminopeptidase
  misc_feature (276)..(586): Pfam ID: Peptidase_M17 Pfam Description: Cytosol aminopeptidase family, catalytic domain
  misc_feature (107)..(243): Pfam ID: Peptidase_M17_N Pfam Description: Cytosol aminopeptidase family, N-terminal domain
MATAASTTSAAVLASRLLLRCSPRLLRRLSVSRAPHAALASSSGRGLPPLVRHSLGHRARMGHTAAAAAVAAEPALGLTKPNAIEPPQVTFSAKDVEFSEWKGDILAVAVTEKDLSKDADSKFENAVLKKLDGQLGGLLSEAAAEEDFTGKTGQSVVLRLAGQGFKRVGLIGLGQNAPSTAAAGRGLGESVASVAKAAQASTAAIVLASPSGIQEEFKLTAAAAIASGTVLGLYEDSRYKSESKKVHLKQVDIIGLGSGADVDQKLKYANDLSSGVIFGRELVNSPANVLTPAVLAEEASKIASTYSDVFTATILDVEKCKELKMGSYLGVAAASANPPHFIHLCYKPTDGNVKRKLAIVGKGLTFDSGGYNIKTGPGCSIELMKFDMGGSAAVFGAAKALGQIKPPGVEVHFIVAACENMISGTGMRPGDIVTASNGKTIEVNNTDAEGRLTLADALVYACNQGVEKIIDLATLTGACVIALGPSIAGVFTPSDELAKEVTAASEVSGEKFWRLPLEESYWESMKSGVADMVNTGGRQGGSITAALFLKQFVDEKVQWMHIDMAGPVWNDKKRAATGFGVSTLVEWVLKNSSS

SEQ ID NO: 21014 - DNA, 1479 bp, Sorghum bicolor
  misc_feature: Ceres ANNOT ID no. 8682022
  misc_feature: Down-regulated in root tissues in response to salicylic acid treatment
  misc_feature: Encodes the peptide sequence at SEQ ID NO 21015
atgcagggcggcggtgggcaggacgacttcttcgaccagatgctgtccacgctgccggccgcgtggtccgacctcggctccggcaagtcgccgtgggagctccccgcgggggcgggggccgtccccgaggacgccgccgcgtacgacgaggccgcgctcctcgcctcgcgcctccgccaccaccagatcggcggcggcggcgccggcgccggggagaagcccctcatgctccacctcagcgacctgcacggcctcggcgggggaggggccggcgacgacgccgggttcatgccgctgccgctcttcaccgaccgcgccagggacgacatggacgccgccttcaagtcccccaatgccaccggagctgaccaggcgctgtacaacgggttcggagccgctgggatgcatgccgccgtgcatcagccgccgttcgggcagggcgggtcaatgccggcggcgcagagcttcgggggaggcgcggcggccgcgggtggtgcgccggcgccggccgccggagcggcgtcggccggaggaggtgccgcgccgccgcggcagcagcgccagcgggccaagagggggcaagccactgatcctcacagcatcgccgaacgtctccggagggagaggatagcggagaggatgaaggcgttgcaggagctggtccctaacgccaacaagaccgacaaggcatcgatgcttgacgagatcattgattatgtgaagttcctccagcttcaagtcaaggttcttagcatgagccgattaggcggagctacagccgtcggccctctagttgctagcatggcatcagagggcaatgggaacggaaatggcacaagcgacagcggaaatggcaatgccgccaacggtgagaatggtggtggcagcctgcaggtgacggagcaacaggtggccaggttgatggaggaggacatgggcaccgccatgcagtacctgcagggcaaggggctctgcctgatgccgatctctctcgcctcagccatctcctccgccacatcgtcgtccctcctatctcgcccctccatgggtgcaatgggaggcgctaggggtcccctgcacgacggcggtagccctgcgtcgccgccactggtgaacggtggtgatgattccaggaccatcaaggatggcgtttcagccaagggtgtgtttgggaaggatcatgtatcctttcagacggcaaagagatcatacaggcgacgacacacggttggatggtacgagaggctactgagaagcaaactggcaatattccctccctgccttcaatccgcacgtcacgatgggctggctgcaagtaaacaaatcggggagccaagatcaacggattcaaggatcccagcaggagatgcacccacgttggtgaagcatggcgaaagctgtttggagatgggacagcacaatgaacagcagacgtatgaaatcatcgcccttactttgggtatccatgatgaaccatga

SEQ ID NO: 21015 - protein, 492 aa, Sorghum bicolor
  misc_feature: Ceres ANNOT ID no. 8682022
  misc_feature: Down-regulated in root tissues in response to salicylic acid treatment
  misc_feature (195)..(244): Pfam ID: HLH Pfam Description: Helix-loop-helix DNA-binding domain
MQGGGGQDDFFDQMLSTLPAAWSDLGSGKSPWELPAGAGAVPEDAAAYDEAALLASRLRHHQIGGGGAGAGEKPLMLHLSDLHGLGGGGAGDDAGFMPLPLFTDRARDDMDAAFKSPNATGADQALYNGFGAAGMHAAVHQPPFGQGGSMPAAQSFGGGAAAAGGAPAPAAGAASAGGGAAPPRQQRQRAKRGQATDPHSIAERLRRERIAERMKALQELVPNANKTDKASMLDEIIDYVKFLQLQVKVLSMSRLGGATAVGPLVASMASEGNGNGNGTSDSGNGNAANGENGGGSLQVTEQQVARLMEEDMGTAMQYLQGKGLCLMPISLASAISSATSSSLLSRPSMGAMGGARGPLHDGGSPASPPLVNGGDDSRTIKDGVSAKGVFGKDHVSFQTAKRSYRRRHTVGWYERLLRSKLAIFPPCLQSARHDGLAASKQIGEPRSTDSRIPAGDAPTLVKHGESCLEMGQHNEQQTYEIIALTLGIHDEP

SEQ ID NO: 21016 - DNA, 1623 bp, Sorghum bicolor
  misc_feature: Ceres ANNOT ID no. 8682065
  misc_feature: Down-regulated in shoot tissues in response to aminocyclopropane carboxylic treatment
  misc_feature: Encodes the peptide sequence at SEQ ID NO 21017
atggcggcggggcttctgctcaagatggtcggcttctgcgtgtgggcgctcttctggctcgccggctccgccaccgtgagcacgagcaccaccgccttcgccggcagcgaggcggtggtcgtggacgcgcggtccgccatcgccgtcactgacgacgatttcgtctgcgccacattggactggtggccgccggagaagtgcgactacggaacctgcagctggggcctcgactccctcctcaacctgaatctctctaacaaaatcctgatgaatgccgtcaaagcattctcccctttgaagctccgcctgggcggcactttgcaagatatggtgatatacgataccggtgactctcgccaaccgtgcaccccgtttgtgaagaacacgtcagcgatgtttggtttctcgcaaggttgcctgccgctgcatagatgggatgagctgaacgcattcttccaaaaaactgggccaaaagttatttttgggctgaatgctctgactggacgggtcccaatgcctgatggttctttagggggtccatggaattacaccaatgcagcttcttttattcgctacaccgtgaacaaaggatatgatatacatggatgggagcttggaaatgaactcagtggcagtggagttggagctcgaattgatgcagaccaatatgcagcagacgtgatcaccctgaaacacattattgacagcacctaccaaagcaacccatcaaagcctctagtaattgcaccaggaggcttctttgatgcagcctggttcaccgaactcatcagcaaaacaaagccgaatcaaatgaatgcgatcactcaccatatctacaatttaggccctggggttgatgatcatctggttcagaaaattcttgatccttcttacctcgatggtgaggcgagcacattcagcaatcttcagggaatactgaagtctgcaggtacatccactgtggcctgggttggcgaggctggaggggcttacaacagtggccaccaccttgtaactgatgcatttgtgttcagcttctggtatctggatcagcttgggatggcatcaaagtatgacacaaagacttattgtagacagacctttgttggagggaactatggcctgctcaacacaactacatttgaaccaaatcctgactattacagtgctttactgtggcatcgcctcatgggtaccaaggtcctctcgacgacattcaacggcacaaacaagatccgtgcttatgcacattgcgcgaaaaattcggaagggatcactctactcctgatcaaccttgatggcaacaacacaaaccacatctgcgttacaagccaaggcgcacagacccagagtgcaaggaaggagagcagaatgtcttatcaaattcctgggcttggcgaagcggccgagctcacgagacaagagtaccatctcactcccaagggcgggaatctgcagagccaacaaatgttgctgaatggcaatgttctggcaactgacgccaatggggacatcccaaagctggagcctgtgcaggtggaggggacgcagcccataaccgtgggtccttactccattgtgttcgctcacatccccagcttctatgctccagcctgtagttag

SEQ ID NO: 21017 - protein, 540 aa, Sorghum bicolor
  misc_feature: Ceres ANNOT ID no. 8682065
  misc_feature: Down-regulated in shoot tissues in response to aminocyclopropane carboxylic treatment
  misc_feature (35)..(353): Pfam ID: Glyco_hydro_79n Pfam Description: Glycosyl hydrolase family 79, N-terminal domain
MAAGLLLKMVGFCVWALFWLAGSATVSTSTTAFAGSEAVVVDARSAIAVTDDDFVCATLDWWPPEKCDYGTCSWGLDSLLNLNLSNKILMNAVKAFSPLKLRLGGTLQDMVIYDTGDSRQPCTPFVKNTSAMFGFSQGCLPLHRWDELNAFFQKTGPKVIFGLNALTGRVPMPDGSLGGPWNYTNAASFIRYTVNKGYDIHGWELGNELSGSGVGARIDADQYAADVITLKHIIDSTYQSNPSKPLVIAPGGFFDAAWFTELISKTKPNQMNAITHHIYNLGPGVDDHLVQKILDPSYLDGEASTFSNLQGILKSAGTSTVAWVGEAGGAYNSGHHLVTDAFVFSFWYLDQLGMASKYDTKTYCRQTFVGGNYGLLNTTTFEPNPDYYSALLWHRLMGTKVLSTTFNGTNKIRAYAHCAKNSEGITLLLINLDGNNTNHICVTSQGAQTQSARKESRMSYQIPGLGEAAELTRQEYHLTPKGGNLQSQQMLLNGNVLATDANGDIPKLEPVQVEGTQPITVGPYSIVFAHIPSFYAPACS

SEQ ID NO: 21018 - DNA, 1533 bp, Sorghum bicolor
  misc_feature: Ceres ANNOT ID no. 8682093
  misc_feature: Down-regulated in root tissues in response to salicylic acid treatment
  misc_feature: Encodes the peptide sequence at SEQ ID NO 21019
atggccgtcttcatcagctcctccggctcgccagggcgcgccacggcgacgaccacgacgacgacgacgctcctactcgcagtactagcggccgccgctgccgccggcctcctcttggcgccggtcgcggcacgcgggtcaccgcccgagcacgacaagcagctgcagctgcagcagcaggaggacgaccgcatcctggggctgccggggcagcccaacggcgtggcgttcggcatgtacggcggctacgtgaccatcgacgacaacaacggccgcgcgttgtactactggttccaagaggccgacaccgccgacccggcggccgcgccgctcgtcctctggctcaacggcgggcctgggtgctcctccatcggcctaggcgccatgcaggagctcggcgcgttccgcgtccacaccaacggcgagagcctcttgctcaacgagtacgcatggaacaaagccgccaacatactcttcgcagagtcgccggccggtgtgggattctcttacagcaacaccagctctgacctatccatgggcgatgacaaaatggcccaggacacgtacactttcctggtgaaatggttcgagaggttcccgcactacaagtaccgcgaattctatattgccggggaaagcggccactttattccacagctctcccaagttgtgtacaggaacaggaacaactcacctttcattaacttccaagggttgctggtttccagtggtctgaccaacgaccacgaagacatgatcggcatgttcgagtcgtggtggcaccacggcctcatctccgacgagacccgggacagcgggctcaaggtctgcccgggcacctccttcatgcaccccacgccggagtgcaccgaggtgtggaacaaggccctggccgagcaaggcaacatcaacccctacaccatctacacgcccacgtgcgacagggagcccagcccgtaccagcgcaggttctgggcgccccacggccgcgccgccccaccaccattgatgctgcccccctacgacccctgcgcagtcttcaactccatcaactacttgaatctccccgaggtgcaaacggccttacatgccaatgtcagcggcatcgtagagtacccatggactgtatgcagcaataccatatttgatcagtggggacaggcagccgatgacctgctacccgtctatagggagctcattcaagctggactcagggtctgggtctacagtggtgacacagacagtgtagtgccggtgagttcgaccaggcgctctcttgccgccctggagcttcctgttaaaactagctggtacccatggtacatggccccaaccgagcgcgaggttggtggctggagcgtgcagtatgaaggcctgacctatgtcaccgtccgtggcgccgggcacttggttcctgtgcaccgtccggcacaggcgttcctcctgttcaagcaattcctcaagggcgaacccatgccggccgaggaaaagaatgacatcctccttcctagtgagaaggctcccttctactga

SEQ ID NO: 21019 - protein, 510 aa, Sorghum bicolor
  misc_feature: Ceres ANNOT ID no. 8682093
  misc_feature: Down-regulated in root tissues in response to salicylic acid treatment
  misc_feature (63)..(498): SWISSPROT Homolog: EC 3.4.16.6 Carboxypeptidase D
  misc_feature (69)..(489): Pfam ID: Peptidase_S10 Pfam Description: Serine carboxypeptidase
MAVFISSSGSPGRATATTTTTTTLLLAVLAAAAAAGLLLAPVAARGSPPEHDKQLQLQQQEDDRILGLPGQPNGVAFGMYGGYVTIDDNNGRALYYWFQEADTADPAAAPLVLWLNGGPGCSSIGLGAMQELGAFRVHTNGESLLLNEYAWNKAANILFAESPAGVGFSYSNTSSDLSMGDDKMAQDTYTFLVKWFERFPHYKYREFYIAGESGHFIPQLSQVVYRNRNNSPFINFQGLLVSSGLTNDHEDMIGMFESWWHHGLISDETRDSGLKVCPGTSFMHPTPECTEVWNKALAEQGNINPYTIYTPTCDREPSPYQRRFWAPHGRAAPPPLMLPPYDPCAVFNSINYLNLPEVQTALHANVSGIVEYPWTVCSNTIFDQWGQAADDLLPVYRELIQAGLRVWVYSGDTDSVVPVSSTRRSLAALELPVKTSWYPWYMAPTEREVGGWSVQYEGLTYVTVRGAGHLVPVHRPAQAFLLFKQFLKGEPMPAEEKNDILLPSEKAPFY

SEQ ID NO: 21020 - DNA, 1170 bp, Sorghum bicolor
  misc_feature: Ceres ANNOT ID no. 8682107
  misc_feature: Down-regulated in shoot tissues in response to salicylic acid treatment
  misc_feature: Encodes the peptide sequence at SEQ ID NO 21021
atgccggcgggaaagcaatgcgtctcccgcctcagttcccggatccccccggcctttttccaaaccagcccgccacccgtgtttcctaccgacaagtggggccgattcggaaaccacgcggacggagaccccacctgtcaggttaatcttccggggcaaggagcggccgggcgcgaaaatgtttcgcggcagcggcggttccccaaatttctccctccatttttccgctacgcgtccccaaacgcctccctattaattccccccgttcccctcaagtccgtcccgccgccgttctcccctcccgcccagatccccgctagggtttccccgatccccctcagccaccgggccgccgccgacgaggagaccgccgccacgatgttggagctgcggcttgtgcaggggagcctcctcaagaaggtcctggaggcgatccgcgagctggtcaccgacgctaacttcgactgctccgggaccgggttctcgctgcaggccatggactcgagccacgtcgcgctcgtcgcgttgctcctccgcgccgaggggttcgagcactaccgctgcgaccgcaacctctccatgggcatgaacctcaacaacatggccaagatgctccgctgcgccggcaacgacgacatcatcaccatcaaggccgatgacggctctgataccgtcaccttcatgttcgagtcgcccaagcaagataagattgctgattttgagatgaagcttatggacatcgacagtgagcaccttggaatcccggattccgagtaccaggccatcgtccgcatgccgtctgctgagtttatgaggatctgcaaggaccttagcagcatcggggatactgtcgtaatctcggtgactaaggagggcgtgaagttctccacctctggagaaattgggagcgcaaacattgtttgcaggcagaaccaaactattgacaagccagaagaggctaccattatagagatgcaagagccggtttccctgacctttgccctgaggtacatgaactccttcaccaaggcatcttcattgtccgagcaagtgactatcagcctgtcgtctgagctaccagtggtggtcgagtacaagattgctgagatgggttacattagattttacctggcccccaagatcgaggaggatgaggagatgaaggcctga

SEQ ID NO: 21021 - protein, 389 aa, Sorghum bicolor
  misc_feature: Ceres ANNOT ID no. 8682107
  misc_feature: Down-regulated in shoot tissues in response to salicylic acid treatment
  misc_feature (127)..(251): Pfam ID: PCNA_N Pfam Description: Proliferating cell nuclear antigen, N-terminal domain
  misc_feature (253)..(380): Pfam ID: PCNA_C Pfam Description: Proliferating cell nuclear antigen, C-terminal domain
MPAGKQCVSRLSSRIPPAFFQTSPPPVFPTDKWGRFGNHADGDPTCQVNLPGQGAAGRENVSRQRRFPKFLPPFFRYASPNASLLIPPVPLKSVPPPFSPPAQIPARVSPIPLSHRAAADEETAATMLELRLVQGSLLKKVLEAIRELVTDANFDCSGTGFSLQAMDSSHVALVALLLRAEGFEHYRCDRNLSMGMNLNNMAKMLRCAGNDDIITIKADDGSDTVTFMFESPKQDKIADFEMKLMDIDSEHLGIPDSEYQAIVRMPSAEFMRICKDLSSIGDTVVISVTKEGVKFSTSGEIGSANIVCRQNQTIDKPEEATIIEMQEPVSLTFALRYMNSFTKASSLSEQVTISLSSELPVVVEYKIAEMGYIRFYLAPKIEEDEEMKA

SEQ ID NO: 21022 - DNA, 1122 bp, Sorghum bicolor
  misc_feature: Ceres ANNOT ID no. 8682114
  misc_feature: Up-regulated in shoot tissues in response to salicylic acid treatment
  misc_feature: Encodes the peptide sequence at SEQ ID NO 21023
atgacagttcaagtgaaaatttgtgtttctggtgcagtagcagagtcgtgtgctcctagtgcagttgctggtgtaattatcggaaggggcaagcagctgcagagctgcagcgaccaaggggacgacgcgaggaagatgagggcggtggtgatcacgcgcggcggcggcggcccggaggtgctggaggcgcaggaggtggaggaacccgcgccgctgggagacggcgaggtcctcctccaggtggccgccgcgggcgttaaccgcgccgacacgctccagcgccacggccgccatccgccgccccccggcgcgcccccttacccggggctcgagtgctccggcactatcctcgcgctcggccccaacgtcccaccgcggtggtccgtcggcgacaaggtctgcgcgctgcttagcggaggcgggtacgcggagaaggtggtggtgccggcgggccagctgttgccggtgccggagggcgtgtcccttacggacgcggccggcttacccgaggtggcctgcaccgtctggtccaccgtgttcatgaccagccacctctctcccggcgaatcgttccttatacatggaggatcaagtggaattggtacgtttgctatacagattgcaaagcacctcggaataaaggtttttatcacagcaggaagtgaagaaaaactagcagcctgcaaagatttgggtgctgatgtatgcattaactacaaaactgaagactttgttgagcgtgtcaaacaggaaactgatgggaaaggtgtcgatgtaattctcgacaacattggaggaccatatctccagcgcaatctgaacagcttaggtgttgatggcagacttttcatcattggcttccaaggcggtgctgtaactgaagtgaacctgcaagctgtgcttgcacggcgtttgaccatacaagctgctggactgcgcaacagaagccttgctaataaagcagagattgttggtgaggtcgaaaagaatgtgtggcctgctgtcgctgctggcaaggtgaagccggtgatttacaagacgtttccgttgtctgaagctgctgaggctcataggttgatggaagctagcacccacatcggcaagatactgctgcttccatga

SEQ ID NO: 21023 - protein, 373 aa, Sorghum bicolor
  misc_feature: Ceres ANNOT ID no. 8682114
  misc_feature: Up-regulated in shoot tissues in response to salicylic acid treatment
  misc_feature (46)..(372): SWISSPROT Homolog: EC 1.6.5.5 NADPH:quinone reductase
  misc_feature (187)..(329): Pfam ID: ADH_zinc_N Pfam Description: Zinc-binding dehydrogenase
  misc_feature (74)..(156): Pfam ID: ADH_N Pfam Description: Alcohol dehydrogenase GroES-like domain
MTVQVKICVSGAVAESCAPSAVAGVIIGRGKQLQSCSDQGDDARKMRAVVITRGGGGPEVLEAQEVEEPAPLGDGEVLLQVAAAGVNRADTLQRHGRHPPPPGAPPYPGLECSGTILALGPNVPPRWSVGDKVCALLSGGGYAEKVVVPAGQLLPVPEGVSLTDAAGLPEVACTVWSTVFMTSHLSPGESFLIHGGSSGIGTFAIQIAKHLGIKVFITAGSEEKLAACKDLGADVCINYKTEDFVERVKQETDGKGVDVILDNIGGPYLQRNLNSLGVDGRLFIIGFQGGAVTEVNLQAVLARRLTIQAAGLRNRSLANKAEIVGEVEKNVWPAVAAGKVKPVIYKTFPLSEAAEAHRLMEASTHIGKILLLP

SEQ ID NO: 21024 - DNA, 4494 bp, Sorghum bicolor
  misc_feature: Ceres ANNOT ID no. 8682123
  misc_feature: Up-regulated in shoot tissues in response to salicylic acid treatment
  misc_feature: Encodes the peptide sequence at SEQ ID NO 21025
atggcgccggcgcgaggggtccgatctgggggctcggctgccgcggcggcgctggtctcggttctgctcgtgggttgcctcgtcgcgggcggcgagggggccgagatccgccgccaaaaaaacgtgcagactgcgctccgggccaagtgggctggcacgccgctgctgctcgaagccagtgaattgctttcgaaagaatggaaggatctattttgggactttattgaccactggaaggaactggagaaaggctctgaatgtttaacggcaaaatgctgtgtccagaagattgttgaggatgcccgcacactactcaatgaaccactctcttcaatttttgagttttctcttacccttcgatcagcatcgccaagattagtgctgtacaggcaacttgcaaaggagtcattatcttcatttcctattgatgattcaccagagcaaatttccggtcatggcactggaaaaacttttgatggagctgtggatcctaactcttctggaggaacttgctgctgggtagacaccgggaatgttctattgttcaattcagctgatctacatgaatggcttggtggattgggcaagctagctatggattccactgaacagcctgaactctttgactttgaccatatatatcctcgcacaaatattactgctccggttgctatattttatggggctgttgggacaaattgcttcaaagagatgcatgttcaactagcagaagcatcaaagcagggaaaagtcaggtatgctttgcgtcctgtcctaccatctggatgtgggactacgtccaccttttgtggttcagttggtactgtagatgcagtcaccttgagtggttatggggtggagcttgccctaaaaaacatggaatacaaagccatggatgacactgctataaagaagagtgttcctctagaagatcctaagacagaggacctcagtcaagaagtcagagggtttatattttcgaagattttggaacgcaagccagagctaaatgctgagattatggccttcagagattatctattatcctcgacagtgtctgatacacttgaagtctgggaactcaaagatctgggtcatcagacagcacagcggatcgttcaagcatccgaccctttacagtcaatgcaggaaatcaatcaaaatttcccaagtatagtttcttctctatcacgaatgaagcttgacgattccatcaaagatgaaattattgcaaatcagcggatggttccacctggcaagtcattgatggctttgaatggtgctttgatcaatattgaggatcttgatctttacctgttaatggatatggtccatggagaattatcccttgctgatcagttcgtccggttaaagaccattgacatgatcctatctctatatcaagatggtgtccctataaggtttggtatcataatgtattcttcaagattcatcaatgtcattgaagaaagtgatggcactcctacaaataatggagaagacacttccattttgataacaaggcttttcttgtacatcaaagaaacatactcaacacagttggcattccaatttctcagcaatacagaaatacataaatcaaggaatggtgaagatgactacaatgaagagcttgtggaagctcatcaagttgaaggggcatttgttgaatcactattgtcaaacgctaaatctcatccacaagatgtgctgctaaagttgcaaaaagagaacgtgtataagcaggaggctgaagaaagttctcgttttgttcacaagcttgggttgtataaactccagtgttgtctattgatgaatggatttgtccatgaagccagtgaggaagcaaccatgaatgctatgaatgatgagcttcctaggattcaagaacaagtttattatgggcatatccagtcccatacagatgttttagagaagtttttgtcagaaaatagctacaagcggtacaacccatcaattactggcaacagtgcagagaagaaatttgtttcgctctttgcatcatatcatcaggacagctctgtatttaatgacatgaagtacttacagtctcctggaactacagatgatgcaaaacctattactcatctacttgctattgatctttcatcaaaagttggaacaaaattgctttctgaggccatacgttacctgatggatggatctgatagagctcgtgttggtctgctactttatgtccacactggtggttcatcacctattttacttctgaaagatatcttcgatagaactatttattctttcagctataaagaaaaggtattggtcttcctgcatggactcttgaaattttatgaagcccaacctttgcctgcctcatctgttgctgacgattggactagaaatatgatggaaaaggtctataccttagctgctgaaactgctttgcctgttgatgactacaaagcatggttcaaaagtttctctgctgatacagttctcaaagggattgataagttatctgacttcttatttgggcaattggggcttgtgtttggtagtaatgctgtgatcaccaatggacgggtttttattatgaatgaaggagaatcatttctagccaatgacttaggtctccttgagtctatcgagtatgatttgagaacaaaatacatatttgaaataattgaagaggttgagtttgctggtgttgaccctgatgacctgacaagtgctatcaaattgaataatgcaaattcaagtattcacattgatgctgtcattgatccacttagtcccattgggcaaaaacttgccccacttctacgcatactctggaaacagattcagccgagcatgaggattgtacttaatcctattagttcccttgcagatcttcctttaaaaaacttctacagatttgttcttccatcgatggatgattttagcagtacagatcattctgtacacggacctaaagctttctttgcaaacatgccactgtcaaaaacacttacaatgaacatagatgttccagaaccatggcttgttgaaccagttattgccatccatgatttagacaacattcttttagagaatctcggcgatgtcagaactttgcaggcagtatttgaacttgaagctctcctcttgacaggtcattgcattgaaaaggaccgggaccctccccgtggtctgcagtttatccttggtactaaacaaagaccacacttggtagacacacttgtcatggccaacttgggttactggcagatgaaggtctcacctggtgtgtggtacctacaactggctcctggtcgtagtgccgatctgtatgagttacctccaaaactcattgccattgatagcttgagaggcaaactaatgcacattgaagtacaaaagaagaaaggcaaggagcacgaggagttgctaaatgctgccgatgactaccacttccaggaaaagacggataacaaaggctggaataacaaccttttgaaatgggcttctagtcttatcagtggtgatgcatcatccaaaaacaaagctgataaaatcaccgaccgtaaggatgcaagacaaggggagaccataaatatattctctgttgcttctgggcatctgtatgagcgtttcctcaaaataatgattttgagtgttctaaaagagacacagaggccagtgaagttttggttcattaagaattatctatctccacagttcaaggatgtcataccgcacatggctcgggaatatggatttgagtatgagctcatcacatataaatggccaacatggttacacaagcagaaagagaagcaaaggattatatgggcatataagatcttatttctggacgtcatatttccactttcactgaggaaggtgatttttgttgatgctgatcaaattgtgagagcagacatgggagaattgtatgacatgaacctgaagggtcgtccgcttgcatatactccattctgtgataacaacaaggatatggatggctatcgattttggaagcaaggtttttggaaggatcatctgcgaggaagaccataccatatcagtgcgctttatgttgttgatctggccaaatttcggcaaactgcttctggggatactcttcgtgtcttctatgaacaactcagcaaggaccccaatagtctctccaatcttgatcaggatctcccgaattacgcccaacataccgtgcctatattctctcttccacaagaatggctgtggtgtgaatcttggtgtggaaatgccacgaaggcaagagcaaagaccattgatctatgcaacaatccaatgacaaaggagccaaagcttcagggtgctagaagaatagttccggagtggactggtcttgacagtgaagcacgccagttcactgcacgaattttgggcgacgatgtcgagtctgcagaagccacacccccaccatctgagacaccaaagcccgaagataaagacactgatcaggaagtcaaagatgagctatga

SEQ ID NO: 21025 - protein, 1497 aa, Sorghum bicolor
  misc_feature: Ceres ANNOT ID no. 8682123
  misc_feature: Up-regulated in shoot tissues in response to salicylic acid treatment
  misc_feature (877)..(1080): Pfam ID: UDP-g_GGTase Pfam Description: UDP-glucose:Glycoprotein Glucosyltransferase
MAPARGVRSGGSAAAAALVSVLLVGCLVAGGEGAEIRRQKNVQTALRAKWAGTPLLLEASELLSKEWKDLFWDFIDHWKELEKGSECLTAKCCVQKIVEDARTLLNEPLSSIFEFSLTLRSASPRLVLYRQLAKESLSSFPIDDSPEQISGHGTGKTFDGAVDPNSSGGTCCWVDTGNVLLFNSADLHEWLGGLGKLAMDSTEQPELFDFDHIYPRTNITAPVAIFYGAVGTNCFKEMHVQLAEASKQGKVRYALRPVLPSGCGTTSTFCGSVGTVDAVTLSGYGVELALKNMEYKAMDDTAIKKSVPLEDPKTEDLSQEVRGFIFSKILERKPELNAEIMAFRDYLLSSTVSDTLEVWELKDLGHQTAQRIVQASDPLQSMQEINQNFPSIVSSLSRMKLDDSIKDEIIANQRMVPPGKSLMALNGALINIEDLDLYLLMDMVHGELSLADQFVRLKTIDMILSLYQDGVPIRFGIIMYSSRFINVIEESDGTPTNNGEDTSILITRLFLYIKETYSTQLAFQFLSNTEIHKSRNGEDDYNEELVEAHQVEGAFVESLLSNAKSHPQDVLLKLQKENVYKQEAEESSRFVHKLGLYKLQCCLLMNGFVHEASEEATMNAMNDELPRIQEQVYYGHIQSHTDVLEKFLSENSYKRYNPSITGNSAEKKFVSLFASYHQDSSVFNDMKYLQSPGTTDDAKPITHLLAIDLSSKVGTKLLSEAIRYLMDGSDRARVGLLLYVHTGGSSPILLLKDIFDRTIYSFSYKEKVLVFLHGLLKFYEAQPLPASSVADDWTRNMMEKVYTLAAETALPVDDYKAWFKSFSADTVLKGIDKLSDFLFGQLGLVFGSNAVITNGRVFIMNEGESFLANDLGLLESIEYDLRTKYIFEIIEEVEFAGVDPDDLTSAIKLNNANSSIHIDAVIDPLSPIGQKLAPLLRILWKQIQPSMRIVLNPISSLADLPLKNFYRFVLPSMDDFSSTDHSVHGPKAFFANMPLSKTLTMNIDVPEPWLVEPVIAIHDLDNILLENLGDVRTLQAVFELEALLLTGHCIEKDRDPPRGLQFILGTKQRPHLVDTLVMANLGYWQMKVSPGVWYLQLAPGRSADLYELPPKLIAIDSLRGKLMHIEVQKKKGKEHEELLNAADDYHFQEKTDNKGWNNNLLKWASSLISGDASSKNKADKITDRKDARQGETINIFSVASGHLYERFLKIMILSVLKETQRPVKFWFIKNYLSPQFKDVIPHMAREYGFEYELITYKWPTWLHKQKEKQRIIWAYKILFLDVIFPLSLRKVIFVDADQIVRADMGELYDMNLKGRPLAYTPFCDNNKDMDGYRFWKQGFWKDHLRGRPYHISALYVVDLAKFRQTASGDTLRVFYEQLSKDPNSLSNLDQDLPNYAQHTVPIFSLPQEWLWCESWCGNATKARAKTIDLCNNPMTKEPKLQGARRIVPEWTGLDSEARQFTARILGDDVESAEATPPPSETPKPEDKDTDQEVKDEL

SEQ ID NO: 21026 - DNA, 3912 bp, Sorghum bicolor
  misc_feature: Ceres ANNOT ID no. 8682136
  misc_feature: Up-regulated in root tissues in response to salicylic acid treatment
  misc_feature: Encodes the peptide sequence at SEQ ID NO 21027
atggagttgggggagccccacgacagggtgcggggcccgtggaggtcgtggttggcatggccccgtgcgattattgttcgtggctggctgttccctttcccttcctgcgtgttttcaggggtggccttgctcagttgccaccccagcgatttcctgcaatcctgcatcagaggggggcattttatccacgcagggtgcagaaatggccgtgttgggttatcagtaggcatttgtatacgtttacctcttttgcctgtcataaccatcttagtttcacactgtatcttttggtttgctgatcaaagtgtctcctttgatgtagtaatgatgggaacagagtgcattgtggccacactcggcggggatcctgaaccctcaattccacctggattcggacctttcgttgccctcgcgttacagggcatccgggacaatgtcaaatcaggtgatgctcattctagttctgctcaagcagtgcagtgcaaggagaaagatgtcgatattgtggagcacggttcagcaaatagtcggagtggtactcctgctagtacttctgggacccatagttgcaggaggtcacttcgtaacaggcctccaatagactatagccagttcgaccttatctgggacgacgaatctgatgttgaatctgcagaaaagggagtgggatcagtgagacacagacgacagttaccgaaaggagtacttcggggatgtgcagaatgtgctgattgccaaaaggaattcaaggacaccttaaaatacattgagagtatatgtcctagggcagagccatatggaatttgtcgtattgtcccaccaccttcttggaaacctccttgccttcttaaagagaagaacatatgggaatgctcaaaattttctactcgggtacagaaggtcgacaagctccaaaaccgtaaatcatccaagaagagcagaagaggtgggatgatgaagaagcggagaaaacttttagagctggaagataacaataaccttaatcacagtcaaactgggatgcagcaaaaccaagagaggtttggatttgaacctggacctgagttcacacttcagacatttaagaagtatgcagatgacttcaatgaacagtattttaagaaagaagtgtctggggactcagtgccatcagtcgaagacattgaaggcgagtattggcgcatagttgaaaagccaaccgaagagatagaggtagtatatggtgctgatttggagactggaacttttggtagtggattcccaaagttttctcctgaagtaaaatctgatgttgagcataagtacgcagagtctggttggaatctaaacaacttgcctagactacaaggttcagttctatctttcgagggtggtgacatctctggtgttttggtaccttgggtgtatgtcggaatgtgcttttcatcattctgctggcatgttgaagaccaccatttgtactcactgaactacatgcattggggtgctccaaagatgtggtatggagttccaggaaaggatgctgtgaatttggaggctgcaatgaggaaacatctacctgacttgtttgaggaacaacctgatttgcttcataacctggttactcaattttcaccatcattgcttaaatctgaaggagtaccagtctaccgatgtgttcagcatgagggagagtttgtcctaacattccctcgggcataccatgccggtttcaattgtggcttcaattgtgcagaagctgttaatgtggcaccgatagattggttaccaattggacaggatgcggttgagctttatcgtaagcaagctcgtaaaattactgtttcccatgataagctgttgcttggggctgcaagagaagcaataagagctcagtgggatatcctgttcctcaagagaaatactgctgataacttgaggtggaagagcatgtgtggacttgatagcaccatatgcaaatcgcttaaggcaagaatcaatttggagttggtgcaaagacaaaatatatgctctccttctcaatctagaaaaatggatgctgaatttgattctaccgaaagggagtgtgcattgtgctattatgatctgcatctttctgcttctggctgtccatgttgcccagagaaatatacttgccttgcacatgcaaagcagctttgttcatgtgactgggacaaaagatttttcctattccgttatgatgtcaatgagctaaatctgttagctgatgctttaggtggtaagttaagtgcaattcacagatggggtgtctctcatcttggattaagtctgagctcatgtgtcaaacgagaaaaagaccaagattcgaagactcttcacagagtaactgaaggccccagaaggtcctacatgtctcaggcttcaacagtatcattggcaccttcggtggtttgcaaagaacagaacaacaatggaaataagatgctgaacacatctagtttggaaacggatacttctggtcctttttccgagccaataaaatctggaaatgtttcactacaaaaggagacacaaatgaggaatgaggtattgtgtacgctaaacaacagtgtcagtcctgaaggccacaaaggctcactaaactttccagttccttctggtcagtcattttcttccaattttgcaacaaggtccttaagtacttcaggtgaatctatgaaaactgcatatggcttggcagtatttgaagggagtagagaatcttctcggtctggaaactgtatatcttcagttggtgtgcatcataacataccaccaataatggttgatcaaggaaacaacatgaatcctagtatggagagctcaaataattcacataggttgatggcatctaacactaatgcaactcagtgtcactcctacaaggaccaaatgcatgtaacaccagagactagggcttgtgcttcatcaagtcagccattcgtgagaactgttttaagagcacaaagtgtatctaaggaagcatcagctggtgtctttggttcaaagcctctcataaattcttcacttgtgaaaaatacatatgggggttcaagttcatgcggtgcccatcttgggcttccaaattttggtaaccagcaaccaagtgatggatgccttcaaagaaaatctgaatctttatgtggttcagaagctagggggcaaccagttttagtggtgcaacctgctctagaaaatcgtaataggaatggaggtgcacacaagggccctcagatagccaacgtcatgcatcgattcaagagcttagttgaacctttggaaattggtgttgtgctatctgggaggttgtggtcctcaagccaagcaatcttcccaaaagggttcaggagcagagtaaaatacttcagcatcgtggatccaacacaaatggcatactacatatctgaaatattagacgccggaccacagggacctctgtttatggtgactctggaaaactgtctgggtgaactttttatcaatgtatctcctaccaagtgctggagcatggttcgtgagaggctgaatatggaaatacggaggcgactcagtatgggaagaactaatcttcctgcactacagccaccaggatcagttgatggttttgaaatgtttgggttgctgtcaccggcaatagttcaggcaatcgaggctcgggacagagatcacatctgcacagagtactggagatccaggtcccatattgtcactgaagatcgtgatagtcggcagatggggccacttcaggctcagggtccactgcatgcgctgagggagctgttccagcgagccaaccgcaatgagctcctagccctacggagtctactggtgagcaacaacaacctggacgacttctccaggcagcaggctgcccaaatcctcgacgaggagatggccaaacagtggcgctga

SEQ ID NO: 21027 - protein, 1303 aa, Sorghum bicolor
  misc_feature: Ceres ANNOT ID no. 8682136
  misc_feature: Up-regulated in root tissues in response to salicylic acid treatment
  misc_feature (1078)..(1217): SWISSPROT Homolog: EC 2.1.1.43 Histone-lysine N-methyltransferase
  misc_feature (467)..(583): Pfam ID: JmjC Pfam Description: JmjC domain
  misc_feature (689)..(742): Pfam ID: zf-C5HC2 Pfam Description: C5HC2 zinc finger
  misc_feature (1142)..(1235): Pfam ID: FYRC Pfam Description: F/Y rich C-terminus
  misc_feature (1087)..(1139): Pfam ID: FYRN Pfam Description: F/Y-rich N-terminus
  misc_feature (246)..(284): Pfam ID: JmjN Pfam Description: jmjN domain
MELGEPHDRVRGPWRSWLAWPRAIIVRGWLFPFPSCVFSGVALLSCHPSDFLQSCIRGGHFIHAGCRNGRVGLSVGICIRLPLLPVITILVSHCIFWFADQSVSFDVVMMGTECIVATLGGDPEPSIPPGFGPFVALALQGIRDNVKSGDAHSSSAQAVQCKEKDVDIVEHGSANSRSGTPASTSGTHSCRRSLRNRPPIDYSQFDLIWDDESDVESAEKGVGSVRHRRQLPKGVLRGCAECADCQKEFKDTLKYIESICPRAEPYGICRIVPPPSWKPPCLLKEKNIWECSKFSTRVQKVDKLQNRKSSKKSRRGGMMKKRRKLLELEDNNNLNHSQTGMQQNQERFGFEPGPEFTLQTFKKYADDFNEQYFKKEVSGDSVPSVEDIEGEYWRIVEKPTEEIEVVYGADLETGTFGSGFPKFSPEVKSDVEHKYAESGWNLNNLPRLQGSVLSFEGGDISGVLVPWVYVGMCFSSFCWHVEDHHLYSLNYMHWGAPKMWYGVPGKDAVNLEAAMRKHLPDLFEEQPDLLHNLVTQFSPSLLKSEGVPVYRCVQHEGEFVLTFPRAYHAGFNCGFNCAEAVNVAPIDWLPIGQDAVELYRKQARKITVSHDKLLLGAAREAIRAQWDILFLKRNTADNLRWKSMCGLDSTICKSLKARINLELVQRQNICSPSQSRKMDAEFDSTERECALCYYDLHLSASGCPCCPEKYTCLAHAKQLCSCDWDKRFFLFRYDVNELNLLADALGGKLSAIHRWGVSHLGLSLSSCVKREKDQDSKTLHRVTEGPRRSYMSQASTVSLAPSVVCKEQNNNGNKMLNTSSLETDTSGPFSEPIKSGNVSLQKETQMRNEVLCTLNNSVSPEGHKGSLNFPVPSGQSFSSNFATRSLSTSGESMKTAYGLAVFEGSRESSRSGNCISSVGVHHNIPPIMVDQGNNMNPSMESSNNSHRLMASNTNATQCHSYKDQMHVTPETRACASSSQPFVRTVLRAQSVSKEASAGVFGSKPLINSSLVKNTYGGSSSCGAHLGLPNFGNQQPSDGCLQRKSESLCGSEARGQPVLVVQPALENRNRNGGAHKGPQIANVMHRFKSLVEPLEIGVVLSGRLWSSSQAIFPKGFRSRVKYFSIVDPTQMAYYISEILDAGPQGPLFMVTLENCLGELFINVSPTKCWSMVRERLNMEIRRRLSMGRTNLPALQPPGSVDGFEMFGLLSPAIVQAIEARDRDHICTEYWRSRSHIVTEDRDSRQMGPLQAQGPLHALRELFQRANRNELLALRSLLVSNNNLDDFSRQQAAQILDEEMAKQWR

SEQ ID NO: 21028 - DNA, 2523 bp, Sorghum bicolor
  misc_feature: Ceres ANNOT ID no. 8682148
  misc_feature: Up-regulated in root tissues in response to methyl jasmonate treatment
  misc_feature: Up-regulated in shoot tissues in response to methyl jasmonate treatment
  misc_feature: Encodes the peptide sequence at SEQ ID NO 21029
atggcgccgcagcccactccgcctccgcgtccggcgccggcgccgacgccgacgcctcaggccgcggccgcgacgaaccccaggacgcccgcggccaagcaccgcctccacttccccgccgccaccccgaggaacgccaacaacggcggcggcggcggcgccacggagcatccggtcgaggtgatcggccgcatccggaacctcgcctcggggaccgcgtccgcgctggagattgcgagcggcgggacggccgtgcgcgtgcgcggcgacgcgggcggttgccgcgacttcacccttgacggcgtctccgtgtccgaggaggaggacctcgaggggttctaccgccgcttcgtgcgctccaggatccagggcgtccgggtcggggccaagtgcaccgtcatggtctacgggcccacggggtccgggaagagccacaccatgttcggctgcaccaaccccaagcagcccgggatcgtgtaccgcgcgctcagggacatccttgagggaggaggcggcggcgaaggcgattccgctgaggatgacgccgggtttgacgccggcctcttcgtccaggtcgcggtgctggagatctacaacgaggagatctacgatttgctcgcgggaagcggggccactgctaaaggaaacgcccccaaggcgagactggaagtaatggggaaaaaggcaaagaacgcaacttatatatctggaaatgaagctgggaagatatcaagagaagttgctaaggtggaaaagcgaagaactgtgaagagcacactttgcaatgagagaagttcgcgaagccattgcatgattatcctggatgtcccatctgtgggaggaaggttaatgcttgtggacatggctggatcggaaaacatagaagcagcaggacaaacaggatttgaagccaaaatgcagacggcaaaaattaaccaagggaacactgctttgaagcgagtggttgaatccattgctaatggtgattcccatgttccatttagggatagcaagctcacaatgctactacaggactcattcgaggatgacaaatccaaaatcctgatgattctgtgcgccagtcctgacccaaaggaattgcacaagacagtttctactttggaatatggtgccaaggcaaagtgtattatccgtgctgctcatgccgcaacacctagggacaaaatgagctctgaggagtcatctgcaatgctcaattctagaattgttgcgatgaaccagttcatccacaagcttcaaaaggagaacaaacttagggagaaagagcgcaatgaggcccagaatgtgctaaagctgaaggaagaggagctagcacaactgagagcaaagctcaagctgatagaagggcaagaaatggaggaaatctggtcattgaggagtgaactcgcgaagatggaagaagcgatgcgtaagcagcagcaagagctcactgcactaagacatcaactgcatgaggttgagcgtgaaaaggctgatggttctcagctagtgcagcaggattcttttggaggtagattgctggcacggctatcagagatgcctgcaggccttgatcaatcaatggcaatgtccatgtctatggacttggatacaggagatcagccagccatgcaagacgtcaaggtaataaaggaggatcctcaccagcagggccacatacggaatcaaacagccacagcagcaagtgcttgcacagggtctgcggtgcaagaagatgatgtcaggctgtccgggtatcctgaaaagactgtcctcagcactgtgtttgaggagggagacgaagatgatgcagagaaggaatgtggtcttcaagaggaggtacgcaaggaggttgtagaggagaactttaagatggacacaacacaacatacactttctgagccagacgatcctgcaacaaggaagcatcggattgagaacatattcaggctatgtggcaattatcgtgaaatagctaagaaaccaaaggtccagtcaccagcaaaggaaatgttctggaatgagaacaagtctccagcgaagcaagtgtttggggatcagaacaaatcattggcaaaccaaacttttggagatgaaaacaaggagccgtcggcatggggagctatagagaaccccatgtgcgacgtcagagtgactgacagcccagtgtcttctcaactttctccaatcgtatgccaagttgtggatgcaccattatcggatcaactgaatacatgcagtgcagcggaagagagtgatccgaagaaggagaacagccttgctggacagaaggatggcggcctcttggaagtttacataaaatgggagtctggcagcctgatcaaagggctgaaggtactgcacaactcatgcctttcagatctgaggaagctcatagaggctcactttgaagaagtaggcagcaaacagcagcagcatcagttcaccttccttctcctcggggacgcagggggcgaggcgagcccgtggttgttgacgcccagtgccaatccccaatcatga

SEQ ID NO: 21029 - protein, 840 aa, Sorghum bicolor
  misc_feature: Ceres ANNOT ID no. 8682148
  misc_feature: Up-regulated in root tissues in response to methyl jasmonate treatment
  misc_feature: Up-regulated in shoot tissues in response to methyl jasmonate treatment
  misc_feature (64)..(384): Pfam ID: Kinesin Pfam Description: Kinesin motor domain
MAPQPTPPPRPAPAPTPTPQAAAATNPRTPAAKHRLHFPAATPRNANNGGGGGATEHPVEVIGRIRNLASGTASALEIASGGTAVRVRGDAGGCRDFTLDGVSVSEEEDLEGFYRRFVRSRIQGVRVGAKCTVMVYGPTGSGKSHTMFGCTNPKQPGIVYRALRDILEGGGGGEGDSAEDDAGFDAGLFVQVAVLEIYNEEIYDLLAGSGATAKGNAPKARLEVMGKKAKNATYISGNEAGKISREVAKVEKRRTVKSTLCNERSSRSHCMIILDVPSVGGRLMLVDMAGSENIEAAGQTGFEAKMQTAKINQGNTALKRVVESIANGDSHVPFRDSKLTMLLQDSFEDDKSKILMILCASPDPKELHKTVSTLEYGAKAKCIIRAAHAATPRDKMSSEESSAMLNSRIVAMNQFIHKLQKENKLREKERNEAQNVLKLKEEELAQLRAKLKLIEGQEMEEIWSLRSELAKMEEAMRKQQQELTALRHQLHEVEREKADGSQLVQQDSFGGRLLARLSEMPAGLDQSMAMSMSMDLDTGDQPAMQDVKVIKEDPHQQGHIRNQTATAASACTGSAVQEDDVRLSGYPEKTVLSTVFEEGDEDDAEKECGLQEEVRKEVVEENFKMDTTQHTLSEPDDPATRKHRIENIFRLCGNYREIAKKPKVQSPAKEMFWNENKSPAKQVFGDQNKSLANQTFGDENKEPSAWGAIENPMCDVRVTDSPVSSQLSPIVCQVVDAPLSDQLNTCSAAEESDPKKENSLAGQKDGGLLEVYIKWESGSLIKGLKVLHNSCLSDLRKLIEAHFEEVGSKQQQHQFTFLLLGDAGGEASPWLLTPSANPQS

SEQ ID NO: 21030 - DNA, 1770 bp, Sorghum bicolor
  misc_feature: Ceres ANNOT ID no. 8682195
  misc_feature: Down-regulated in root tissues in response to salicylic acid treatment
  misc_feature: Encodes the peptide sequence at SEQ ID NO 21031
atggcgacgtgctctcgcccgctcttcgtctccgactccgcgtcctccgcctcgccgtcgcgggcgaggaaaagcggcgaccccagaaaagtggaggcctcgccttctcgagtctccattccattcgaaaaggcatcgccgggtgagcgaaaagggggaagatcgatggcgacgtgctctcgcccgctcttcgtctccgactccgcgtcctccgcctcgccgtcgcgggcgtcccttcgccgccttcacacggtagcagtagtatcgatatgggaacccctaccccgcccaccagtgcgggctgtagcctggcgtttctcccgaacgaagcaatgctcaaggagatccaccgagtgtttggcgagtggagcatccgtgtccagattgacgcggccaataaggagaatgctgtctcgttactcttcactgatgatcaccttgcacggcaacctcagccggtgctacaaggccatgagcgcgctgcggccagatggggcatccaggcacttcatgtctgctggtttcggacgcgtcgttttaggggtggtgctggtgatgtccatctcagcggcttcttatacagcaccttcttcatcggcgcttacagaggaaaacttgcttttcctggaggcttggcgcgcggttgatcgagcatactatgacaaatctttcaatgggcaaagttggtttagataccgtgaaaatgcccttcgcaatgaaccaatgaacacaagggaagagacatatgcagcaatcaagaaaatgctttcaacattggatgatccatttactcgtttcttggagcctgagaaattgaagagcttgaagtctggtacgcaaggcgcactcacgggtgtaggtttatcgattagttacccaatggcaattaatggatcaccttcaggagttgctgtcatgacagccacccctggtggtcctgcagaaaaggccggcattcttcctggagatatcattttggcaattgatgacagaagcactgaagacatggatatatatgatgccgcagaacgcttacagggccctgaaggaagtccggtagatttgtctattcgtagtgggaccaataccaggcatgtcgttctgaagagacaaacagtcactttaaacccagtgaggtcaaggatgtgtgagattccaggttcaaaagatagctcaaagatcggttacatcaaattgacaacatttaaccaaaatgctgcagaatctgttaaggaagccattaagacattaagggacaacaatgtcaaatcctttgtgttggatctgagaaataacagtggtggcctttttcctgaaggaattcaaattgctaagatttggatggacaagggtgttattgtatatatatgtgatagccaaggtgttcgtgacatttatgaggcagatggagctgatacaattgctgcatcagaacctttggtggtgctggtaaacaaaggaactgcgagtgcaagtgagatccttgctggagcactgaaagacaataaaagggcagtcgtatatggggaaccaacatatggaaaagggaagattcagtcggtttttggattatctgatggatctggcttagctgtgactgtagcacgctatgaaactcctgcacataccgacattgacaaggttggtgtgattccagaccgaccattgccagcgtcattccctacagatgaagatggcttctgcagctgccttagggattcgacggctgcttgcaatctgaatgctgctcagctgtttgcaagatcatga

SEQ ID NO: 21031 - protein, 589 aa, Sorghum bicolor
  misc_feature: Ceres ANNOT ID no. 8682195
  misc_feature: Down-regulated in root tissues in response to salicylic acid treatment
  misc_feature (202)..(553): SWISSPROT Homolog: EC 3.4.21.102 C-terminal processing peptidase
  misc_feature (393)..(556): Pfam ID: Peptidase_S41 Pfam Description: Peptidase family S41
  misc_feature (274)..(358): Pfam ID: PDZ Pfam Description: PDZ domain (Also known as DHR or GLGF)
MATCSRPLFVSDSASSASPSRARKSGDPRKVEASPSRVSIPFEKASPGERKGGRSMATCSRPLFVSDSASSASPSRASLRRLHTVAVVSIWEPLPRPPVRAVAWRFSRTKQCSRRSTECLASGASVSRLTRPIRRMLSRYSSLMITLHGNLSRCYKAMSALRPDGASRHFMSAGFGRVVLGVVLVMSISAASYTAPSSSALTEENLLFLEAWRAVDRAYYDKSFNGQSWFRYRENALRNEPMNTREETYAAIKKMLSTLDDPFTRFLEPEKLKSLKSGTQGALTGVGLSISYPMAINGSPSGVAVMTATPGGPAEKAGILPGDIILAIDDRSTEDMDIYDAAERLQGPEGSPVDLSIRSGTNTRHVVLKRQTVTLNPVRSRMCEIPGSKDSSKIGYIKLTTFNQNAAESVKEAIKTLRDNNVKSFVLDLRNNSGGLFPEGIQIAKIWMDKGVIVYICDSQGVRDIYEADGADTIAASEPLVVLVNKGTASASEILAGALKDNKRAVVYGEPTYGKGKIQSVFGLSDGSGLAVTVARYETPAHTDIDKVGVIPDRPLPASFPTDEDGFCSCLRDSTAACNLNAAQLFARS

SEQ ID NO: 21032 - DNA, 2022 bp, Sorghum bicolor
  misc_feature: Ceres ANNOT ID no. 8682180
  misc_feature: Up-regulated in root tissues in response to methyl jasmonate treatment
  misc_feature: Up-regulated in shoot tissues in response to methyl jasmonate treatment
  misc_feature: Up-regulated in root tissues in response to salicylic acid treatment
  misc_feature: Up-regulated in shoot tissues in response to salicylic acid treatment
  misc_feature: Encodes the peptide sequence at SEQ ID NO 21033
atggacatgccatctcacactcacagccagctttgtgaaagcaaggcccttgtagccagctacacgcaggaagccaggaagagaaaccagcagcacaatatggcctcaaagcctggccctctcagtcgctggccatggcaagatctcggaaactacaagtacgcgctggtggctccatgggcggtgcgcagcacgtacaggttcgtgacgagcggggagcgggacctgctcgccttcgccgtgctgccggtgctcctcctccgcctcctctacagccagctctggatcaccgtgtcccgccaccagacggcccggagcaggcaccggatcgtcgacaagagcctcgacttcgaccaggtcgacagggagaggaactgggacgaccagatcctgctgacggcgcttctcttctacgtggtgaacgcggcgttgccggcggcgcagtctttgccgtggtggaactccaagggtctggtaatggtctccctcctccacgccggccccgtggagttcctctactactggctccaccgcgccctccaccaccactacctctactcccgctaccactcgcaccaccacgcctccatcgtcaccgagcccatcacatcggtgatccacccgttcgcggaggagttggtgtacttcaccctgttcgccatcccgctgctcaccatggtgggcaccggcactgcctccgtggctgtagcaaacggctacctcatctacatcgacttcatgaactacctcggccactgcaacttcgaggtcgtgcccaagctgctcttcgacgtcttccctccgctcaaatacctggtgtacacgccgtcgttccactcgctgcaccacacgcagttccgcacaaactactcgctcttcatgccgctctacgaccacctctacggcaccgccgacaagtccagcgacgacctgtacgagcgcaagctcatgcaatgccggaacgaggagcaggaggaggcgcccgacgtcgtccacctcacgcacctcaccacgccggcgtccctcctccgcctccgcctcggcttcgcctccctcgccgccgcgccggcgccgctcgcgtcttcgacccgcggctgcaccagcgtcctggcggctgccgcgcgcccggtggccgcgctccttggccggaccgccaccgccttcaggtctgaggccaacaggctccacaagctcaacctcgagacgtgggtcgtgccaacatacacctctcagtatgagtcgaagcaaggtttgcatgcagtggggcggctggtggagaaggcggtggcagacgcggaggcaagtggcgccagagtactcacgctgggtctactgaaccagggaagcgagctgaacaagaacggcgagctgtacgtcatcaggaaacctgacctgaggaccaagatcgtcgacggcaccagcctggccgccgccgccgtgctgcacatgatccctcggggcaccgccgacgtgctcctcctgggagacgccggcgccaagatggcggccgtgctggcgtcggcgctctgcgaacgcgggattcaggttcagatggtggacagggacctgtacgagtctctgaagcaggaggtgcgcccagagacgcacaagcatcttcttctcctttctgactggagccgcagccgcagcagcagcagcaaggtctggctcgtcggcgacaagctgacggacgaggagcagaggagggcgcagggcggcgtccacttcgtgccctactcgcagttccctcccgacgccgtccgcggcgactgcgtctaccacagcacgccggcgctggttgtcccggacgccttcgagaacctccacgcctgcgagaactggctgccgcggagggtgatgagcgcgtggcgcgcggcgggcatcgtgcacgcgctccagggctgggacgaccacgagtgcggcgccagggtcaccggcgtcgacaaggcatggcgcgccgcgctcgcgcacggcttccgcccctacgaccgccatcacaccgcgggtggcgccagcaagtga

SEQ ID NO: 21033 - protein, 673 aa, Sorghum bicolor
  misc_feature: Ceres ANNOT ID no. 8682180
  misc_feature: Up-regulated in root tissues in response to methyl jasmonate treatment
  misc_feature: Up-regulated in shoot tissues in response to methyl jasmonate treatment
  misc_feature: Up-regulated in root tissues in response to salicylic acid treatment
  misc_feature: Up-regulated in shoot tissues in response to salicylic acid treatment
  misc_feature (162)..(284): Pfam ID: FA_hydroxylase Pfam Description: Fatty acid hydroxylase
MDMPSHTHSQLCESKALVASYTQEARKRNQQHNMASKPGPLSRWPWQDLGNYKYALVAPWAVRSTYRFVTSGERDLLAFAVLPVLLLRLLYSQLWITVSRHQTARSRHRIVDKSLDFDQVDRERNWDDQILLTALLFYVVNAALPAAQSLPWWNSKGLVMVSLLHAGPVEFLYYWLHRALHHHYLYSRYHSHHHASIVTEPITSVIHPFAEELVYFTLFAIPLLTMVGTGTASVAVANGYLIYIDFMNYLGHCNFEVVPKLLFDVFPPLKYLVYTPSFHSLHHTQFRTNYSLFMPLYDHLYGTADKSSDDLYERKLMQCRNEEQEEAPDVVHLTHLTTPASLLRLRLGFASLAAAPAPLASSTRGCTSVLAAAARPVAALLGRTATAFRSEANRLHKLNLETWVVPTYTSQYESKQGLHAVGRLVEKAVADAEASGARVLTLGLLNQGSELNKNGELYVIRKPDLRTKIVDGTSLAAAAVLHMIPRGTADVLLLGDAGAKMAAVLASALCERGIQVQMVDRDLYESLKQEVRPETHKHLLLLSDWSRSRSSSSKVWLVGDKLTDEEQRRAQGGVHFVPYSQFPPDAVRGDCVYHSTPALVVPDAFENLHACENWLPRRVMSAWRAAGIVHALQGWDDHECGARVTGVDKAWRAALAHGFRPYDRHHTAGGASK

SEQ ID NO: 21034 - DNA, 918 bp, Sorghum bicolor
  misc_feature: Ceres ANNOT ID no. 8682192
  misc_feature: Down-regulated in shoot tissues in response to salicylic acid treatment
  misc_feature: Encodes the peptide sequence at SEQ ID NO 21035
atggccacggccgtcctccgccgcccactcctcgccgcgctactcccggccggcgccggggagtccgggccctcccggctccgtctccggagacgcatgtccccgcctcctgcgcgcgcggtgtcttccgactcccccaagcccgtcgcatccacttcctctcccgctggcggcgacagccccgaggaggagccgccggtcctgccgctcctccaggagctcgcggattgcttggttcttccgcccaagttcctcgctcagctcccgcgcgaccttcgtcttgacctcaatgatgccgcttttgatctctccaatgggccagttctcgatgagtgtggccaagaagtgggtgatctgctcctgaacctggcgaaagcatgggagttggctgatacgtcagcatcgaatagcatcgccaagcagctgccatcgatggagccctacttgacgcacagcgccaaaccagcatttggcaagcggctggtgtcagctggaaggaggtttcagtcaatggggcagtatggtcagggagaactcaagaagattgctgaaacaatgatcaagaatggtaagctactttggacacgcccagtggttcaatctgatgttcaggctatgaaagaaaaaaggagacttaagtttggagaactggagttcgaagtgactgctgaaagtgccaatatcggtgctgcagtagcggcaatttttggattcatctcatggcaactagcacaaggtgtgcaaaatgttcctgacagtacaatgcaatacgcaaatgacaatgcattgcagctggccaagtcgctcaagaccgcactgcttgttcttggctacacatctaccggcctatccttattcacggcttttgggctgctgttgctagcccagcggattaactctgagaacaaatcggagtaa

SEQ ID NO: 21035 - protein, 305 aa, Sorghum bicolor
  misc_feature: Ceres ANNOT ID no. 8682192
  misc_feature: Down-regulated in shoot tissues in response to salicylic acid treatment
MATAVLRRPLLAALLPAGAGESGPSRLRLRRRMSPPPARAVSSDSPKPVASTSSPAGGDSPEEEPPVLPLLQELADCLVLPPKFLAQLPRDLRLDLNDAAFDLSNGPVLDECGQEVGDLLLNLAKAWELADTSASNSIAKQLPSMEPYLTHSAKPAFGKRLVSAGRRFQSMGQYGQGELKKIAETMIKNGKLLWTRPVVQSDVQAMKEKRRLKFGELEFEVTAESANIGAAVAAIFGFISWQLAQGVQNVPDSTMQYANDNALQLAKSLKTALLVLGYTSTGLSLFTAFGLLLLAQRINSENKSE

SEQ ID NO: 21036 - DNA, 1392 bp, Sorghum bicolor
  misc_feature: Ceres ANNOT ID no. 8682234
  misc_feature: Up-regulated in root tissues in response to methyl jasmonate treatment
  misc_feature: Up-regulated in shoot tissues in response to salicylic acid treatment
  misc_feature: Up-regulated in root tissues in response to salicylic acid treatment
  misc_feature: Up-regulated in shoot tissues in response to methyl jasmonate treatment
  misc_feature: Encodes the peptide sequence at SEQ ID NO 21037
atggagaaggcgatcgatcggcagcgggtcctcctggcgcacctcctcccctccgcctccgcctccgcctcctccgcgcagcctcagcttgcggcgtcggcgtgcgcggccggggacagcgccgcctaccagaggacctcctccttcggggacgatgtcgtcgtcgtcgctgcgtaccggacgcccatatgcaaggccaagcgaggaggcttcaaggacacctacccagaggacctcctcactgttgttctcaaggctgttctggacaacactagaatcaatccagctgacattggtgacattgtggttggtacggtgcttggtcctggttcccagcgtgcaatcgagtgcaggacggctgcgttgtttgctggattccctgaaaccgttcctgttagaactgtcaaccgacaatgttcatctgggcttcaggcagtagccgacgtcgcggctgctataaaggctggttactatgacatagggattggtgctggtttggaatccatgtccataaattccatgggttgggaagggcaagttaacccaagaataactgaactccagaaagcacaggattgtcttctgcccatgggaattacttctgaaaatgtcgcccatcgatatggtgtaaccaggcaagagcaagaccaggctgctgctgagtctcataggagagctgctgcagccacggcctctggaaaattcaaggatgagatcgtccccgtgccaacaaagattgttgatcctaaaactggagaggagaagaaagttgtgatatcagttgatgatggggttaggccagggaccacagcatctggattggcaaaacttaaaccagtttttaaaaaggatgggactacaactgcaggcaattctagtcaagtgagtgatggtgctggagctgttcttctcatgaaaagatctgtggctctgaagaaaggacttcctattcttggtgttttcaggagctttgccgctgttggagtggatccagctgttatgggtgttggtcctgctgtggccattcctgctgcagtgaaatctgctggccttgagattggagacattgatctgtttgaactgaatgaggcctttgcctctcaatttgtttattgctgcaacaagttgggcctggaccgttccaaagtaaatgtaaacggaggcgcgattgcccttggacacccactgggtgcaacaggtgcccggtgtgtggctactcttctaaatgaaatgaagcgccggggcagagactgcagatttggcgttgtcaccatgtgtatcggatctggaatgggggcagcagctgtgttcgagcggggagatgctgtggatggactctccaacgtgagggacacccagacacaaaattttctgtcaagggatgcaaagtag

SEQ ID NO: 21037 - protein, 463 aa, Sorghum bicolor; identical to SEQ ID NO: 8594
  misc_feature: Ceres ANNOT ID no. 8682234
  misc_feature: Up-regulated in root tissues in response to methyl jasmonate treatment
  misc_feature: Up-regulated in shoot tissues in response to salicylic acid treatment
  misc_feature: Up-regulated in root tissues in response to salicylic acid treatment
  misc_feature: Up-regulated in shoot tissues in response to methyl jasmonate treatment
  misc_feature (1)..(463): SWISSPROT Homolog: EC 2.3.1.16 Acetyl-CoA C-acyltransferase
  misc_feature (50)..(308): Pfam ID: Thiolase_N Pfam Description: Thiolase, N-terminal domain
  misc_feature (315)..(439): Pfam ID: Thiolase_C Pfam Description: Thiolase, C-terminal domain

SEQ ID NO: 21038 - DNA, 4641 bp, Sorghum bicolor
  misc_feature: Ceres ANNOT ID no. 8682224
  misc_feature: Up-regulated in shoot tissues in response to salicylic acid treatment
  misc_feature: Encodes the peptide sequence at SEQ ID NO 21039
atggcaaggacaaagaggaggatgcaaccgcgagtgggcaagggtgggcgcgtgaggagaaagaacataccgctgccagcaagacaagtggagttgggacgcgaggcggcgcaagcttccattgcggtgggatcccaagtttgggtcgaggaccgcgatgtcgcttggattgatggggaggttgtaaaagccaatggggacacggttacagtcaagtgttccaatgaaaagacggttacggcaaaagcatctaatgtccacgctaaggatcccgaggaagcgccatgtggagtcgatgacatgacgaagcttgcctatctgcatgaacctggggttcttcagaatttgaaatctagatatgatatgaatgaaatttatacatatactgggaatatcttgattgctgtaaatcctttccgaagactgccccatctgtacgacactcagatgatgcagcaatataaaggggcagaatttggtgaattaagccctcatccttttgctgttgcagatgttgcatatagattgatgcgcaatgaaggaattagtcagtcgatccttgttagtggagaaagtggtgctggtaaaacggaaagcaccaagatgatcatgcgctatcttgcttacatgggtgggaaggcggcttccgaagggcgaactgtggagaagcaagtccttcagtccaatcctgttcttgaagcatttggaaatgcaaagactgtcaggaacaataattcaagtcgtttcggtaaatttgttgagatccagtttgatcagaaagggaaaatatcaggagctgccgtaagaacctatcttcttgagagatcccgtgtctgtcaaatatctgacccagagagaaactaccattgtttctacatgatatgtgctgcccctcctgaggagcgtgagagatacaaactcggagatcccagcacatttcactaccttaatcagtccaactgcattaagcttgaaggcctagatgaatctaaagagtaccttgaaactaggaaggctatggacattatcggaatcagttctgaagaacaggaagcgatctttcgggttgttgctgctattctccacttggggaatgtcgagtttgcagaaggggatgatggtgattcatcaaaacctaaagatgaaaaatctctttttcatttgaggacagctgctgagctattcatgtgcgatgagaaagctttaaaagattcgttgtgtcagcgcattattgtgactcgcgatgagaatatagtgaaaactttggatcctgaagctgccaagggaagtagagatgcacttgctaagactgtgtactcacggttgtttgattggcttgtgaataaaatcaacaactctattggccaagaccccaactcgaaatgcttaattggagtgctggatatctatgggtttgaaagcttcaagacaaacagttttgagcagttttgtatcaacctgacaaatgaaaagctccagcaacacttcaatcagcatgtgtttaagatggaacaggaagagtacaccaaagaagaaattaattggagttacattgagttcattgataaccaggacgttcttgatctcattgagaagaaacctggtggaattatttcccttctagatgaagcttgtatgttgccaagatcgacacatgagacatttgctcagaaattgtatcaaactttcaaaaatcacaagcgctttgctaagccaaaattatctcggtcagactttaccatatgccattatgcaggagatgtcacctatcaaacggaattatttctggacaagaacaaagattatgttgttgctgagcatcaggctctgttgagtgcttcaaaatgtgcattcgtttcaggccttttccctcttctgtctgaggattcctcaaaatcttcaaagttttcatccattggttctaggttcaagcaacaattgcaatctctgttggaaactctgagttcaactgagccacactacatccgttgtgtaaaacccaataatttattgaagcctgcaatttttgagaaccagaacgttcttcagcaactcagatgcggaggagtaatggaggcgattaggattagctgtgccggatatccgaccagaagaacattctacgagttcatagaccgttttggtattcttgcgcctgatgttttgagtggaagttctgatgaggtcagtgctgtaaggaggttgttagacaaggtagatcttcaaggttatcagattggcaagacaaaagtattccttcgtgctggtcagatggctgaacttgatgctcgtagaaatgaagtgttagggcgttcagctagcatgattcagaggaaagtacgttcattcttggcacagaagagtttcattgcattgcgacgagcagctttacaaatccagacagtttgtcgcggtgagcttgcaagaagagtttatcacaacctccgcagagaagctgcttcactcaagatccagactttgtaccgtatgtatactgccagaaaagcatacaacgagctttctgcttcagcagttaccattcaatcaggattgcgcggtatgtgcgcgcgtaaagagctccacttcagaagacaaacaagagctgcaatcatcatccagagtcgctgccgtcaattcttggcaagattgcattattcaagaacaaagaaagctgcaattactacacagtgtgcctggagagggaaggttgctagaaaggagctccgtaagctcaaattggctgcccgggaaactggtgcattgcaagctgccaaaaataaacttgaaaagcaagttgaggagcttacatggcggctacagttggagaagcgcatgcgagctgatctcgaggaagctaaatcacaagaaaatgcaaagttgcaagctgcattgcaggaggtgcaacaacagtacaaagaaacaaaagaaatactagtacaggagagggaagcagccaaaaaggctgcagagatagctccagtcattaaagaggtccctgttatagatacagacctaatgaataagcttagagatgaaaatgacaaactgaagactttggttagttctcttgaaaagaagatcgatgatactgagaagaaatatcaagaaacaagcaaaatcagtgaggataggctcaaacaggcaatggatgctgagactaaaatcgttgacttgaacatggcaatgctaaggcttcaagagaaaatatccaccatggaatctgaggagaaagtccaaagacaagcgctgctaggcacgccagtcaagagcatgtctgaacatttgtcaattccaattgctccaaagaatttggagaatggctatcacgaggttgaagagcataaggaaccccaaagtgcacctcctgctattaaggaatatgtgaatggtgatcctaagatgagaaaatcttgtgttgacaggcaacttgaaaacgtggatgcactcattgactgtgtagggaaaaaccttggatattgtgcagggaagccagttgctgctattaccatatacaaatgtcttcttcattggaaatcattcgaggcagagaagactagcgtttttgaccgtctcattcagttaataggatctgcaatcgagaacgaggatgacaatgacaaccttgcttactggctctccaatacatccagcttactgttcctactgcagagaagtctcaaggctgctggtgctcctggtagcgtttcacgaaagaaacctcctcagccaacatcattatttggcagaatggcccaaggcttgcgttctgcatcttttgccaacatgcatgtcgaagcaacagatgttgtgcgccaagttgaggccaaatatcctgccttgcttttcaagcagcagctaactgcttatgtggagaagatatatggaatcgtccgagacaatattaaaaaggaattgtcatctttgatttcgctatgtatccaggccccaagaacaatgaaagctagcatgctgcgagtttctgggcgattatccggtcaatctcagagtcagagcaaccactggcagaaaattattgaaagcttggataagctcttgaagatactgcaagataaccatgtgcccccggttttagctcagaaaatctttacccagatattttcgtacatcaatgtacagctattcaacagtctattgcttcgtcgtgagtgctgctccttcagcaatggagagtatgtcaaggctggtctagctgagttggagttgtggtgtgcaaaggcaacaactgagtatgcagcatcttcatgggatgagctcaagcatattagacaggctgttggatttttggttatattccagaagttcagaatatcttatgacgagatagtcaatgatctatgtccgatcttgagtgttcaacaactgtacagaatatgtacacaatactgggatgacaagtataatacccaaagtgtttcatcagatgttcttagtaacatgcgggtgctaatgacagaggattctaacagtgctgaaagcggttcattcttgttagatgataattcaagcatcccgttctcggtggatgatatcaccaactcaatgcaggagaaggactttacggatatcaaaccggctgatgagctactcgagaaccctgccttccagtttttacaggattag

SEQ ID NO: 21039 - protein, 1546 aa, Sorghum bicolor
  misc_feature: Ceres ANNOT ID no. 8682224
  misc_feature: Up-regulated in shoot tissues in response to salicylic acid treatment
  misc_feature (98)..(614): SWISSPROT Homolog: EC 2.7.11.1 Non-specific serine/threonine protein kinase
  misc_feature (98)..(754): Pfam ID: Myosin_head Pfam Description: Myosin head (motor domain)
  misc_feature (1367)..(1474): Pfam ID: DIL Pfam Description: DIL domain
  misc_feature (889)..(909): Pfam ID: IQ Pfam Description: IQ calmodulin-binding motif
  misc_feature (793)..(813): Pfam ID: IQ Pfam Description: IQ calmodulin-binding motif
  misc_feature (866)..(886): Pfam ID: IQ Pfam Description: IQ calmodulin-binding motif
  misc_feature (818)..(838): Pfam ID: IQ Pfam Description: IQ calmodulin-binding motif
  misc_feature (44)..(85): Pfam ID: Myosin_N Pfam Description: Myosin N-terminal SH3-like domain
MARTKRRMQPRVGKGGRVRRKNIPLPARQVELGREAAQASIAVGSQVWVEDRDVAWIDGEVVKANGDTVTVKCSNEKTVTAKASNVHAKDPEEAPCGVDDMTKLAYLHEPGVLQNLKSRYDMNEIYTYTGNILIAVNPFRRLPHLYDTQMMQQYKGAEFGELSPHPFAVADVAYRLMRNEGISQSILVSGESGAGKTESTKMIMRYLAYMGGKAASEGRTVEKQVLQSNPVLEAFGNAKTVRNNNSSRFGKFVEIQFDQKGKISGAAVRTYLLERSRVCQISDPERNYHCFYMICAAPPEERERYKLGDPSTFHYLNQSNCIKLEGLDESKEYLETRKAMDIIGISSEEQEAIFRVVAAILHLGNVEFAEGDDGDSSKPKDEKSLFHLRTAAELFMCDEKALKDSLCQRIIVTRDENIVKTLDPEAAKGSRDALAKTVYSRLFDWLVNKINNSIGQDPNSKCLIGVLDIYGFESFKTNSFEQFCINLTNEKLQQHFNQHVFKMEQEEYTKEEINWSYIEFIDNQDVLDLIEKKPGGIISLLDEACMLPRSTHETFAQKLYQTFKNHKRFAKPKLSRSDFTICHYAGDVTYQTELFLDKNKDYVVAEHQALLSASKCAFVSGLFPLLSEDSSKSSKFSSIGSRFKQQLQSLLETLSSTEPHYIRCVKPNNLLKPAIFENQNVLQQLRCGGVMEAIRISCAGYPTRRTFYEFIDRFGILAPDVLSGSSDEVSAVRRLLDKVDLQGYQIGKTKVFLRAGQMAELDARRNEVLGRSASMIQRKVRSFLAQKSFIALRRAALQIQTVCRGELARRVYHNLRREAASLKIQTLYRMYTARKAYNELSASAVTIQSGLRGMCARKELHFRRQTRAAIIIQSRCRQFLARLHYSRTKKAAITTQCAWRGKVARKELRKLKLAARETGALQAAKNKLEKQVEELTWRLQLEKRMRADLEEAKSQENAKLQAALQEVQQQYKETKEILVQEREAAKKAAEIAPVIKEVPVIDTDLMNKLRDENDKLKTLVSSLEKKIDDTEKKYQETSKISEDRLKQAMDAETKIVDLNMAMLRLQEKISTMESEEKVQRQALLGTPVKSMSEHLSIPIAPKNLENGYHEVEEHKEPQSAPPAIKEYVNGDPKMRKSCVDRQLENVDALIDCVGKNLGYCAGKPVAAITIYKCLLHWKSFEAEKTSVFDRLIQLIGSAIENEDDNDNLAYWLSNTSSLLFLLQRSLKAAGAPGSVSRKKPPQPTSLFGRMAQGLRSASFANMHVEATDVVRQVEAKYPALLFKQQLTAYVEKIYGIVRDNIKKELSSLISLCIQAPRTMKASMLRVSGRLSGQSQSQSNHWQKIIESLDKLLKILQDNHVPPVLAQKIFTQIFSYINVQLFNSLLLRRECCSFSNGEYVKAGLAELELWCAKATTEYAASSWDELKHIRQAVGFLVIFQKFRISYDEIVNDLCPILSVQQLYRICTQYWDDKYNTQSVSSDVLSNMRVLMTEDSNSAESGSFLLDDNSSIPFSVDDITNSMQEKDFTDIKPADELLENPAFQFLQD

SEQ ID NO: 21040 - DNA, 1269 bp, Sorghum bicolor
  misc_feature: Ceres ANNOT ID no. 8682271
  misc_feature: Down-regulated in root tissues in response to salicylic acid treatment
  misc_feature: Encodes the peptide sequence at SEQ ID NO 21041
atggcctccgacgacctcttcgacggcctgcctccgcccgccgccgccccggccggcggcggaactggcgcggcctccctctctcctcctcctcctcctcctccggcgccagcgccggcaccggcaccgaagcccgcgcttaagagctccctcaagcggaccaagccctccccctccgccgacgctactacctcttccccatcggctgccgcgcccgaatcccatgttcctgagaaacgtcttcggttcagaacaaccgttgatgcatcagaaacacaagtgattgaggctatgcaaaagatagcttcacacatagggaatacttcaaaattcagcaaggcatcaaaactagctttgcaacttattgaagctggaagcgtcaagcctggaacaatcagtcatttctttgctatactagaggctgcgatgtcttcaccgggagcatgcaatgagccttctgtacgagcagactaccacaaattgtttgatgctgctcagggtgtcacagagttattcaaccaacagcagaaaaatcaattcgacatatgggtgctgcatgctgtggtggctaatgatcttttcactgatgacagttttgtgttctcaaaggctgtaggaaagatcaaagatgccatctcagccctgccagtggcaacagtggatgatgacaatgatgaagctgcagctcttgctgccgcaagcaaaactgactcagtgacggacaataaaactgatcatagcgccccagctgcagcttctaactctgtggcagatgatagcacacatgctgcagcctcagagccaggagaagaatcttctgatccttttggtttagatggtctccttgagcacaagctgaagaagtctgagagagctagagaaaaggcaattgcagctctgaacagaaaagcagacgaggaggaagcaaaaagattcctcaagtcgcagcgggaggcccttctgaaatgcctggaaatagctgctcggcgctacagaatcccatggacgcaaaccgccattgacatctttgcgaagcacgcgtacgacaacgtgacccggttcacacggcagcagcgggacgcgattgtgaagctgtggaactcgatcaaggagcagcagatccggcggaagcagggcaagtcggtgagcgggaagctcgatgtgaacgccttcgagtacctccaggagaagtactcccatgagaagatcagcatccggcatagcgtcggcggtggcggcgagcgccgggcaactgcgtggctcggctag

SEQ ID NO: 21041 - protein, 422 aa, Sorghum bicolor
  misc_feature: Ceres ANNOT ID no. 8682271
  misc_feature: Down-regulated in root tissues in response to salicylic acid treatment
MASDDLFDGLPPPAAAPAGGGTGAASLSPPPPPPPAPAPAPAPKPALKSSLKRTKPSPSADATTSSPSAAAPESHVPEKRLRFRTTVDASETQVIEAMQKIASHIGNTSKFSKASKLALQLIEAGSVKPGTISHFFAILEAAMSSPGACNEPSVRADYHKLFDAAQGVTELFNQQQKNQFDIWVLHAVVANDLFTDDSFVFSKAVGKIKDAISALPVATVDDDNDEAAALAAASKTDSVTDNKTDHSAPAAASNSVADDSTHAAASEPGEESSDPFGLDGLLEHKLKKSERAREKAIAALNRKADEEEAKRFLKSQREALLKCLEIAARRYRIPWTQTAIDIFAKHAYDNVTRFTRQQRDAIVKLWNSIKEQQIRRKQGKSVSGKLDVNAFEYLQEKYSHEKISIRHSVGGGGERRATAWLG

SEQ ID NO: 21042 - DNA, 4275 bp, Sorghum bicolor
  misc_feature: Ceres ANNOT ID no. 8682303
  misc_feature: Up-regulated in shoot tissues in response to salicylic acid treatment
  misc_feature: Encodes the peptide sequence at SEQ ID NO 21043
atggctccaactctactgatagagctgtccatggagctcaaacctctaaaaacagcttcactagtgaagtggagcatacaaaatagggtctcaggcttacacaaaagcatgcaaccatatattcctatgttggcttggtggaatgaaccagggcaggcccgggccgctgctgctgctcccgccggcgacgagcggagccggaggcagccgcagctggaacaaggaggaggaggaggaggacgccaccagaatcagaatcaggagacggaggaggagcacgcgcaggcggtgtactgcgccgtggggattgggattgggattgggaccggcagcgccagccagaaccaggcgcaggcggccgaggaatggaaggccaacctgcgctgggtgctcgccgccctcgccccccgccggagcagcaggcgcctcgtgctcgcgcacctgcgccgccccacctcccggatcaacatcatgggggcgtgggtcccagtgagccagcttgcagaggaggaggtggctgcgtacaggcagctggaggaagagaggatcgccaaagtcctagacgacctcttggcaatttgccaaagtcaaaaggtgaatgcgagcaagatcatcatcgcgagcgacgatatcgccaggggtctcgtgcagttggttgacgaccatggggtcaccgagctcgtcatgggcgctgcgtctgatcgggcgtacggcaggaagatgcgggcgccaaggtctaagaaggcgctaacggtgcagcagaaggcgaatccctcttgcaggatctggttcgtctgcaggggaaatcttatctgcaccagggacgctagcgagggacaagctcatagagctgaatcgtccacagctagcacaagccccaggacaagcacttctgactgctcgagatcgaaatcctcgccatgcctgcacagcgagacattcagcacacaagaaacagacgatccatcagctgaacagactcatggaagggacctcaacatagaggattcaaataatcaagcaaccaccattgctggatcctcagcagctgtgcatttgctacaagagattcaagaggaccgggaaatgcccgcatcggacggtttggatgctggtgagatggatgatgccttgtatgagaagctgaagcatgcgctcatggaagctgagaacctgaagcaagaggcgtacgaagagactcgccggcgtcagatggccgagcgcgggctcgctgaagcgtccaggatggtcatgacaaaacttcgccacttcctgtcaaaattcatgtcgatgaccatatgcatgtatgccgacgaagcagagagatcgtatcagagagaggctaggcatcggaaggaggtggaggagatggtggcgagagagcgcgcggccatggagcaggacaagcgagagctcgacggcatcctggatcagatacggaaggtcgacgaccggagcgccgagctggagctccagatcacgacctcggagcacacgatgaacgacttggaggccaggctgtcggaatcgtacaacctcctcgacacactccggcacggacatcatccttgcaatgcgtcggagtccgcgtccagagaggagggcggcggcgagcagagagtgagcttcttgcacctgggttactcggagctggacgaggccaccaagcatttcgacgagtctgtcaggatcgacggcggcggcggcagcaggggcaaagtgtacagaggggagctgcgcaacatgtccgtcgccgtgaaggtggtggaccgcgacgtggccgtggacgaggcccgtttcgcccgtgcggtggaaggcatcgcccgagcgagacacccgaacgtggtgacgctcgtgggcgcgtgcccggcggcgcgcgctgtcgtgtacgagctggtgccgggcgggagtctggaggagcgcctgggtccgggaccgggaggcgggaacgggaacgggaacgggagtggctcggcgccgccgtcgctgccgtggcatgcgcggtgcggcgtcgcgtacggggcgtgctccgcgctggcgttcctgcactccacgctgccgcgggcgacggtgcacggcgacgtgaggccggcgaacatcctggtggtggaggacgacgcgcggcgcgggtggtcgtgcaagctggccggcctcggcgagcgcgggctcgtggaggagcgagcgcgccccggcggcgccggcccggcggcgcgggcgtacgcggacccgcggtacctcgctgcgacgggggagctgatcctgaccccgcactgcgacgtgtacgcgctgggcgtggtcctcctccggctggtgaccgggaggccggcgttcctggcgaggaaggcggcgcgggaggccgcgggcggcagggcgtcgtggcaggaggtggcggcgggagggtggccgacggagcgcgccagggaggtggctctgctcgggctgagatgctgcggcgtggacgtggaggcggagcggaggccgcggctccccgccgcggtgctgctggaggaggcccgcggcgtgctggaggccgcgatgagctccgcgccgagcaggtcgccgtcgtcgctgtccctgtcggacggcgccccgtcctacttcctctgcccgatactcaaggaggtgatgagggacccgcagatcgccggcgacgggttcacgtacgaggcggaggccatcggggagtggctgtgcggcggacacgacacgtcgccgatgaccaacctgaagctccccacgcggaagctggtccccaaccacgcgctccgctccgccatccacgagtggcgccaccgccagctccgtgtaaaagtgcggacctggatcaaccaaaaagataaaattgagtttgttggtgttggtgctcgatttggccccaagatagagtcaaaggaaaagcaatccaactggacaaacttgctgttaccagacacttctgattgctgcacccctccaaaagagaaggttgctggagatattttgttagtagagagaggaaactgtacgttcactacaaaggctagggttgctgaatctgctggtgcttctgcgattataatcatcaatgataagcaggagttatacaagatggtatgtgagaccaatgaaacaaatttagatatcggcatacccgctgttcttctgccaaaagatgcagtcttagtggagttgtactctccagatcgtcctctggttgatactgcagaggtgtttctatggcttatggcagttggtaccattctttgtgcatcatactggtcagcatggagcgcccgagaagctgatattgaacaagagaagcttctgaaggatggtcatgaagtaccaccaaactttgaggctggaggttctagtggtatggtagaaatcaacatggtatcggcaatattgtttgtggtgattgcatcatgcttcttgataacactctacaagaagatgtctcattggtttgtggagcttctggtggttatcttttgcataggtggtgtagagggtctgcaaacatgcttggtgggtttactgtcgatgtcaaggtggtttaaacctgctgcaggatcgtttgtgaaagtgccattttttggagctgtttcataccttacattggcagtttgtccgttttgcatagtatttgctgttctgtggggtgtttaccgtcggttgtcctttgcttggattgggcaagatattcttggtattaccttgatcgttacagtcatccaaattgttagaatacctaacctcaaggtgggttcagccctcctgagttgtgccttcttatatgacatcttctgggtttttatctccaagatgatattccatgaaagtgtgatgattgtggttgcacgtggtgataagactgatgaggatggtgtacccatgctgttaaagattcctcggatgtttgatccatggggcggatacagcatcataggctttggtgatatccttcttcctgggctgttggttgcttttgcattaaggtatgattgggctgccaagaagaccttgcaatctggctactttttgtggtcaatggtggcatatggttccggtctcctaattacatacgtcgccttgaaccttatggatggccatggccagcctgctctcctttacattgtgcctttcacgattggcaccttcctagcactaggcatgaagagaggtgagctcagaaacctgtggacgaaagggcagccagagagagtgtgcacgcacatgcacacacacccatccccgaaggactcgcctgttgcagtcagctcgacgtcgtaa

SEQ ID NO: 21043 - protein, 1424 aa, Sorghum bicolor
  misc_feature: Ceres ANNOT ID no. 8682303
  misc_feature: Up-regulated in shoot tissues in response to salicylic acid treatment
  misc_feature (1115)..(1399): Pfam ID: Peptidase_A22B Pfam Description: Signal peptide peptidase
  misc_feature (862)..(936): Pfam ID: U-box Pfam Description: U-box domain
  misc_feature (964)..(1060): Pfam ID: PA Pfam Description: PA domain
  misc_feature (562)..(835): Pfam ID: Pkinase_Tyr Pfam Description: Protein tyrosine kinase
MAPTLLIELSMELKPLKTASLVKWSIQNRVSGLHKSMQPYIPMLAWWNEPGQARAAAAAPAGDERSRRQPQLEQGGGGGGRHQNQNQETEEEHAQAVYCAVGIGIGIGTGSASQNQAQAAEEWKANLRWVLAALAPRRSSRRLVLAHLRRPTSRINIMGAWVPVSQLAEEEVAAYRQLEEERIAKVLDDLLAICQSQKVNASKIIIASDDIARGLVQLVDDHGVTELVMGAASDRAYGRKMRAPRSKKALTVQQKANPSCRIWFVCRGNLICTRDASEGQAHRAESSTASTSPRTSTSDCSRSKSSPCLHSETFSTQETDDPSAEQTHGRDLNIEDSNNQATTIAGSSAAVHLLQEIQEDREMPASDGLDAGEMDDALYEKLKHALMEAENLKQEAYEETRRRQMAERGLAEASRMVMTKLRHFLSKFMSMTICMYADEAERSYQREARHRKEVEEMVARERAAMEQDKRELDGILDQIRKVDDRSAELELQITTSEHTMNDLEARLSESYNLLDTLRHGHHPCNASESASREEGGGEQRVSFLHLGYSELDEATKHFDESVRIDGGGGSRGKVYRGELRNMSVAVKVVDRDVAVDEARFARAVEGIARARHPNVVTLVGACPAARAVVYELVPGGSLEERLGPGPGGGNGNGNGSGSAPPSLPWHARCGVAYGACSALAFLHSTLPRATVHGDVRPANILVVEDDARRGWSCKLAGLGERGLVEERARPGGAGPAARAYADPRYLAATGELILTPHCDVYALGVVLLRLVTGRPAFLARKAAREAAGGRASWQEVAAGGWPTERAREVALLGLRCCGVDVEAERRPRLPAAVLLEEARGVLEAAMSSAPSRSPSSLSLSDGAPSYFLCPILKEVMRDPQIAGDGFTYEAEAIGEWLCGGHDTSPMTNLKLPTRKLVPNHALRSAIHEWRHRQLRVKVRTWINQKDKIEFVGVGARFGPKIESKEKQSNWTNLLLPDTSDCCTPPKEKVAGDILLVERGNCTFTTKARVAESAGASAIIIINDKQELYKMVCETNETNLDIGIPAVLLPKDAVLVELYSPDRPLVDTAEVFLWLMAVGTILCASYWSAWSAREADIEQEKLLKDGHEVPPNFEAGGSSGMVEINMVSAILFVVIASCFLITLYKKMSHWFVELLVVIFCIGGVEGLQTCLVGLLSMSRWFKPAAGSFVKVPFFGAVSYLTLAVCPFCIVFAVLWGVYRRLSFAWIGQDILGITLIVTVIQIVRIPNLKVGSALLSCAFLYDIFWVFISKMIFHESVMIVVARGDKTDEDGVPMLLKIPRMFDPWGGYSIIGFGDILLPGLLVAFALRYDWAAKKTLQSGYFLWSMVAYGSGLLITYVALNLMDGHGQPALLYIVPFTIGTFLALGMKRGELRNLWTKGQPERVCTHMHTHPSPKDSPVAVSSTS

SEQ ID NO: 21044 - DNA, 1134 bp, Sorghum bicolor
  misc_feature: Ceres ANNOT ID no. 8682309
  misc_feature: Down-regulated in root tissues in response to methyl jasmonate treatment
  misc_feature: Up-regulated in root tissues in response to methyl jasmonate treatment
  misc_feature: Down-regulated in root tissues in response to aminocyclopropane carboxylic treatment
  misc_feature: Up-regulated in shoot tissues in response to methyl jasmonate treatment
  misc_feature: Down-regulated in shoot tissues in response to salicylic acid treatment
  misc_feature: Encodes the peptide sequence at SEQ ID NO 21045
atgccgccgccctccgccgccgccacttccaccaccgcagccgccagcgccgcgagggacgacatgtccccggcggaggcccggctggcgatgatggagctggcgaacatggtgtcggtcccgatggcgctgacggccgtaatccggctgggcgtccccgccgcaatatgggctggcggcgccaacgcgccgcggtcggcggccgagctcctcccggcgggccacccggacccgtcggtcctggagcggctgctccgcctgctggcgtcccgcggcgtcttctccgagtccacgtccacgtcggaggaccggacgacgacgacgcggcggttcgcgctcaccgcggtgggccgcacgctggtgccggagggcgcctcgggcgcgtcgtacgccgactacgtgctgcagcaccaccaggacgcgctggtggcggcgtggccgcggctgcacgaggccgtgctggacccgcgcgggcccgagccgttcgcgcgcgccaacgccggcgtccccgcctacgcctactacggcaaggacagggaagctaaccaggtgatgctccgcgccatgacgggggtctccgagcccttcatgcacgccctcctcgacggctacggcttcgacggcgggttccacggcgtcgccacgctcgtcgacgtcgggggaagctccggcgcctgcctcgagatgatcatgcgcagggtccccactatcaaggagggtatcaacttcgacctgcccgacgtcgtcgccgacgcgccggccatcgccggagtgaggcatgttggcggagacatgttcaagtccatcccctctggtgatgccatcttcatgaagtgggttctgacgacgtggaccaacgacgagtgcacggccatcctcaggaactgccacgccgcgctgccggacggcggcaagctggtcgcctgcgagccggtggtgccggaggagacggacagcagcaccaggacgagggcacttctggagaacgacatcttcgtcatgaccacctaccggacgcaggggagggagcgctccgaggaggagttccaccacctcggcatcgccgccggcttcaccggcttccgcgccatctacctcgaccccttctatgccgtcctcgagtacaccaagtga

SEQ ID NO: 21045 - protein, 377 aa, Sorghum bicolor
  misc_feature: Ceres ANNOT ID no. 8682309
  misc_feature: Down-regulated in root tissues in response to methyl jasmonate treatment
  misc_feature: Up-regulated in root tissues in response to methyl jasmonate treatment
  misc_feature: Down-regulated in root tissues in response to aminocyclopropane carboxylic treatment
  misc_feature: Up-regulated in shoot tissues in response to methyl jasmonate treatment
  misc_feature: Down-regulated in shoot tissues in response to salicylic acid treatment
  misc_feature (22)..(364): SWISSPROT Homolog: EC 2.1.1.68 Caffeate O-methyltransferase
  misc_feature (103)..(354): Pfam ID: Methyltransf_2 Pfam Description: O-methyltransferase
MPPPSAAATSTTAAASAARDDMSPAEARLAMMELANMVSVPMALTAVIRLGVPAAIWAGGANAPRSAAELLPAGHPDPSVLERLLRLLASRGVFSESTSTSEDRTTTTRRFALTAVGRTLVPEGASGASYADYVLQHHQDALVAAWPRLHEAVLDPRGPEPFARANAGVPAYAYYGKDREANQVMLRAMTGVSEPFMHALLDGYGFDGGFHGVATLVDVGGSSGACLEMIMRRVPTIKEGINFDLPDVVADAPAIAGVRHVGGDMFKSIPSGDAIFMKWVLTTWTNDECTAILRNCHAALPDGGKLVACEPVVPEETDSSTRTRALLENDIFVMTTYRTQGRERSEEEFHHLGIAAGFTGFRAIYLDPFYAVLEYTK

SEQ ID NO: 21046 - DNA, 3315 bp, Sorghum bicolor
  misc_feature: Ceres ANNOT ID no. 8682450
  misc_feature: Down-regulated in shoot tissues in response to salicylic acid treatment
  misc_feature: Encodes the peptide sequence at SEQ ID NO 21047
atggagccttccacccccacccccacccccacccccacccctcgccgtggcggagcccccgccgactacgccgccatgtccccctccttttcccacacgcccaggagcggcgcctcttcctccgcccacaagccccccacaagcaggcaccgggatcgcggccccctcgtcttcaacggcaacagtaacagcagcagcatcagcgctgcccagcaggcctcgcagcagcagcaaacctccacctccaccaccaccacctcctcctccaagggttctggatccggaggcgtcaacgtccaggtcctccttagatgcaggccattgagcgaggaggaacgccgcattggcacacctgtggtggtcacttgcaatgaccagagacgggaggtttctgttgcccagaacatcgctaacaagcaaattgatcgcacctttgcattcgacaaggtgttcggaccaaagtcccagcagcaggatgtcttcaaccatgctgttgtgccacttgtcagagaggttttggacggttacaattgcacaatatttgcatatggtcagactggaactggcaaaacatacaccatggaaggaggagggggcaaagcactgaacggtgacctcccatctgatgctggtgtcattccaagggctgttaagcgcatatttgacatcctcgaggcacagagttcagagtacagcatgaaggtttcttttcttgagctgtacaatgaggagctcactgatcttctagccccagaggaatctaagttccctgatgacaagtccaagaagcctatggcactcatggaggatggcaagggaggagtctttgttagggggctcgaggaagaactagtttcttcagctgctgagatctacaggatactggagagaggctctgcaaagagaaaaactgctgagactcttctcaacaagcaaagcagtcgctcacactctattttctccatcaccatccatattaaggaatgcacacctgagggtgaggacatgatcaagtgtggaaagcttaatctcgttgaccttgctggctctgaaaacatatctaggtccggagctagagacgggcgagctcgcgaggcaggagaaattaacaagagtctgcttacacttgggcgtgttattaatactcttgttgagcactctggacacataccatacagggatagcaagttaacaagactattaagagattctttgggagggaagacaaagacttgcatcatagcgaccatctcaccttcagtacactgccttgaggagacgctaagcaccctggattacgcgtatcgtgcaaaacacatcaagaataagccagaggtcaatcagaagatgatgaaatctgcgctcatcaaagatttgtattttgaaatggaccgtctcaagcaagaactttatgctgcaagggagaaaaatggtgtttatattccaagggaacaatacttagcagatgaagctgaaaaaaagcatgacagaggaattcttcaggctatgtcagagaaactggatcgtttggagcttattttggaatcgaaagataagcaattagaagaccttcaaggactctatgattctcagaaagttctgagtgcagatctaagtgatcaacttcagacattgcataaaagaatgaaggaaatagagtgcaccctagcggatcttgaagcgaaatacatgaaggcaaataatactattaaggagaagcaatatttgatagaaaatcttcttaaatcagaaaaagttcttgttggtgaagcacaaagactccgatcagagctggagaatacagcaggggatctatatgggctattttcaaaattagaaaggaaggaaaagatcgaagatacaaatagaagtacaattcaacatttccattcccagctgactcaagacattagtgtcttgcatagaacagtctcaacctcggtctctcaacaggagagccaactaaaatcacttgaagaagagatgcaatcttttgtcacctcaaagtgcaaggttgctggagaacttcaagagcatgtaagaaagctcaaagagagcttcaattctaggatagaagaattgcatggttttgcaaatgaactcaagcataaatctgtgttgagctttgaaaaccttaattcgcaagttatcacacacacatctggccttgaggattgcatgaagggcctgttggttgatgctgaccaaatactcattgcactacaaaatgggctttctcagcaagaagtgaactttgctacatttattgagcagcagcatgaggggctctctagaaatttggagagaacaaagtctgtttcgacgactacaataaacttcttcaaaactatagattcccatgcattggagctcataaagattttggaagaatcacagatggaacatcaaaagcaactcttccagcttcagaagaagtttgaggcctttgttgctgatgaagaaaagtacttgatggagaaggtcacagggttatttgcagaatcgaatgctagaaagaaaaatatggttcaagatgatatatgcagcctcaataggactgcttctgagcgttcaaacaatttacaaactgaaactaccaagcttcatgattttacatcttctatgaaagagcaatgggaagcctacatgaagagaactgaagaggcattccaacaaaatgtatcatctattgaacagaaacgatgcttcttggtagggaatttgcagcagtgcaagggaagggtagaatcatgttcagaacaatggattacggcacaaaatttggtgttggcgcttggaagaaacaatgcagaagccattggttcagtcataagtgctgggaatgaggtgagcaaccaactggatgcaagattttcatctgctgtcactgctgggtttgaagatagtgacatttcaagcaaatcccttcttagttcttttgacgattcattaaaattggaccatggtatttgcgacaatgtgaaatccatcgtgatgacatccagaacagaacttcatgacttagaacatggtcactatgagaagacaaaagtagtaacagggaatgccgatagatctctgggagatgattataaggtggatgaagcaacttgttcaacaccgagaaggcgtgagatcaacattccggacagccaatcgatcagggggttggtaaccccccttgatgatctcgtgaaggcattttgggacagcagaacaccgacgaagcttgctttaactggaaacgggaagcagcagttggcagggtcgacgacacccgaaacacagagagcccctcttgccgcgataaactag

SEQ ID NO: 21047 - protein, 1104 aa, Sorghum bicolor
  misc_feature: Ceres ANNOT ID no. 8682450
  misc_feature: Down-regulated in shoot tissues in response to salicylic acid treatment
  misc_feature (104)..(441): Pfam ID: Kinesin Pfam Description: Kinesin motor domain
MEPSTPTPTPTPTPRRGGAPADYAAMSPSFSHTPRSGASSSAHKPPTSRHRDRGPLVFNGNSNSSSISAAQQASQQQQTSTSTTTTSSSKGSGSGGVNVQVLLRCRPLSEEERRIGTPVVVTCNDQRREVSVAQNIANKQIDRTFAFDKVFGPKSQQQDVFNHAVVPLVREVLDGYNCTIFAYGQTGTGKTYTMEGGGGKALNGDLPSDAGVIPRAVKRIFDILEAQSSEYSMKVSFLELYNEELTDLLAPEESKFPDDKSKKPMALMEDGKGGVFVRGLEEELVSSAAEIYRILERGSAKRKTAETLLNKQSSRSHSIFSITIHIKECTPEGEDMIKCGKLNLVDLAGSENISRSGARDGRAREAGEINKSLLTLGRVINTLVEHSGHIPYRDSKLTRLLRDSLGGKTKTCIIATISPSVHCLEETLSTLDYAYRAKHIKNKPEVNQKMMKSALIKDLYFEMDRLKQELYAAREKNGVYIPREQYLADEAEKKHDRGILQAMSEKLDRLELILESKDKQLEDLQGLYDSQKVLSADLSDQLQTLHKRMKEIECTLADLEAKYMKANNTIKEKQYLIENLLKSEKVLVGEAQRLRSELENTAGDLYGLFSKLERKEKIEDTNRSTIQHFHSQLTQDISVLHRTVSTSVSQQESQLKSLEEEMQSFVTSKCKVAGELQEHVRKLKESFNSRIEELHGFANELKHKSVLSFENLNSQVITHTSGLEDCMKGLLVDADQILIALQNGLSQQEVNFATFIEQQHEGLSRNLERTKSVSTTTINFFKTIDSHALELIKILEESQMEHQKQLFQLQKKFEAFVADEEKYLMEKVTGLFAESNARKKNMVQDDICSLNRTASERSNNLQTETTKLHDFTSSMKEQWEAYMKRTEEAFQQNVSSIEQKRCFLVGNLQQCKGRVESCSEQWITAQNLVLALGRNNAEAIGSVISAGNEVSNQLDARFSSAVTAGFEDSDISSKSLLSSFDDSLKLDHGICDNVKSIVMTSRTELHDLEHGHYEKTKVVTGNADRSLGDDYKVDEATCSTPRRREINIPDSQSIRGLVTPLDDLVKAFWDSRTPTKLALTGNGKQQLAGSTTPETQRAPLAAIN

SEQ ID NO: 21048 - DNA, 3048 bp, Sorghum bicolor
  misc_feature: Ceres ANNOT ID no. 8682499
  misc_feature: Down-regulated in shoot tissues in response to salicylic acid treatment
  misc_feature: Encodes the peptide sequence at SEQ ID NO 21049
atggctgccagggcgcccgagatcgatgaggacctccacagccgccagctcgccgtctatgggcgcgagactatgaagcgcctcttcggctccaacgtccttgtctctggactccagggactaggcgctgagatcgcaaaaaaccttgtccttgctggtgtcaagtctgtaaccttgcatgatgatggcaaagtcgagctatgggacttgtcaagcaacttcttcctctcagagaaggatgttgggcaaaaccgtgctcaagcttgtgttccaaagctacaagagcttaacaatgctgtcattatctctaccataactggtgatttgtccaaggagcagctttctaactttcaggctgtggtctttactgatatcagcatagaaaaagcagttgagtttgatgattactgtcatagccatcagccaccaattgctttcattaagtcagaagttcgtggtctttttggcagtgttttctgtgattttggtcctgagtttactgttttggatgttgatggtgaggaaccacatacaggaattgtggcatcaatcagcaatgacaacccagcacttgtttcttgtgtggatgatgagcgcttggagttccaagatggcgatctagttgttttctctgaagtgcatggaatgactgagctcaatgatggaaaaccaagaaagatcaagagtgcaaggccttattctttcactctagaagaagacaccacctcatatggcacctacattagaggtggtattgtcacacaggtgaagccaccaaaggttctgaaattcaaaaccctgaaggaggcaatcaaggagccaggagaatttctcatgagtgatttctccaagtttgaccgcccacctcttttgcatttggccttccaagctttggacaagtttaggactgagttggcacggttccctattgctgggtcagctgatgatgcacaaaagctgattgatcttgctattagtattaatgaaactcttggtgatagtaagcttgaagaaattgataagaagctcctgcagcatttcgcaagtggttccagggctgttttgaatcccatggctgcaatgtttggtggtattgtgggtcaggaggttgttaaagcatgctcagggaaattccatccactttaccagttcttctactttgattctgtcgaatctctgccagttgaaccattggagcctagtgatttgaagccagagaacagtagatatgatgcacaaattagtgtcttgggggctaagcttcaaaagaaactggagcagtcaaaaatattcatggttggttctggggctcttggatgtgaattcttgaagaaccttgcattaatgggtatttcttgcagtcaaaatgggaagctgactgttacagatgacgatgttatagagaaaagcaatctcagtcgccagtttctcttccgtgactggaacattgggcagcccaagtccacagttgctgcaactgctgctatggcaattaatcctaagcttcatgtggaggcccttcagaacagagcaagtcctgagactgaaaatgtgtttaatgatgccttttgggagagcttggatgctgttgttaatgcactggacaatgtaaccgcaagaatgtatattgactccagatgtgtatatttccagaaaccacttcttgaatcaggcactctgggtgctaagtgcaacacacagatggtcattcctcacctaacagaaaactatggggcatccagagatccaccagaaaagcaggcacctatgtgcactgtacattcatttcctcacaatattgatcactgcctgacgtgggctaggtctgagtttgagggtctacttgagaagactcccaccgaagtaaatgctttcctgtcgaaccctggtgggtatgcaactgcagcaagaactgctggtgatgcacaggctagggaccaacttgagcgagttattgaatgccttgagacagacaagtgtgagacattccaagattgtattacctgggcccggcttaagtttgaggattatttctccaaccgtgtaaagcagctgacattcactttccctgaagatgcaatgactagctctggtgctcctttctggtctgctcctaagcggttcccgcgacctctggagttctcatcttccgactcaagtcacctgaactttttgttggctgcttctatattaagggcagagacatttggaatacccatacctgattgggcgaaaaacccaacgaaactggctgaagctgtggacaaggtcatcgttccggatttccaaccaaaacagggtgttaagatagagacagatgagaaggctactagcctttcctctgcatctgttgatgatgctgctgttattgaagagcttattgcgaagctggaaacaatttctaaaacattgccaccaggattccatatgaaccctatacagtttgagaaggatgatgataccaatttccatatggacttgatcgctggctttgccaacatgcgggctaggaattacagcatccctgaagttgacaagttgaaggcaaagttcatagctggaagaatcattccagccatcgccacctcaactgcaatggccactggccttgtctgcctggagctttacaaagtcctcgctggtgggcacaaggttgaagactaccggaacacatttgcgaaccttgcaatccccctcttctccatggcagagcctgtgccacccaagaccatcaagcaccaagacatgtcctggactgtctgggaccgctggaccgtaactggcaacatcacgctgagggagctcctggagtggctcaaggagaagggcctgaatgcgtacagcatatcctgtgggacctcgctgctgtacaactccatgttcccgaggcacaaggaccggctggacaagaaggtggtggatgtggccagggaggtggccaaggtggaggtgccttcgtaccgccgccatctggacgttgtggtggcctgtgaggatgacgatgacaatgacgttgacatcccgcttgtgtccatttacttccggtaa

SEQ ID NO: 21049 - protein, 1015 aa, Sorghum bicolor
  misc_feature: Ceres ANNOT ID no. 8682499
  misc_feature: Down-regulated in shoot tissues in response to salicylic acid treatment
  misc_feature (426)..(570): Pfam ID: ThiF Pfam Description: ThiF family
  misc_feature (29)..(168): Pfam ID: ThiF Pfam Description: ThiF family
  misc_feature (814)..(882): Pfam ID: UBACT Pfam Description: Repeat in ubiquitin-activating (UBA) protein
  misc_feature (713)..(774): Pfam ID: UBACT Pfam Description: Repeat in ubiquitin-activating (UBA) protein
MAARAPEIDEDLHSRQLAVYGRETMKRLFGSNVLVSGLQGLGAEIAKNLVLAGVKSVTLHDDGKVELWDLSSNFFLSEKDVGQNRAQACVPKLQELNNAVIISTITGDLSKEQLSNFQAVVFTDISIEKAVEFDDYCHSHQPPIAFIKSEVRGLFGSVFCDFGPEFTVLDVDGEEPHTGIVASISNDNPALVSCVDDERLEFQDGDLVVFSEVHGMTELNDGKPRKIKSARPYSFTLEEDTTSYGTYIRGGIVTQVKPPKVLKFKTLKEAIKEPGEFLMSDFSKFDRPPLLHLAFQALDKFRTELARFPIAGSADDAQKLIDLAISINETLGDSKLEEIDKKLLQHFASGSRAVLNPMAAMFGGIVGQEVVKACSGKFHPLYQFFYFDSVESLPVEPLEPSDLKPENSRYDAQISVLGAKLQKKLEQSKIFMVGSGALGCEFLKNLALMGISCSQNGKLTVTDDDVIEKSNLSRQFLFRDWNIGQPKSTVAATAAMAINPKLHVEALQNRASPETENVFNDAFWESLDAVVNALDNVTARMYIDSRCVYFQKPLLESGTLGAKCNTQMVIPHLTENYGASRDPPEKQAPMCTVHSFPHNIDHCLTWARSEFEGLLEKTPTEVNAFLSNPGGYATAARTAGDAQARDQLERVIECLETDKCETFQDCITWARLKFEDYFSNRVKQLTFTFPEDAMTSSGAPFWSAPKRFPRPLEFSSSDSSHLNFLLAASILRAETFGIPIPDWAKNPTKLAEAVDKVIVPDFQPKQGVKIETDEKATSLSSASVDDAAVIEELIAKLETISKTLPPGFHMNPIQFEKDDDTNFHMDLIAGFANMRARNYSIPEVDKLKAKFIAGRIIPAIATSTAMATGLVCLELYKVLAGGHKVEDYRNTFANLAIPLFSMAEPVPPKTIKHQDMSWTVWDRWTVTGNITLRELLEWLKEKGLNAYSISCGTSLLYNSMFPRHKDRLDKKVVDVAREVAKVEVPSYRRHLDVVVACEDDDDNDVDIPLVSIYFR

SEQ ID NO: 21050 - DNA, 768 bp, Sorghum bicolor
  misc_feature: Ceres ANNOT ID no. 8682501
  misc_feature: Down-regulated in shoot tissues in response to aminocyclopropane carboxylic treatment
  misc_feature: Down-regulated in shoot tissues in response to methyl jasmonate treatment
  misc_feature: Up-regulated in root tissues in response to methyl jasmonate treatment
  misc_feature: Up-regulated in root tissues in response to salicylic acid treatment
  misc_feature: Up-regulated in shoot tissues in response to salicylic acid treatment
  misc_feature: Encodes the peptide sequence at SEQ ID NO 21051
atgctgagggtttccccgtccccggccgccgccgccgcgggcaaccagttcgctggtgcggccgtagcccccgctcccgttcccgtcagggtcgccgcgccgcgcggcggcgtctcgccgtccgctgcagctgcgtgcagggcctccgggaaggggaaggaggtgctcagcggggtcgtgttccagccgttcgaggagatcaagggggagctcgccctcgtgccgcagacgcctgacaagtcactcgcccgacacaagttcgtggacgagtgcgaggccgccctcaacgaacagatcaatgtggagtacaacgcctcgtatgcgtaccactccctcttcgcttacttcgaccgtgacaacgttgctctcaaaggatttgccaagttctttaaggaatcgagcgacgaggagagggagcatgctgagaagctcatggagtaccagaacaaacgtggaggcagggtgaggctccaatccattgtgacgcccttgactgaatttgaccaccctgagaaaggcgatgctttgtacgctatggagcttgctctggctctggaaaagctggttaatgagaagctgcacaacctgcatggtgtagcaacaaggtgcaatgatccgcacctgacagacttcatcgagagcgagttccttgaggagcaggtggaggccataaataagatctcgaagtatgttgcccagctgaggagagtgggcaaggggcacggggtgtggcactttgatcagatgctgcttgaggaagaggcctaa

SEQ ID NO: 21051 - protein, 255 aa, Sorghum bicolor
  misc_feature: Ceres ANNOT ID no. 8682501
  misc_feature: Down-regulated in shoot tissues in response to aminocyclopropane carboxylic treatment
  misc_feature: Down-regulated in shoot tissues in response to methyl jasmonate treatment
  misc_feature: Up-regulated in root tissues in response to methyl jasmonate treatment
  misc_feature: Up-regulated in root tissues in response to salicylic acid treatment
  misc_feature: Up-regulated in shoot tissues in response to salicylic acid treatment
  misc_feature (39)..(255): SWISSPROT Homolog: EC 1.16.3.1 Ferroxidase
  misc_feature (92)..(237): Pfam ID: Ferritin Pfam Description: Ferritin-like domain
MLRVSPSPAAAAAGNQFAGAAVAPAPVPVRVAAPRGGVSPSAAAACRASGKGKEVLSGVVFQPFEEIKGELALVPQTPDKSLARHKFVDECEAALNEQINVEYNASYAYHSLFAYFDRDNVALKGFAKFFKESSDEEREHAEKLMEYQNKRGGRVRLQSIVTPLTEFDHPEKGDALYAMELALALEKLVNEKLHNLHGVATRCNDPHLTDFIESEFLEEQVEAINKISKYVAQLRRVGKGHGVWHFDQMLLEEEA

SEQ ID NO: 21052 - DNA, 1530 bp, Sorghum bicolor
  misc_feature: Ceres ANNOT ID no. 8683051
  misc_feature: Down-regulated in shoot tissues in response to aminocyclopropane carboxylic treatment
  misc_feature: Down-regulated in root tissues in response to methyl jasmonate treatment
  misc_feature: Down-regulated in shoot tissues in response to methyl jasmonate treatment
  misc_feature: Down-regulated in shoot tissues in response to salicylic acid treatment
  misc_feature: Encodes the peptide sequence at SEQ ID NO 21053
atggaagcagccgactcgtcgctgccatgggcggcgcagtgcttgggcgcagccctgttcgccgccgcgctctgcgtggcggcgctgggcgtcgtgctgacgctcctccggcggtggccctggtgcagctgccacgtttgccgggcgtacctgacgggttcgtgggcgcgggacttcaccaacctcggcgactggtacgcgcacctgctccgggactcccccaccggcaccgtccacgtccacgtcctcggctgcaccgtcaccgccaacccggccaacgtcgagtacatgctccggaccaacttcgacaacttccccaaggggaaagccttcgcggcggtgctcggggacctcctcggcggcggcatcttcaacgtcgacggccacgcctggctccaccagcgcaagatggccagcctcgagctcggcagcgtcgccgtccggtcctacgcgttcgggatcgtcgcgcaggaggtggagtcccgcctcgtcccggtcctcgcctccgccgccgacgctggcgcggtcgtcgacctgcaggacgtgttccgtcgcttcgcgttcgacaccatctgcaagatctccttcggcctcgacccggggtgcctcgacctggagatgcccgtgtccaagctcgccgacgccttcgacaccgccacgcgcctctgcgccatgcgcggcgccgccgcgtcgccgctgctgtggaaagccaagcgcctgctcaacgtcgggtccgagagggagctcagggaggccatcaagctcgtcgacgagctctcggccgccatgatccgggaacgccggaagttaggcgtcgccggcagccacgacctcctgtcccggttcatggcctcgtccggcgacgcgcgccacgacgtcgacgacaagtacctccgcgacatcgtggtcagcttcctcctggccgggcgcgacaccgtgtcctccgcgctcaccacgctcttcatgctcctgtccaagaacccggccgtggcgtccgccatgcgcgcggaggccgccggcggcgacgagtccaccgcggcgctcacgtacgagcacctcaagcgcctgcactacacgcacgcggtgctgtacgagaacatgcggctgttcccgccggtgcagttcgactccaagttcagcgcgggctccgacgtgctccccgacggcacctacgtcgccggcggcacgcgcgtgacgtaccacccctacgccatgggccggatgccgcgcatctggggcgccgaccacggcgcgttccgccccgaccggtggctcaccggacccggcgggacgttcgtgcccgagagcctgtacaggtaccccgtgttccaggcgggcctccgcgtctgcctcggcaaggagctcgccgtcaccgagatgaaggcggtcgcggtggccgtggtgagagcgttcgacgtcgaggtcgtcggggacggtggcaacgccgcctgcgcgcccaagttcgtgtcggggctcaccgcgtccatcagcggcggccttccagtgaggatcaggagagttgttcgttaa

SEQ ID NO: 21053 - protein, 509 aa, Sorghum bicolor
  misc_feature: Ceres ANNOT ID no. 8683051
  misc_feature: Down-regulated in shoot tissues in response to aminocyclopropane carboxylic treatment
  misc_feature: Down-regulated in root tissues in response to methyl jasmonate treatment
  misc_feature: Down-regulated in shoot tissues in response to methyl jasmonate treatment
  misc_feature: Down-regulated in shoot tissues in response to salicylic acid treatment
  misc_feature (74)..(461): SWISSPROT Homolog: EC 1.14.13.98 Cholesterol 24-hydroxylase
  misc_feature (33)..(502): Pfam ID: p450 Pfam Description: Cytochrome P450
MEAADSSLPWAAQCLGAALFAAALCVAALGVVLTLLRRWPWCSCHVCRAYLTGSWARDFTNLGDWYAHLLRDSPTGTVHVHVLGCTVTANPANVEYMLRTNFDNFPKGKAFAAVLGDLLGGGIFNVDGHAWLHQRKMASLELGSVAVRSYAFGIVAQEVESRLVPVLASAADAGAVVDLQDVFRRFAFDTICKISFGLDPGCLDLEMPVSKLADAFDTATRLCAMRGAAASPLLWKAKRLLNVGSERELREAIKLVDELSAAMIRERRKLGVAGSHDLLSRFMASSGDARHDVDDKYLRDIVVSFLLAGRDTVSSALTTLFMLLSKNPAVASAMRAEAAGGDESTAALTYEHLKRLHYTHAVLYENMRLFPPVQFDSKFSAGSDVLPDGTYVAGGTRVTYHPYAMGRMPRIWGADHGAFRPDRWLTGPGGTFVPESLYRYPVFQAGLRVCLGKELAVTEMKAVAVAVVRAFDVEVVGDGGNAACAPKFVSGLTASISGGLPVRIRRVVR

SEQ ID NO: 21054 - DNA, 1497 bp, Sorghum bicolor
  misc_feature: Ceres ANNOT ID no. 8683222
  misc_feature: Up-regulated in shoot tissues in response to salicylic acid treatment
  misc_feature: Up-regulated in root tissues in response to salicylic acid treatment
  misc_feature: Encodes the peptide sequence at SEQ ID NO 21055
atggaggcactgatttcagcagctgcaggtgaacttgtcagccggttcatctctttcatggcacagaaattctgcgatcgtacgctgaatgagggtgaccatagaagattggagcagctcctgctaaggattcataccatcgttgaggaggcagagggacggcgaatcacaaatagaggaatgctactccagctgaagatgctcatggagggcatgtaccaagggcactacatgcttgacaggttcaagatacagcatgctgaacaaggcaaaatcaaaggccaggggagtcatcagagtcgatcgtttgccatgtctactttgactgccgccaagcgccttcgttttgcttctgctaccacaaaggacacaccagtagcttttggtaccgggagcctgaaaggtgttcttgacagtttagaagcaaagattcaggatatgagggaattcgtcatgctacttggtagctgcccacgcctgcctcgtcagatgtactgtacatatctgttcatggataagtgcatgtttggtcgccacaccgagaaggagcatgtcatcaatttcttgctgtgcagtgatggtactcatgatgactgcccaaatcttggcatccttccgatcatcggtccgcaccgagtcgggaagaaaactcttgtgcaacatgcttgcaaggatgagagggtacgcggtttcttctccaagatattgttcttcaaaggggatgatcttgagaacgcagaattcgcggtgagtttagaggccgcctcagggaagaagtgcttgtttgttgttgagttcagctggaatgtggatgaggcggcatgggcaaacttcaaatccacttttcaggaggcgacgggtcatggaagtaaagttcttctgataggaagaactcaggaagttgctaagttggggacggcaatgcccatctggatgaagagtttgtctcaagaagagtactggtactacttcaaggcacttgctttcggaagcatggatcctgatgagcatccaaaacttgcatctctgggcatgcagctggctactgaactaaaaggctcattccttggtgcaaacatacttggtgagatgttaaggtccaatcctagtgctcagttctggcacgccatcctgtcaagcgtaagagcgctggtacaggaacacatgttttcccttggggtacaccctgaagacctccttgagagaaatgttcctgttggtttcactaatgtttcccttgtgggtgctcaaagtcaggggtgtctggtgtatgatcttagggaggctgaccctggacaagaagagctaccactgcctacgtcgcgagaagtactgacgggtgtcaaggttcctgctgaggagaagtttgatgtgctggtatggaaatctcgcatcccaccttacatcagctatgtagttacctatgagagacagaaggcgccccggcgcagagttggcaagaagagccgtctggctctgagagaagtatcatcgtag

SEQ ID NO: 21055 - protein, 498 aa, Sorghum bicolor
  misc_feature: Ceres ANNOT ID no. 8683222
  misc_feature: Up-regulated in shoot tissues in response to salicylic acid treatment
  misc_feature: Up-regulated in root tissues in response to salicylic acid treatment
  misc_feature (159)..(434): Pfam ID: NB-ARC Pfam Description: NB-ARC domain
MEALISAAAGELVSRFISFMAQKFCDRTLNEGDHRRLEQLLLRIHTIVEEAEGRRITNRGMLLQLKMLMEGMYQGHYMLDRFKIQHAEQGKIKGQGSHQSRSFAMSTLTAAKRLRFASATTKDTPVAFGTGSLKGVLDSLEAKIQDMREFVMLLGSCPRLPRQMYCTYLFMDKCMFGRHTEKEHVINFLLCSDGTHDDCPNLGILPIIGPHRVGKKTLVQHACKDERVRGFFSKILFFKGDDLENAEFAVSLEAASGKKCLFVVEFSWNVDEAAWANFKSTFQEATGHGSKVLLIGRTQEVAKLGTAMPIWMKSLSQEEYWYYFKALAFGSMDPDEHPKLASLGMQLATELKGSFLGANILGEMLRSNPSAQFWHAILSSVRALVQEHMFSLGVHPEDLLERNVPVGFTNVSLVGAQSQGCLVYDLREADPGQEELPLPTSREVLTGVKVPAEEKFDVLVWKSRIPPYISYVVTYERQKAPRRRVGKKSRLALREVSS

SEQ ID NO: 21056 - DNA, 1170 bp, Sorghum bicolor
  misc_feature: Ceres ANNOT ID no. 8683306
  misc_feature: Down-regulated in shoot tissues in response to aminocyclopropane carboxylic treatment
  misc_feature: Down-regulated in shoot tissues in response to salicylic acid treatment
  misc_feature: Encodes the peptide sequence at SEQ ID NO 21057
atgtctcaccgcaagttcgagcacccgaggcacggctccctcggcttcctccccaggaagcggtcctcccgccaccgcggcaaggtgaagtcattccccagggatgaccccaagaaggcttgccacctcaccgccttccttggctacaaggctggcatgactcacattgtgcgtgaggtcgagaagcctggatccaaactacacaagaaggaaacgtgtgaggctgttaccatcattgaaacccctcctctggtcattgttgggcttgtggcatatgtgaagactcctcgcggcctccgcacactcaacactgtttgggctcagcatcttagcgaagaagttaggagaaggttctacaagaactggtgcaagagcaagaagaaggctttctccaagtatgctctcaagtatgacaatgatgctggcaagaaggaaattcagctgcagcttgagaagatgaagaaatatgcttctgttgtccgtgtcattgcccatacccagattaagaagatgaagggtttgaagcagaagaaggctcatctcatggagattcaggtcaatggtggtaccattgctgacaaggtggactatggctacaagttctttgagaaggaggtccctgttgatgctgtcttccagaaggatgagatgattgacattattggtgtgaccaagggtaagggttatgagggtgtggtcactcgttggggtgtcacccgccttcctcgcaagacccacaggggtctgcgcaaggttgcttgtattggtgcatggcatccggctagggtatcctacactgttgcccgtgctggtcagaatggataccaccaccgtactgagatgaacaagaaggtttacaagattggcaaggctggacaagagacccatgatgcctccacagagtttgacaggactgagaaggacatcactccaatgggtggcttcccccactatggtatagtgaagggtgactacctgatgatcaagggctgctgcgtgggtccgaagaagagggtggtgaccctccgccagtccctgcttaagcagacttctcggctggccctcgaggagatcaagctcaagttcatcgacacctcatccaagttcgggcacggccgcttccagaccaccgaggagaagcagaggcactatggcaaggtcaaggcctaa

SEQ ID NO: 21057 - protein, 389 aa, Sorghum bicolor
  misc_feature: Ceres ANNOT ID no. 8683306
  misc_feature: Down-regulated in shoot tissues in response to aminocyclopropane carboxylic treatment
  misc_feature: Down-regulated in shoot tissues in response to salicylic acid treatment
  misc_feature (50)..(343): Pfam ID: Ribosomal_L3 Pfam Description: Ribosomal protein L3
MSHRKFEHPRHGSLGFLPRKRSSRHRGKVKSFPRDDPKKACHLTAFLGYKAGMTHIVREVEKPGSKLHKKETCEAVTIIETPPLVIVGLVAYVKTPRGLRTLNTVWAQHLSEEVRRRFYKNWCKSKKKAFSKYALKYDNDAGKKEIQLQLEKMKKYASVVRVIAHTQIKKMKGLKQKKAHLMEIQVNGGTIADKVDYGYKFFEKEVPVDAVFQKDEMIDIIGVTKGKGYEGVVTRWGVTRLPRKTHRGLRKVACIGAWHPARVSYTVARAGQNGYHHRTEMNKKVYKIGKAGQETHDASTEFDRTEKDITPMGGFPHYGIVKGDYLMIKGCCVGPKKRVVTLRQSLLKQTSRLALEEIKLKFIDTSSKFGHGRFQTTEEKQRHYGKVKA

SEQ ID NO: 21058 - DNA, 1476 bp, Sorghum bicolor
  misc_feature: Ceres ANNOT ID no. 8683466
  misc_feature: Up-regulated in shoot tissues in response to salicylic acid treatment
  misc_feature: Encodes the peptide sequence at SEQ ID NO 21059
atgccgccgccgttaccgccgtctccccctcccccgcgtctcctcgccggcggcgaccaccacccgcccccgacctccgcctcctccccggaacaccccttccactccgcgcatctcgtcctcccctccccgtctccgtccaccgccgacctctcctcgccgcacctacccttcgccctcgccttcgccttcatcacccagccttccccgctcccgcggcgtctccttgtcgtcctccacgcagccggcgcccgcttccccgccttctaccacgccttcgcgtccgctctcctctccctccccttccccctcctcctcccccacccacgcacccgcctcctcctcgccgcctcggagctcgcccgcgcggcggcgccggggttcgcgcccctcctcgtctccctcctccgccgcgtgccgttccccggggacgcccgcctgctcgaggtcttgcacgagcacgcctcgtttctcgccgacgaggagccccaggtcctcgccaccgccgtgttcgccttcctacgactcctctccaggaaccgcctcgctccggccgcaggcagcgtcgagtgcaaggactgcgaggagtgcaatggtgccaagaatctgcaagaatgcaggggaaggcttgtgtctttctgcgtctccgtgctgcgggatcacttccaagtgtgcgcactgctcggaagggaccttgtgaggtcgctccacgagctggcgctcgtgcccgagttccagctgctgtggagagacttgattcttgaccgtgctgccgacgtctgtcggattggcacaccccggtggtgcacggcggtggccatcacgtcggagatggagacacagctcttgttcatgatgaacaatgtgaagtggggcgatcagaagaggtaccagctgtggttcgcaaggaagcacctgatggtgcctggaggggaggagaggatccctgacattgtgcggttcatatgctgcgggtaccacccgaccaatgaggtcatgcaatctggtgtcattgctcgctgggcggtcgtaggttggttgcttacgagttgcagcaagggttatgttgtggccaatgcaaagctggcgctgttctatgactggttgttcttcgagaaggggaggggtagtgtcatgaatattgaacctgctatgctcctgatggtgaactcagtgtctcagtacactgatatcacgaacatgctgcttgagttcttgtttcttctgattgacaactatgatgtgcagcggaaagaggtgattgcacgctgtgtgaggagtgcgtttggggtgctggtgaagaaaggagtggttccgtcattggtgccattgacaggttgtgacaagttatcgctgttgctcaggcaaaagcttctggcttttttatctgatacttgtgaggtggctgaagaagcttgcgggaagccaatcaatgaggtttctaaaggaacagaattgaacaagagaatttgctga

SEQ ID NO: 21059 - protein, 491 aa, Sorghum bicolor
  misc_feature: Ceres ANNOT ID no. 8683466
  misc_feature: Up-regulated in shoot tissues in response to salicylic acid treatment
MPPPLPPSPPPPRLLAGGDHHPPPTSASSPEHPFHSAHLVLPSPSPSTADLSSPHLPFALAFAFITQPSPLPRRLLVVLHAAGARFPAFYHAFASALLSLPFPLLLPHPRTRLLLAASELARAAAPGFAPLLVSLLRRVPFPGDARLLEVLHEHASFLADEEPQVLATAVFAFLRLLSRNRLAPAAGSVECKDCEECNGAKNLQECRGRLVSFCVSVLRDHFQVCALLGRDLVRSLHELALVPEFQLLWRDLILDRAADVCRIGTPRWCTAVAITSEMETQLLFMMNNVKWGDQKRYQLWFARKHLMVPGGEERIPDIVRFICCGYHPTNEVMQSGVIARWAVVGWLLTSCSKGYVVANAKLALFYDWLFFEKGRGSVMNIEPAMLLMVNSVSQYTDITNMLLEFLFLLIDNYDVQRKEVIARCVRSAFGVLVKKGVVPSLVPLTGCDKLSLLLRQKLLAFLSDTCEVAEEACGKPINEVSKGTELNKRIC

SEQ ID NO: 21060 - DNA, 3465 bp, Sorghum bicolor
  misc_feature: Ceres ANNOT ID no. 8683544
  misc_feature: Down-regulated in root tissues in response to aminocyclopropane carboxylic treatment
  misc_feature: Encodes the peptide sequence at SEQ ID NO 21061
atggacctcctcatcgcgcagatcaccaccgacctccgctcctctgacgcgctccggcagtcgtcggcgctgctgcaggccctgcagcagtgcgccgcggggcgggacgtctccgcgctcgcccgaaccgcggccaccgagatcctgtccgcgccctcctccgccgtctgcaagcgccttgcgctcgacctcctccgcgcgctcccgctgccgccggacctcctcgacccgctcctcctctcctccctccgctccgacctctccttcccggaccccgacgtcgccgcctcctccatcgcctcgttcccgtccctgccctcgcaccttctcccctcgctcctctcctccgcccactccgagatcgctggcgcgctctcctcgcccgccgagtcgctgcgcctcgccgccgtcacatctctgtcctcgctcctcccgcgcgatgacctcgcgctcatgtgctccacgaacccctccctcatggcgcacgccaccacgtggtggggccgcctggccgagcttgcgttggactctgcagacgcggtttccgccggtgcgtttgaggcccttgcacggctgttccaggagctagaggggcgccgtatgagcaggctagctggtgacaagcttgttgatggagaaggtgcgcttgcagtgcgtgcccagtgggcggctgatgccattgatttcatttggtcaaggcgcaacatgctgattgcgcgctccatggtgatgcctgtggagagcttccgagtttctgtgtaccctctagtgcacgcagcgaaaatggttgcttctggtgttgtaaacacgctgcggcggattgccaagccaggggacactacaattgctgatagtgtggagtcgagtgcggagaaattggtaggagtgtcagacatcgtctcgcacttgctgccattccttagttcacttgacccgccactggtgtttgaggttgggatcaatatgctggcacttgcagatgtccctggaggcaagccagagtgggcttcagctgccattattgcaatcctgacactatgggaccggcaagaattctcgtcgatgagggagaccattgtcagggctgttgtgaccaatcttcatttgctggatcttggaatgcaggtctctctgttcaaaagactgcttcagatggtgagaaacctgagagccgaatcagatcgtatgcatgctttggcatgtatttgtcggactgctctttgtgttgatctttttgcaaaggagagtgttcgaagaggtcagaagcctgttccaggaacagatgtgatatcgctctttgaggatgtgagggtgaaggaagatctaaacagtgtaacaagcaaaaacttgttcagagaagagctagtggcttccctggtcgaaagttgtttccagctatctcttccactaccagagttgaagaattctgggacagagagcagagttataggagcgttagcctatggaactggttatggtgcccttaattggacagaacctgctttggatgtggtggaagtttgcaggccatgtgttctttgggattgtgatggtcgtacctatgcaattgattgctatctaaagttgcttgtgaggctttgtcatatatacgacaccagaggtggtgtgaagacaattaaagctggtgcatctcaagatcagattctgaatgagacccggcttagaaatttgcagctacagcttattagggaccttcgtgaggttcacactccacgtatatcttcacgcttgatatgggcaatttctgaacactttgatcttgaaggtctggatccccttttagctgatgacccagaggacccactgaatattatcatatctaacatgcacaagatattattcaacaccgattcatctgctactacatcaaataggatacaagatgtgcaggctgtcctaatttgcgctcaacgtctgggagcaagaaatgcaagagcagggcaacttctgactaaagaactggaagaatttagggcaagtacttcagctgattctgtcaccaagcatcaatcacgttatgtgttgcaagtaataaaatatgtaacaaaccatcccgataacaggtgggttggtgtaggtgatgctacaggggattatccatttagtcaccacaaacttacagttcaattttcagaggcgtctgctgcccaagatagaaaattggagggattagttcataaggccattcgggagctttggaggccgaatcccagtcaattaactctcctacaaacaaagggaattggtgctttacataaagagcttccaaaagcctgtactttgactggcagcagtgatccgtgctacatcgaagcatatcatttggcagatccaactgatggcagaatcactctacatctaaagattttaaatttgaccgagctggaactcaacagggtggacatccgtgttggcctctctggagcactgtattatatggatggtttctctcgcactgttcgtcaccttcggaatcttgtttcccaggatccggtccaaagtagtgtgactgttggggtttcacattttgagagatgctcactctgggttcaagttttgtattatccgttttatggaactggtggatctgcagactatgaaggagattatgcagaagaggattcacagatgatgaggcagaagcgctcacttcggcctgagcttggggaaccagttgttttgcggtgccaaccctacaagttccctcttgccgagcttctactaccattagaatgctctccagttgagtatttccggctatggcctagcctgccagccatggttgagtgcactggcacatacacatacgaaggcagtggtttcaaggccaccgctgctcagcagtatgacagctctcccttcctcagtggattgaagtcaatttcttctaaacccttccatcaagtctgctcacatttcatccgaacagtagctggattccagttatgttatgcagcaaagacatggtttggtgggtttgtgggcatgatgatatttggggcaagtgaagtcagcaggaacgttgatttgggtgacgagaccaccacaatgatctgcaaattcgtcatgcgtgcatccgatgaatccatcacgagagagatcgaatccgatctccagggctggcttgacgatatcaccgacggtgctgtggaatacatgcccgaggatgaggtgaagagtgcggccgcggagcggctgaagatctccatggagaggatcgccctgctcaaggcggccaagccaaaggtcccacccgcgaagaccgagcaagaggaggaagaggagcggaagcagagcgaggaactagatgggtttggaaaccccaagggcccctcgacgctctccaagctcaccgccgaggaagcggagcaccgcgctctccaggctgccgtgctgcaggagtggcaccagctgtgcaaggagaaagccatgaaagcgcagtga

SEQ ID NO: 21061 - protein, 1154 aa, Sorghum bicolor
  misc_feature: Ceres ANNOT ID no. 8683544
  misc_feature: Down-regulated in root tissues in response to aminocyclopropane carboxylic treatment
MDLLIAQITTDLRSSDALRQSSALLQALQQCAAGRDVSALARTAATEILSAPSSAVCKRLALDLLRALPLPPDLLDPLLLSSLRSDLSFPDPDVAASSIASFPSLPSHLLPSLLSSAHSEIAGALSSPAESLRLAAVTSLSSLLPRDDLALMCSTNPSLMAHATTWWGRLAELALDSADAVSAGAFEALARLFQELEGRRMSRLAGDKLVDGEGALAVRAQWAADAIDFIWSRRNMLIARSMVMPVESFRVSVYPLVHAAKMVASGVVNTLRRIAKPGDTTIADSVESSAEKLVGVSDIVSHLLPFLSSLDPPLVFEVGINMLALADVPGGKPEWASAAIIAILTLWDRQEFSSMRETIVRAVVTNLHLLDLGMQVSLFKRLLQMVRNLRAESDRMHALACICRTALCVDLFAKESVRRGQKPVPGTDVISLFEDVRVKEDLNSVTSKNLFREELVASLVESCFQLSLPLPELKNSGTESRVIGALAYGTGYGALNWTEPALDVVEVCRPCVLWDCDGRTYAIDCYLKLLVRLCHIYDTRGGVKTIKAGASQDQILNETRLRNLQLQLIRDLREVHTPRISSRLIWAISEHFDLEGLDPLLADDPEDPLNIIISNMHKILFNTDSSATTSNRIQDVQAVLICAQRLGARNARAGQLLTKELEEFRASTSADSVTKHQSRYVLQVIKYVTNHPDNRWVGVGDATGDYPFSHHKLTVQFSEASAAQDRKLEGLVHKAIRELWRPNPSQLTLLQTKGIGALHKELPKACTLTGSSDPCYIEAYHLADPTDGRITLHLKILNLTELELNRVDIRVGLSGALYYMDGFSRTVRHLRNLVSQDPVQSSVTVGVSHFERCSLWVQVLYYPFYGTGGSADYEGDYAEEDSQMMRQKRSLRPELGEPVVLRCQPYKFPLAELLLPLECSPVEYFRLWPSLPAMVECTGTYTYEGSGFKATAAQQYDSSPFLSGLKSISSKPFHQVCSHFIRTVAGFQLCYAAKTWFGGFVGMMIFGASEVSRNVDLGDETTTMICKFVMRASDESITREIESDLQGWLDDITDGAVEYMPEDEVKSAAAERLKISMERIALLKAAKPKVPPAKTEQEEEEERKQSEELDGFGNPKGPSTLSKLTAEEAEHRALQAAVLQEWHQLCKEKAMKAQ

SEQ ID NO: 21062 - DNA, 1446 bp, Sorghum bicolor
  misc_feature: Ceres ANNOT ID no. 8683665
  misc_feature: Up-regulated in root tissues in response to methyl jasmonate treatment
  misc_feature: Up-regulated in shoot tissues in response to methyl jasmonate treatment
  misc_feature: Encodes the peptide sequence at SEQ ID NO 21063
atggcggcggagcaggaggggcggtcgctggcggagacgcccacctggtccgtggccaccgtcaccacgctcatggtcgccgcctgcttcctcgtcgagcgctccctctcgcgcttcgccaagtggctgcgcaagaccaagcggaaggccatgctcgccgcgctcgagaagatccgcgaagagctgatgctgctcggagtcatctcgctgctgctcagccagacggcgcgcttcatatcggagatctgcgtgccgtcctcgctcttcaccagccgcttctacatctgctccgagaaagactacgaggacctgctgcgcaacacggacgccaaccagacggcgcttggcaagagcatgttcggtggccagcggctgcatgtctgcagcgagggccatgaaccttttgtttcgtacgagggcctcgagcagctgcaccggtttctgttcatccttggtatcactcatgtgttgtacagttttgtgacagtggttctgtccatgattaagatctatagctggaggaaatgggaaaccttagcaggtccaattgctgctgaggaattgaaagctaggagaacaaaggtgatgagaaggcagtctacctttgtttttaaaaatgcttctcatccatggagcaaaaataaagtacttatttggatgctctgttttctgcgtcaattcaagggctccataacaaggtcagactatttggcactgaggttgggctttgtcacgtatcacaagctaccacattcatatgacttccataaatacatggtacggagcatggaagatgattacaatgggactattggtatcagctggccactttgggcatatgcgattgtctgcatattcatcaatattcatggtatcaatatatatttctggttatcctttgttcctgttgttcacgtcatcgctcagttggctctggaagttgctgaggcaacagcgccttatgttggctcacaactcaaactgcgtgatgatctcttttggtttggaaagccacggaatgcttttgagctggcaacattcttatggtctctgtgggaactcagtgcacacacatgcttcatgaagcactactacatggttgccattcggttgatttctgggctcctagttcagttttggtgcagctacagcacactgccactgaatgtgattatttctcagatgggttccaagttcaagaaatcactggtctcggagaacgtgagggagtcgcttcacagctggtgcaagagggtcaaggacaggagccggcacgggaacctcacgaccagatccgtctgctccctggacaccacctacgagacggaccacgagacgaacacggtgtgcacgctgtcgaggacggcgtcggcgacgtcgctcgacgaccagctcaccgtggccaccgtcgacgacgagccgtcctgcatcgagaaagatgtctga

SEQ ID NO: 21063 - protein, 481 aa, Sorghum bicolor
  misc_feature: Ceres ANNOT ID no. 8683665
  misc_feature: Up-regulated in root tissues in response to methyl jasmonate treatment
  misc_feature: Up-regulated in shoot tissues in response to methyl jasmonate treatment
  misc_feature (5)..(470): Pfam ID: Mlo Pfam Description: Mlo family
MAAEQEGRSLAETPTWSVATVTTLMVAACFLVERSLSRFAKWLRKTKRKAMLAALEKIREELMLLGVISLLLSQTARFISEICVPSSLFTSRFYICSEKDYEDLLRNTDANQTALGKSMFGGQRLHVCSEGHEPFVSYEGLEQLHRFLFILGITHVLYSFVTVVLSMIKIYSWRKWETLAGPIAAEELKARRTKVMRRQSTFVFKNASHPWSKNKVLIWMLCFLRQFKGSITRSDYLALRLGFVTYHKLPHSYDFHKYMVRSMEDDYNGTIGISWPLWAYAIVCIFINIHGINIYFWLSFVPVVHVIAQLALEVAEATAPYVGSQLKLRDDLFWFGKPRNAFELATFLWSLWELSAHTCFMKHYYMVAIRLISGLLVQFWCSYSTLPLNVIISQMGSKFKKSLVSENVRESLHSWCKRVKDRSRHGNLTTRSVCSLDTTYETDHETNTVCTLSRTASATSLDDQLTVATVDDEPSCIEKDV

SEQ ID NO: 21064 - DNA, 6354 bp, Sorghum bicolor
  misc_feature: Ceres ANNOT ID no. 8683699
  misc_feature: Down-regulated in shoot tissues in response to salicylic acid treatment
  misc_feature: Encodes the peptide sequence at SEQ ID NO 21065
atggcaaatttcaactcgtcagaacctcgagactctagagaatcaacttcacctgcaccatcaacatcatcttctatatcaagggaaaaaggtgacctggcagatgttgatgatcctgaaagtgcaatgtccactgtggctcgattgttggaagacctccatgctagcatggtatctccatctgggaaggaagctacaaccagaaggttacttgaactggccagagcaaaacaggaggcaaggattttgataggtagccattctcaggcaatgccattacttatatctacccttagagttgggtcatctgcagcaaaagtaaatgctgcagctctacttagtgcactctgcaaggaagaggacctgcgtgtgagggtcctcttaggaggctgtataccacccttaatctctcttttgaagtctgaatctgctgaagcgaagaaggctgctgctgaagctatttatgaagtgtcttctggtgggctttcagatgatcacataggcaggaaaatatttgtgactgaaggtgttgttccaactctgtgggacttgcttaatcctaggtctcgccaagatagagtagttgagggctttgtgactggggctttaaggaatctctgtggggacaaagatggttactggaaggccacacttgaagctggaggtgttgaaataattactggtcttctttcatccaagaatactgcttcacagtcgaatgctgcctccctattggcacggtttatctctgcttttggtgatagcattcccaaagttatagatgctggggctgttaaggctctccttcaccttctaaatcgagataatatcatttctgttcgtgaaagtgcggctgatgctttggaggccctgtcttccaagtctagtattgcaattaaagctgtggtggatgcaggaggccttcctattctgattggagctgttgtagcaccctcaaaagaatgcatgcagggtgagacatgtcattctctacaaagtcatgctgtccgtgctttatcaaatatttgtgggggaacaacttctctgttgctttaccttggtgagctctgccaagcaccccggtcacctgttccccttgctgacattcttggagcacttgcttattcattgatggtttttgatggctctgatggtaaatcgtttgacccagttgagattgaaaatactttggttgtgctcctaaaatctcatgacagcaagcttgatcgtattcttgaggctttagcaagtctatatgggaatggttgtctctctgacaggcttgatcactctaattctaagaaggttcttgttgggctgattaccatggctcctgctgatgttcaagaacatcttgttcgtgccttaactagcttgtgttgtgatggtgttggaatatgggaggctcttggaaagagagaaggggttcagttgctaatatcattacttgggctttccagtgagcagcagcaggaatatgcagtttccttattggctatcttgagtgatgaagtagatgacagcaagtgggcaataacagctgctggaggtatccctccacttgtccagctactagaaacaggatctcaaaaagcaaaggaggatgcagcttacatcatgtggaacatgtgctctgacagtgatgatatcagggcatgtattgagagtgctggagctgttctggcactaatttggcttctaaagagtggtagccctcgtggacaggaggcatcagttaaagcactcaagaagctgatacgatcagcagattctgctacgatcaatcagttactagcattactgctcagtgactcactgagctcaaaggctcatgtcattacagttctcgggcatgtccttgtgctggcgcctcagagagctctaatccagagtggagcctcagctaataaaggtcttaggtcactggttcttgttcttgaatcatcaaatgaagaaacacaagagattgctgcaactgtgttggctgatattttcactatgcgtcaggatatttgtgatgtcttggcaattgatgaaattgtccagccatgcatgaagcttttgacaagtggaaaccaagtgattgccacacaatctgccagagctttaggagcgctttcatgttcagctagttccatgtcaaaaaacaaaatgtcttgcttaactgaaggtgatgtgcgacctcttatcgaaatggcaaagacatcatctattgatgttgctgaaacagcatttgctgcattagcaaatctcctatcagatgcacagattgctaaagaagcgttagatgacaatattgtcttggctttgactagagtgctcaaggaagggagtttagaaggcaagattagtgcgtcgcggtcacttcgtcagttggtcaaccagtttcccctcagtgaagttctcccagattactcgcagtgctgttttataattcatgcattgttggtatgtctatctggcatcaatttggacaatgttacaaatttggaaccccttgatgttcttacattgatggctacaacaaaggagggttcacattatagcccccctctatgcactggttttcttgaagttccagaaagcttagaacctttaattcgttgtgttagtattgggcttccacctgttcaagataagtccgttcaaatacttgcaagtctttgtcagggccgaccttctctacttggtgaatatttaaacagaagtcaaggatgcatcacttcacttgctagtagagttatagagtcaaatgacatggaaataagaatcagcagtgcagtcatcctcatatctgcaatgagggacagcagagaacagtcgatcgatgttcttgaagcatcaaaacttctgaagaatctgatatctgcactcattgatatgctgaagcaacgttcctctttaacatccctagacattgaaatttggaaacctcacatggaaaaaagttcgcttaattatgagcaggatgttttgagtgtgcctgaacttggaaaggtttctgaagaaactgttgcactatggttgctctcactgatttgttctcatcatggaaggagtaaatatactgttatggagctcaatggcgttgatgcagtatctgatagacttgctagctatactgctaaccgacaggaacagtatgaagactcagaaaatatatggacttgcgcccttctgttggctactctgtttcaggattcagtggttgttcagtcttctgaaataacacgaacaataccttctttagcatccttgctaaaatctgatgatatcatcgataaatactttgctgctcaagcactggctagccttgtttccactgggagcagaggtatacagcttgctattgcaaattctggtgcagttttgggtgctgtagcattgatcggacaggtagaatctgatatgccaaaccttgttacaatggctaaagaattcaagttggcagacaatccaagtcaaataatattgaaaaacctttttgagcttgaagatgtctgcactggtgcttccgctcgaaggtccatacccttgctagtggatctacttaaaccaatgccagacaggccaggtgcacctctgattgctttgcaccttctgactcaactagcggaaggtagtgagggaaataaagttgctatggcagaggctggagctttagatgctttgactaagtatctatctttaagccctcaagactcaactgaaactactataaccaatttattagggattttatacagtaatcctgatcttctttaccatgaatcatcacgcagcacttcaaatcaactggtagctgtcttacgtttgggctcgagaagttctaggcttagtgcagtaaggacgttgcagaaactctttgatgcagagaatataagggacacagaagtggcccggcaagctattcaaccactacttgacatgcttgaatcaggaactgaaatagaacagcaggcagcacttggtgcacttatcaagctttctgctgggactatctctaaggattctgctatgtttgatgtagaaggcaacacacttgaaaatctttacaaaattttatccttcagttcgttattggagcttaagaaagatgctgctcaactctgctatattttatttgagaactccactgtacgtgcatcaccaattgcaacagaatgtcttcaacccctgatatcactgatgacatcaggatctagtttggctatcgaaccagcagtttgtgctctaaacagattactggatgaggactacaatgcagaggttgctgcaactagtgaagttattgatcttcttgtcagttttgttcctggtacaaactatcagttgtctgaagcatgtattggtgctctcataaagttgggcaaggaccgtccaaactgcaagcttgacatggttaaagctggtatcattgagcatgcgcttgatatgattcttgatgttcctgtatctgttagttcatccattgctgaattgcttcgcattttgacaaacaacagtggcattgctaaaagttctgctgctgcaaaaatggtggagccacttttcttgcttttacgtcgccctgatgttactatgtgggaccagcacagtgccttgcaagcacttgtaaatattctggagaaacctcagagtctagcagcattgaagttgactcccagtcaaataattgagcctttaatatcatttcttgagtctccctctcaagcaattcagcaacttggcactgaggtgctctcacatcttctagaacaggaacattttcaacaagatatcaccaccaaaaatgcagttgttcctctggtgcagcttgctggtattggaatcctgagcttacaacaaactgcagttaaagcacttgaaaacatctcacagagttggcccaaggcagtagctgatgcaggtggaatttttgaactttcaaaggtaattgtccaggatgatcctcagccaagtcaagcattatgggaatctgcagcacttgtgttatgcaatgttttgcgttataattctgacaattatgtcaaagtctcaatggctgtacttgtgagattgctgaactccaccatggagagtactgtcacgatagctctcagtgctctacttgttcaagagaaaagtagctcacgctgtggtgtggccatggctgaggctggggcagtacgtgcactcttggagctcctgaagagccatcgatgtgaggaatctgcagcaagattgcttgaagctctaataaacaattcaagggttcgtgaaacaaaagttgccaagtatgctattgctcctctctcacagtacctgttagatcctcagtccaagaaccagtcagcaaagtttctggtgactcttgcattaggtgacattttccaacatgaagcacttgcaagggcaagtgactccgtgtctgcctgccgtgctcttgtaagcctacttgaggaccagcctacggatgacatgacaacagttgctatttgtgcactacaaagcttagtgatgcacagcaggacaaataggcgtgctgttgctgaagctgggggcattttggttgtgcaagaattgcttctttcaccaaatgtggatatttcaggacaggctactcttctaatcaagtacctattttcaaatcatacactgcaagaatacgtgtcgaatgagcttatccgatctctcactggtgagtcggcaatctttatgcaactcaaaaaggtgcggttttctgaggcggcaaccctgtgcataccacacctgctttgtgctttgaaggatggaaatgaggctgcccaggagagtgtgcttgacacccttcgcttgcttaaagaatcttgtccgcacatgaatgaagacatcgctaaagcccagtccctgctttcagctgaagccatacctgtactacaaatgcttatgaagacatgtcctcccagttttcacgagagagccgatagtttgctccattgcttgcctggttgcttgacagtgaccatcattcgtgggaataatttgaaacagacaatggggggtacaaatgcattttgttgcctgcaaataggaaatggtcctccaaggcaaactaaggtggtaaaccacagcatctgcccagcttggaacgagggtttcacctggttatttgatgtcgctcctaaagggcagaagctctacatcatatgcaaaagcaaaaatacatttggaaagtcaacccttggaagagtgaccatccagattgacaaggttgtcaccgagggtgtatacagcgggttcttcagcctcagccacgacggtggcaaggatggctcaagaacccttgagatagaaattgtatggtcgaataggccatccaacgacagtatgtag

SEQ ID NO: 21065 - protein, 2117 aa, Sorghum bicolor
  misc_feature: Ceres ANNOT ID no. 8683699
  misc_feature: Down-regulated in shoot tissues in response to salicylic acid treatment
  misc_feature (505)..(545): Pfam ID: Arm Pfam Description: Armadillo/beta-catenin-like repeat
  misc_feature (1992)..(2072): Pfam ID: C2 Pfam Description: C2 domain
MANFNSSEPRDSRESTSPAPSTSSSISREKGDLADVDDPESAMSTVARLLEDLHASMVSPSGKEATTRRLLELARAKQEARILIGSHSQAMPLLISTLRVGSSAAKVNAAALLSALCKEEDLRVRVLLGGCIPPLISLLKSESAEAKKAAAEAIYEVSSGGLSDDHIGRKIFVTEGVVPTLWDLLNPRSRQDRVVEGFVTGALRNLCGDKDGYWKATLEAGGVEIITGLLSSKNTASQSNAASLLARFISAFGDSIPKVIDAGAVKALLHLLNRDNIISVRESAADALEALSSKSSIAIKAVVDAGGLPILIGAVVAPSKECMQGETCHSLQSHAVRALSNICGGTTSLLLYLGELCQAPRSPVPLADILGALAYSLMVFDGSDGKSFDPVEIENTLVVLLKSHDSKLDRILEALASLYGNGCLSDRLDHSNSKKVLVGLITMAPADVQEHLVRALTSLCCDGVGIWEALGKREGVQLLISLLGLSSEQQQEYAVSLLAILSDEVDDSKWAITAAGGIPPLVQLLETGSQKAKEDAAYIMWNMCSDSDDIRACIESAGAVLALIWLLKSGSPRGQEASVKALKKLIRSADSATINQLLALLLSDSLSSKAHVITVLGHVLVLAPQRALIQSGASANKGLRSLVLVLESSNEETQEIAATVLADIFTMRQDICDVLAIDEIVQPCMKLLTSGNQVIATQSARALGALSCSASSMSKNKMSCLTEGDVRPLIEMAKTSSIDVAETAFAALANLLSDAQIAKEALDDNIVLALTRVLKEGSLEGKISASRSLRQLVNQFPLSEVLPDYSQCCFIIHALLVCLSGINLDNVTNLEPLDVLTLMATTKEGSHYSPPLCTGFLEVPESLEPLIRCVSIGLPPVQDKSVQILASLCQGRPSLLGEYLNRSQGCITSLASRVIESNDMEIRISSAVILISAMRDSREQSIDVLEASKLLKNLISALIDMLKQRSSLTSLDIEIWKPHMEKSSLNYEQDVLSVPELGKVSEETVALWLLSLICSHHGRSKYTVMELNGVDAVSDRLASYTANRQEQYEDSENIWTCALLLATLFQDSVVVQSSEITRTIPSLASLLKSDDIIDKYFAAQALASLVSTGSRGIQLAIANSGAVLGAVALIGQVESDMPNLVTMAKEFKLADNPSQIILKNLFELEDVCTGASARRSIPLLVDLLKPMPDRPGAPLIALHLLTQLAEGSEGNKVAMAEAGALDALTKYLSLSPQDSTETTITNLLGILYSNPDLLYHESSRSTSNQLVAVLRLGSRSSRLSAVRTLQKLFDAENIRDTEVARQAIQPLLDMLESGTEIEQQAALGALIKLSAGTISKDSAMFDVEGNTLENLYKILSFSSLLELKKDAAQLCYILFENSTVRASPIATECLQPLISLMTSGSSLAIEPAVCALNRLLDEDYNAEVAATSEVIDLLVSFVPGTNYQLSEACIGALIKLGKDRPNCKLDMVKAGIIEHALDMILDVPVSVSSSIAELLRILTNNSGIAKSSAAAKMVEPLFLLLRRPDVTMWDQHSALQALVNILEKPQSLAALKLTPSQIIEPLISFLESPSQAIQQLGTEVLSHLLEQEHFQQDITTKNAVVPLVQLAGIGILSLQQTAVKALENISQSWPKAVADAGGIFELSKVIVQDDPQPSQALWESAALVLCNVLRYNSDNYVKVSMAVLVRLLNSTMESTVTIALSALLVQEKSSSRCGVAMAEAGAVRALLELLKSHRCEESAARLLEALINNSRVRETKVAKYAIAPLSQYLLDPQSKNQSAKFLVTLALGDIFQHEALARASDSVSACRALVSLLEDQPTDDMTTVAICALQSLVMHSRTNRRAVAEAGGILVVQELLLSPNVDISGQATLLIKYLFSNHTLQEYVSNELIRSLTGESAIFMQLKKVRFSEAATLCIPHLLCALKDGNEAAQESVLDTLRLLKESCPHMNEDIAKAQSLLSAEAIPVLQMLMKTCPPSFHERADSLLHCLPGCLTVTIIRGNNLKQTMGGTNAFCCLQIGNGPPRQTKVVNHSICPAWNEGFTWLFDVAPKGQKLYIICKSKNTFGKSTLGRVTIQIDKVVTEGVYSGFFSLSHDGGKDGSRTLEIEIVWSNRPSNDSM

SEQ ID NO: 21066 - DNA, 3060 bp, Sorghum bicolor
  misc_feature: Ceres ANNOT ID no. 8683867
  misc_feature: Down-regulated in shoot tissues in response to methyl jasmonate treatment
  misc_feature: Down-regulated in root tissues in response to salicylic acid treatment
  misc_feature: Up-regulated in root tissues in response to methyl jasmonate treatment
  misc_feature: Down-regulated in shoot tissues in response to salicylic acid treatment
  misc_feature: Encodes the peptide sequence at SEQ ID NO 21067
atggagggagagagaggtgagctctggtctgtttgcaacggttggaagcgaggaagaagagcaggacctttgctccctgtggatgccatcggggcgctcgccggggcaacatccgccacgacagcgacgccgccgcgctccctcgaagagagctcgtggctgcccccgcgcaaagctccggcctttcttggccccgtcgacacctccttcccgccgccgccgccaccgccgcgtggtggtggcgatcggcggcgcgccatggcgtcgccgcgcgggcgtcgtcgtccttcggttcccggatcgggctcgattcccagggacctgtcccagttgttgtggatcggtccggtgcccggtgacatcgcggagattgaggcctactgccgcatatttcgtgctgccgagcagctgcacaccgcggtcatgtcagcactatgtgatccagagacaggagagtgtcctgtgcgctatgatgtggaatctgaggatctgccagtcctggaagacaaggtcgctgccgtccttggctgcatgctggcattgctgaaccggggaaggaatgaggtgctctcagggaggtcgggtgttgcaagtgccttccagggatctgaggacacctctgataggatcccaccgctcgccttgttccgaggagacatgaagcgttgctgtgagagtatgcaggtggcgcttgccagctaccttgcaccgagtgagcccaggggattggatgtatggaggaagatgcagaggttgaagaacgcttgttacgatgcaggtttcccaaggcctgatggttatccatgtccgacattatttgcaaattggtttccggtgtacctttcaattgtgtcagatgattcaggaacagatgagctagaggtagcattttggaggggagggcaagtcagtgaggagggactggcatggctactacaaaagggattcaaaactattgttgatctccgggaagaagatgttaaagatgatttgtacctttcagcagttcaggaagctgtctcatctgggaagatagaggtggtgaatatgccagttgagattggaactgcaccatcagctgaacaggttcagcaatttgcagctcttgtgtcagatggcgcaaggaagcccatttatctccatagcaaagaaggtgtttctaggacgtctgcaatggtctcaagatggaaacagtatgttactcgttcagagagattggctgtccaaaatcactctctaaatgggaatggtaaggtcctgacaagttacaagaccatgcagcacacggacagctcaagttcctctacaaatggaactgaaaatggtacgataacagaatctgataggaccatgaacaatggagaatcatgtgagatagacatagagacagctcgtcataatctggaggtcactaatgcccttcccaatgatcaaagcactcaacaaggcgaaatgcctggcactggggcagaactcttgtcaaactttaaactggagagtaacccccttaaagcacaatttcctacttgcgatgttttctctagaaaagagatgaccaagttttttagaagcaaaaaggtttatccaaaatctgttctgaattctaggagacgatcaagtagcttgctggtctcaaggagaaaacaaaatctcatcgtggagcgtaatggaaccattgactatgaagcagcagagtttgcagttctggaaagttcaaatgggaaatcatttgacaatgattatattctatcagttgcttcaggtatcactaatggaaaaccttccaacaatggagcctcctcattaattgaggaaaaggaaagggaagtttcagtcgctactgttgatactagagcatctgccagcagttctaatggaaaggttcaggttggatctcaaaaatctgctgcaaagaatggtaccccttatcttgagagaaacaaatcagataatgttgatggaaatatgtgtgcatcttcaactggtgtcgttagactccagtcgagaagaaaagcagagatgtttctagtacgtactgatggattttcttgtactagagaaaaagtaacagaatcatctttggcttttacgcatccgagtacccagcaacagatgcttatgtggaaatcacctccaaagactgtcttacttttgaagaaattaggcgatgagctcatggaagaagctaaagaggttgcttcatttttgcatcatcaagaaaagatgaatgttcttgtggaacctgatgttcatgatacatttgctagaattccaggttatggttttgtgcaaaccttctattctcaagataccagtgaccttcatgagcgagttgattttgttacatgcttgggtggtgatggactcattttgcatgcatcaaacttatttagaacttctgtaccacctgttgtctccttcaatctcggatctcttgggttcttaacttcacataatttcgaaggtttcagacaagatttgagagatttaatccatgggaacaacacacttggagtttatataacccttagaatgcgtctaagatgtgagatctttcgcaaaggaaaagcaatgcctggtaaagtgtttgatgtgctgaatgaagttgttgttgatcgaggttccaatccatacctatcaaaaattgagtgttatgagcataaccaccttatcactaaggtgcaagctgatggggtgatagttgctacaccaactggcagcacagcatattctactgcagcagggggatcaatggttcatccaaatgtcccatgcatgctgtttactccaatctgccctcactcactgtcatttagacctgtcatccttccggattctgcccggcttgaattaaagataccagatgaggcaagaagcaatgcatgggtttcatttgatggcaaaaggaggcagcaactgtcaagaggagactctgttcgaatatccatgagtcagcacccactcccaactgttaataaatctgaccaaacgggtgattggttccgcagcctgatcaggtgcctcaactggaacgagagattggaccagaaggcactatag

SEQ ID NO: 21067 - protein, 1019 aa, Sorghum bicolor
  misc_feature: Ceres ANNOT ID no. 8683867
  misc_feature: Down-regulated in shoot tissues in response to methyl jasmonate treatment
  misc_feature: Down-regulated in root tissues in response to salicylic acid treatment
  misc_feature: Up-regulated in root tissues in response to methyl jasmonate treatment
  misc_feature: Down-regulated in shoot tissues in response to salicylic acid treatment
  misc_feature (469)..(1019): SWISSPROT Homolog: EC 2.7.1.23 NAD(+) kinase
  misc_feature (714)..(993): Pfam ID: NAD_kinase Pfam Description: ATP-NAD kinase
MEGERGELWSVCNGWKRGRRAGPLLPVDAIGALAGATSATTATPPRSLEESSWLPPRKAPAFLGPVDTSFPPPPPPPRGGGDRRRAMASPRGRRRPSVPGSGSIPRDLSQLLWIGPVPGDIAEIEAYCRIFRAAEQLHTAVMSALCDPETGECPVRYDVESEDLPVLEDKVAAVLGCMLALLNRGRNEVLSGRSGVASAFQGSEDTSDRIPPLALFRGDMKRCCESMQVALASYLAPSEPRGLDVWRKMQRLKNACYDAGFPRPDGYPCPTLFANWFPVYLSIVSDDSGTDELEVAFWRGGQVSEEGLAWLLQKGFKTIVDLREEDVKDDLYLSAVQEAVSSGKIEVVNMPVEIGTAPSAEQVQQFAALVSDGARKPIYLHSKEGVSRTSAMVSRWKQYVTRSERLAVQNHSLNGNGKVLTSYKTMQHTDSSSSSTNGTENGTITESDRTMNNGESCEIDIETARHNLEVTNALPNDQSTQQGEMPGTGAELLSNFKLESNPLKAQFPTCDVFSRKEMTKFFRSKKVYPKSVLNSRRRSSSLLVSRRKQNLIVERNGTIDYEAAEFAVLESSNGKSFDNDYILSVASGITNGKPSNNGASSLIEEKEREVSVATVDTRASASSSNGKVQVGSQKSAAKNGTPYLERNKSDNVDGNMCASSTGVVRLQSRRKAEMFLVRTDGFSCTREKVTESSLAFTHPSTQQQMLMWKSPPKTVLLLKKLGDELMEEAKEVASFLHHQEKMNVLVEPDVHDTFARIPGYGFVQTFYSQDTSDLHERVDFVTCLGGDGLILHASNLFRTSVPPVVSFNLGSLGFLTSHNFEGFRQDLRDLIHGNNTLGVYITLRMRLRCEIFRKGKAMPGKVFDVLNEVVVDRGSNPYLSKIECYEHNHLITKVQADGVIVATPTGSTAYSTAAGGSMVHPNVPCMLFTPICPHSLSFRPVILPDSARLELKIPDEARSNAWVSFDGKRRQQLSRGDSVRISMSQHPLPTVNKSDQTGDWFRSLIRCLNWNERLDQKAL

SEQ ID NO: 21068 - DNA, 1548 bp, Sorghum bicolor
  misc_feature: Ceres ANNOT ID no. 8684065
  misc_feature: Down-regulated in root tissues in response to salicylic acid treatment
  misc_feature: Down-regulated in shoot tissues in response to salicylic acid treatment
  misc_feature: Up-regulated in shoot tissues in response to salicylic acid treatment
  misc_feature: Encodes the peptide sequence at SEQ ID NO 21069
atggcgatccgctcctccaaggcctgctggatctcgctgctgctcgcgctcgcgctctccgccgtcgcgcgggcggaggagcccgcggcggagggtgcggccgaggccgtgctcacactcgacgtcgacagcttcgacgaggccgtcgccaagcaccccttcatggtcgtcgagttctacgccccctggtgtggacactgcaagaagcttgctccagagtatgagactgcggccaaggaacttagcaagcacgacccaccgattgttctcgctaaggttgatgctaatgaggagaagaacaggccgcttgctaccaagtacgagatccaagggttcccaaccctcaagatcttcaggaaccaggggaagaacattcaggaatacaagggccccagggaggctgatggcattgtcgattacttgaagaagcaggttggccctgcgtccaaggagctcaagtcacaggaagatgttgcgacccattatgatgacaagaatatctacattgttggtgtcttcactgaattcagcggcactgaatttacaaacttcatggaggtcgctgagaagctgaggtctgactatgactttggccacactttgcatgccaaccacctcccacgcggtgatgcagcggtggagaggccattggtcagggtgctgaagccatttgatgagcttgttgttgacaccaaggattttgatgttgctgctctgttgaagtttattgacgctaccaccgtccccagagttgtcacttttgacaagaaccctgacaaccacccgtatctcatgaaattcttccaaagctcagcccccaaggctatgctgtttttgaacttctccactggaccttttgattctttcaagtctgtttactatgctgccgcagaggaattccagaacaaggaaatcaagttccttattggtgaccttgaatccagccagggtgccttacagtactttggtctgaaagaggaccaggcaccccttatcctcatccaggatggtgattccaagaagttcttgaaggatcaaattgaggctgaccagattgtctcttggttgaaggagtactttgatggcaaattgacgccgttcaagaagtctgagcctattcctgaggtcaacaatgagcctgttaaggtggttgtggctgacaacatccatgatttcgtcttcaagtctggcaaaaatgttcttattgaattctatgccccctggtgtggacactgcaagaagctggcgcccatcttggaagaggcagccaccactctccagagtgatgaggaagttgtgattgctaagatggacgcgacggccaatgatgtgcccagtgagttcgaggtccaaggctacccaaccatgtacttcgtgacccccagcgggaaggtcaccgcctacgacagcggcaggacagcagacgacatcgtcgacttcatcaagaagagcaaggagaccgccggcgccacccaggcgacgacgacgacatctgagaaggcagctgacgcagccgagaaagctgagcccgtcaaggacgagctgtaa

SEQ ID NO: 21069 - protein, 515 aa, Sorghum bicolor
  misc_feature: Ceres ANNOT ID no. 8684065
  misc_feature: Down-regulated in root tissues in response to salicylic acid treatment
  misc_feature: Down-regulated in shoot tissues in response to salicylic acid treatment
  misc_feature: Up-regulated in shoot tissues in response to salicylic acid treatment
  misc_feature (1)..(515): SWISSPROT Homolog: EC 5.3.4.1 Protein disulfide-isomerase
  misc_feature (36)..(144): Pfam ID: Thioredoxin Pfam Description: Thioredoxin
  misc_feature (380)..(484): Pfam ID: Thioredoxin Pfam Description: Thioredoxin
MAIRSSKACWISLLLALALSAVARAEEPAAEGAAEAVLTLDVDSFDEAVAKHPFMVVEFYAPWCGHCKKLAPEYETAAKELSKHDPPIVLAKVDANEEKNRPLATKYEIQGFPTLKIFRNQGKNIQEYKGPREADGIVDYLKKQVGPASKELKSQEDVATHYDDKNIYIVGVFTEFSGTEFTNFMEVAEKLRSDYDFGHTLHANHLPRGDAAVERPLVRVLKPFDELVVDTKDFDVAALLKFIDATTVPRVVTFDKNPDNHPYLMKFFQSSAPKAMLFLNFSTGPFDSFKSVYYAAAEEFQNKEIKFLIGDLESSQGALQYFGLKEDQAPLILIQDGDSKKFLKDQIEADQIVSWLKEYFDGKLTPFKKSEPIPEVNNEPVKVVVADNIHDFVFKSGKNVLIEFYAPWCGHCKKLAPILEEAATTLQSDEEVVIAKMDATANDVPSEFEVQGYPTMYFVTPSGKVTAYDSGRTADDIVDFIKKSKETAGATQATTTTSEKAADAAEKAEPVKDEL

SEQ ID NO: 21070 - DNA, 3354 bp, Sorghum bicolor
  misc_feature: Ceres ANNOT ID no. 8684317
  misc_feature: Up-regulated in root tissues in response to aminocyclopropane carboxylic treatment
  misc_feature: Up-regulated in shoot tissues in response to aminocyclopropane carboxylic treatment
  misc_feature: Encodes the peptide sequence at SEQ ID NO 21071
atgcccagctacaatccgagatcacagaatatgattcggctgcttctccgtatcaatgctcgattgatccaagaacgtagggatatcccccaaatttcgttgcagcttcctctatactgcagccccctaccacaacatcctgataaatgcagtccgctgctcttcttggctgctggagagtccccaatcctccatcggaagtggctgccggagaggtccaatcctccgtcagaagtggctactggagacgccccaaacatccacgccaggaagctgcctcggatcccatcaggccagcagagacaggctacggagggtagattgaaatcattcaccctgcacaccacacaggaggatttcaacattgatataagtgacgtcactggtgtatctcagacactaccagctcaaccagttcatcagcagccaccacattgtccaggaccgtcgtcacgccctcgttcagaggaggacgatgatgatgacgatttcatgcaacccccaactaggcacccagtaatgaacaataatcaacgtcgtactacaaaagttgttgtcaatgcacgcagagatgggaaagtgcagaagaaaaatgcctctcgcatagatccacctacaaagcctaaacagcaaaagcttaccaaatatcttcatgcaccaactgttcgatgtgcaccttcaatttttaactcatttattgatctcctcaccatgagtcagcgtactagaatcaataatatgaactttggtggcctcctccagatccgagcagacaagctagttagcagagaaatgttgaggtatctgtatgacaggctagatcctgtaactatgatgttggttcttggtaaagatagggttatacatatcaacccttttgtcgttaagcaaacgtttggcattccggacagtggtgaagaattatctttacacacaaaccaggaagcatgcaaggccttgtctgatttcaaggattttattggtttacaagaagctgaggatgtgcacacaaagtatctacaagagatctgggaggccgacattgagctagactccaggatgcttgacgacaacatgtgcattaaaattttcttcatgatcgcttctaacaagctgttgtttccttcctcggacaacaacatcagggcgaaagatgtttatttggctaggaatttgtctcgactacccactatgaactggtgcaaggctgttaccgatgaaatccaagaagctgcacgcacgtggcgtcttgatagaacaactaaagtttcgccttcaattacaggatgcgcgttttttctgttgatagtgtatttggataatttacgctgcaaacaccagatcaatcacaaggacattccccgtgccaagtacttcaatcaagatttgattaaaaaaataattgctgctgacaagacaaaggacgaccaaggaaaggtcacatttgggcgattaccgcttagggacatcagtgatactgtttaccatatgcctcatcattctattctagaaaagccagcaaacattcaacctgtgtctgctatacagttccctagcattctttcagaactagttggagtagtcaatgtgacagttgccaagccaaagaggaagccgttagtgcaagctttcacagaatttgacatcaaatcaaaaaaggcaacaacttacttaaacaggggacaactaatgctacaaacctcacatgaccagctcattgcaaaggtgcggtcaattttggagaaccaaagttgtgagaataacagcatagatcaccaagctaaaccaactgctcctactgcaggatatggcactaaccaacatataaaccatgagagacatgtgccactgcaacagaacagtcccacggaggctgcggcaccacagcccatggatgccgcaacgaatgccgggtcagaacaggaattggatcatgaacactcaccggttcacacggatgtgacaattggcgatgttgttcctccaattttgggtcaggcgatggaccaagaaggcactggacaagcatcacacattggcagaacctcatccctggattctctagttgacctcatcactgcatctgttatacggactgcccaccgacaaactacaacaactgacacgatgacaccagagcctgttgtgcttacacacacccaacatcagcttcctaatgaggttatacgacctgacagcaccaccattgctgttgagcccctcctacttgctgcccacccacaaactataacaaccgacacgatgacaccagagcttgttgtgcttacacagacccaacataagcttcctaatgaggttatacaacctgatagcacgattggtgttgagcccctcctacctgctgcccacccacaaactacaacaaccgacacgatgacatcagagcctgctatgcttacacacacccaacatccgcttcctaatgaggttctacgacctgatatcaccattgatgatgagcccctcctacctgtttatccaaaaccacaacgtcttacaagacgcccatccaagtacgtgtcgccattcaaaggtgatccaatgcggacacgagtaccaatgtcaaaggcactagctgtgaggaagaagtttcgcccgagtctcaagagtttaaatgaggttttcattagtacaggcttcatagatttcactggcaatgaaatattagattccttccctaacgatcaagagctttcgaccaaatttatgtcctactttgttcaatgcttgagccatgatgaatcagtccacatgccagatggtggtggctacagggtgttcctaccccacaggattggggaatacgtcaatatggaggatcaggaggaatacgaagagtgggaatttcataatgctcttgaaattttagagagtggcattgcttctattgacacaactaatgttaagctattctttttgccgattatggaggaggaccactatactgtttactgcatcaaccttatacatgaccgaatagatattctcgactctagtcctgatgaccataggctttaccatgaagttgtgggtaacagaattattccaaggctcaatcttctgttccaggaagccacagatggtaagcttaagtcgtttactcgattcaggcgacccatcctacctgtcccagtgcagcgcaatgccaccgacagtggattctatgccatcaagttcatggagttatggaatggtgaatctttccatcttccaatcctcacggaaaatgcagcaatgtatagagatcagcttctctactacgccatctatcacgaaatcaacactgttgagaagcttcctgctggtctagaagcactcaagccacgacgttga

SEQ ID NO: 21071 - protein, 1117 aa, Sorghum bicolor
  misc_feature: Ceres ANNOT ID no. 8684317
  misc_feature: Up-regulated in root tissues in response to aminocyclopropane carboxylic treatment
  misc_feature: Up-regulated in shoot tissues in response to aminocyclopropane carboxylic treatment
MPSYNPRSQNMIRLLLRINARLIQERRDIPQISLQLPLYCSPLPQHPDKCSPLLFLAAGESPILHRKWLPERSNPPSEVATGDAPNIHARKLPRIPSGQQRQATEGRLKSFTLHTTQEDFNIDISDVTGVSQTLPAQPVHQQPPHCPGPSSRPRSEEDDDDDDFMQPPTRHPVMNNNQRRTTKVVVNARRDGKVQKKNASRIDPPTKPKQQKLTKYLHAPTVRCAPSIFNSFIDLLTMSQRTRINNMNFGGLLQIRADKLVSREMLRYLYDRLDPVTMMLVLGKDRVIHINPFVVKQTFGIPDSGEELSLHTNQEACKALSDFKDFIGLQEAEDVHTKYLQEIWEADIELDSRMLDDNMCIKIFFMIASNKLLFPSSDNNIRAKDVYLARNLSRLPTMNWCKAVTDEIQEAARTWRLDRTTKVSPSITGCAFFLLIVYLDNLRCKHQINHKDIPRAKYFNQDLIKKIIAADKTKDDQGKVTFGRLPLRDISDTVYHMPHHSILEKPANIQPVSAIQFPSILSELVGVVNVTVAKPKRKPLVQAFTEFDIKSKKATTYLNRGQLMLQTSHDQLIAKVRSILENQSCENNSIDHQAKPTAPTAGYGTNQHINHERHVPLQQNSPTEAAAPQPMDAATNAGSEQELDHEHSPVHTDVTIGDVVPPILGQAMDQEGTGQASHIGRTSSLDSLVDLITASVIRTAHRQTTTTDTMTPEPVVLTHTQHQLPNEVIRPDSTTIAVEPLLLAAHPQTITTDTMTPELVVLTQTQHKLPNEVIQPDSTIGVEPLLPAAHPQTTTTDTMTSEPAMLTHTQHPLPNEVLRPDITIDDEPLLPVYPKPQRLTRRPSKYVSPFKGDPMRTRVPMSKALAVRKKFRPSLKSLNEVFISTGFIDFTGNEILDSFPNDQELSTKFMSYFVQCLSHDESVHMPDGGGYRVFLPHRIGEYVNMEDQEEYEEWEFHNALEILESGIASIDTTNVKLFFLPIMEEDHYTVYCINLIHDRIDILDSSPDDHRLYHEVVGNRIIPRLNLLFQEATDGKLKSFTRFRRPILPVPVQRNATDSGFYAIKFMELWNGESFHLPILTENAAMYRDQLLYYAIYHEINTVEKLPAGLEALKPRR

SEQ ID NO: 21072 - DNA, 1884 bp, Sorghum bicolor
  misc_feature: Ceres ANNOT ID no. 8684322
  misc_feature: Down-regulated in root tissues in response to methyl jasmonate treatment
  misc_feature: Down-regulated in shoot tissues in response to methyl jasmonate treatment
  misc_feature: Down-regulated in shoot tissues in response to salicylic acid treatment
  misc_feature: Encodes the peptide sequence at SEQ ID NO 21073
atggggcctgggcagccggtgggcggcgcggcggcgtcgctgctccggacaaactcttccctgctcagtggtggtggccagccggggatgatgggcggcggcggcggtggtggcggtggcatgctttcttcgcagtcgcccttctcctcccttgtctcccagcgcacgcagtttggcagcaatggtctgcttggaggcgcctcgaatgtctcctcgctgctgaaccggccgccgttcgggagtggtggccctatgcaaggtccagggtcgatgcagggtggtgggatgcagatgagtacgctccagcagagagctgggctggatggtggtggcgatttcattagtgcgggagggtcggatgctctgtcgttcccatcttcctcacaggtcagtttgggcaatcagatgggatcagataatctgcaggcgacttcgcagcagcagcagcagcagatggatgctgtgcaggatatgcagcaccagcagctaccaatgtcttacaaccagcaacagttgccacctcaacattcgcagcagctccagcagccacaggctacagtgaagttggagaatggaggaagcatggttagcatcaagtcagagcagcagatggggcaacctgaccagaatggtcctggggcccagatgatgcgaagtgctagtgtcaaacttgagccacaacagctgcaagcccagatgatgaggagtttaagttcagtcaagatggagcaacagacgtcggatccatcagcattcttgcagcagcagcaacagcagcaacaacaacatcatttgttgcagctgacaaagcagattcgaaattgtccagaccttgtatcaatgggtggaccaaacacaattgcaaaccctcaagctgctgcggctgctcaactgaccctcttacagcagcaacggatcctgcatatgcaacaacagcatcagcagcagcaacaacaacagattcttaagaacttgcctttgcagagaaaccagttgcagcaacagcaacagcagcatcaacaacagcagcaacagcagcagttacttcgtcaacaaagtctgaacatgagaactccaggaaagtcgcctccttatgagccaggaacctgtgcaaagagattgactcactacatgtatcatcaacaaaacagaccacaagataacaacattgagtactggagaaactttgtcaatgagtattttgctccaaatgctaaaaagaggtggtgtgtctcgctttatggaagtggtcgtcaaactactggagttttccctcaggatgtatggcactgtgagatttgtaatcggaaacctggccgtggttttgaaacaacggttgaggtactaccgcgattatgccaaattaaatacgccagtggtacactggaagaacttttgtacatcgacatgccacgtgagtcccagaatacctcaggccagattattttggactacacgaaagcaatccaagagagtgtctttgaacaattgcgtgtcgtacgggaggggcatctaaggatagtttttaatccagaccttaagattgcatcttgggagttttgtgctaggcgtcatgaagaacttattccacggagatctataataccacaggttagtaatcttggcgcggttgtacaaaagtaccaggctgcctcccagaactcaacgagtttgtctgctcaggacatgcagaataattgcaactcgtttgttgcatgtgcccgtcaattggccaaagcactggaggttcctttagtaaatgatttagggtacacaaaacgatatgttcgctgccttcagattgccgaggtcgtaaactgtatgaaggatttgattgatcacagcaggcagactggatctggacccattggtatgatgttttga

SEQ ID NO: 21073 - protein, 627 aa, Sorghum bicolor
  misc_feature: Ceres ANNOT ID no. 8684322
  misc_feature: Down-regulated in root tissues in response to methyl jasmonate treatment
  misc_feature: Down-regulated in shoot tissues in response to methyl jasmonate treatment
  misc_feature: Down-regulated in shoot tissues in response to salicylic acid treatment
MGPGQPVGGAAASLLRTNSSLLSGGGQPGMMGGGGGGGGGMLSSQSPFSSLVSQRTQFGSNGLLGGASNVSSLLNRPPFGSGGPMQGPGSMQGGGMQMSTLQQRAGLDGGGDFISAGGSDALSFPSSSQVSLGNQMGSDNLQATSQQQQQQMDAVQDMQHQQLPMSYNQQQLPPQHSQQLQQPQATVKLENGGSMVSIKSEQQMGQPDQNGPGAQMMRSASVKLEPQQLQAQMMRSLSSVKMEQQTSDPSAFLQQQQQQQQQHHLLQLTKQIRNCPDLVSMGGPNTIANPQAAAAAQLTLLQQQRILHMQQQHQQQQQQQILKNLPLQRNQLQQQQQQHQQQQQQQQLLRQQSLNMRTPGKSPPYEPGTCAKRLTHYMYHQQNRPQDNNIEYWRNFVNEYFAPNAKKRWCVSLYGSGRQTTGVFPQDVWHCEICNRKPGRGFETTVEVLPRLCQIKYASGTLEELLYIDMPRESQNTSGQIILDYTKAIQESVFEQLRVVREGHLRIVFNPDLKIASWEFCARRHEELIPRRSIIPQVSNLGAVVQKYQAASQNSTSLSAQDMQNNCNSFVACARQLAKALEVPLVNDLGYTKRYVRCLQIAEVVNCMKDLIDHSRQTGSGPIGMMF

SEQ ID NO: 21074 - DNA, 1932 bp, Sorghum bicolor
  misc_feature: Ceres ANNOT ID no. 8684540
  misc_feature: Down-regulated in root tissues in response to salicylic acid treatment
  misc_feature: Down-regulated in shoot tissues in response to salicylic acid treatment
  misc_feature: Encodes the peptide sequence at SEQ ID NO 21075
atggaagtggacagaaggaagaatttgcagttccccccaaaaaatttcatttcgaaacctaatgggtggctcctttattgcgagaagattggatccaaggggaaggaggaggttcagagcaagaatcagaggcgggaggagccgctggcatcgtcggaggtggacatggatgagccagaggctgccgagagcggcgacatggttgttgatggcaacaatggcagctccaaagagagccccgtgccacccatggattccaagaactccaagggctgtgcggccaagaagcggagatccgtgagcgccgactttggggcggagctggacttggaccttggcaatggggaggagagtggggcacagcaggaggagaggaagctctctaggcaggaccgggttgagctttgcaggtcgttccagcacgcagtcagctcccatgattgggagagcgcagaggggctggtaggaatggccgatgcacaagggctcaacgatgtgctctgcgtggctgtggatgcgatttggttcttgagtgacaaggacgagctccttgctattgtggggttgatcaggaggattgtgtctgagggcgcaaaggattttacccgtgctgcgctccggacatcattcctcgcatcgtgcgtatcagcatgtaggggacggtcgactagccttgctgatgcagtgagcttcatgggtcagaaattgcatgaacgactccaagaatcccaaggtgatgaggtattgaaagcagaagcaagtgcaaaggtgcacaggtttacagaatgggctctaaagtgtatcgggctgcattcgcgtgttcgagagaataggggcaaaggaaaccatgacactgtcatcgaggttcaacttcagttgtctgctttcaagacatttcttgatcttgctgataatgagcttactgggaaggattttacggaggcttttgatgctgcatgcttccctcttacactcttttcaaccaccttcgaccaaggatgggcgtcaggaatatcagcagctgcagtacaagggcttttagagttgttggtagagggtggtgcagacaatgtaaaccaatgctttcttgaagctgcacgctatggcagcactgagcttgtccggatcttacttcagattgctcaaaggaacagcttggacattgatgtggatctagcccttggctttgctgctcactatgggaagatagaaaccatgggatgcttggttgaagaaggtaatgctgttggctttcttggccctttgatgcgtgctgctgaacgtggatgcctccaagttgtggaatggtttgtcaaccacgggtgtcgagaaatggagctttgtctagctcttactgctgccacctctagtagccagattgcagttgctgcttatcttcttcctcttgtcccgcaacatgttcttgcccccctcagcatcgagattatcaaggctgctggtgagaggagtacaggttccctgcatggtgtcgattttcttctccgttcagatttcctcaatgacccagctgccacatatgctgtggcagacagtattgcaagatgtaccgatgaagctgtggatgcaaagcttaggtctttcatgaatgagcattggagcgaggcagctttttctgcaggatttgaatctgcacaacagcactttgttaatttcatgaggataatggaaaggggggaatcaccaatccgcctaggggacctacctcttgagctggtaattgccatggcctacctgccactctataaggaatgtatgaattccattgggcgacttttgcctcaaaggcttagaggtcagcttgtggaggctgcaagcaggctcgaggatcggcaagtggaaagggatagccaaagcagagaactcttggccatcttggagcaccacatcccacgattcatgacccaaacttga

SEQ ID NO: 21075 - protein, 643 aa, Sorghum bicolor
  misc_feature: Ceres ANNOT ID no. 8684540
  misc_feature: Down-regulated in root tissues in response to salicylic acid treatment
  misc_feature: Down-regulated in shoot tissues in response to salicylic acid treatment
MEVDRRKNLQFPPKNFISKPNGWLLYCEKIGSKGKEEVQSKNQRREEPLASSEVDMDEPEAAESGDMVVDGNNGSSKESPVPPMDSKNSKGCAAKKRRSVSADFGAELDLDLGNGEESGAQQEERKLSRQDRVELCRSFQHAVSSHDWESAEGLVGMADAQGLNDVLCVAVDAIWFLSDKDELLAIVGLIRRIVSEGAKDFTRAALRTSFLASCVSACRGRSTSLADAVSFMGQKLHERLQESQGDEVLKAEASAKVHRFTEWALKCIGLHSRVRENRGKGNHDTVIEVQLQLSAFKTFLDLADNELTGKDFTEAFDAACFPLTLFSTTFDQGWASGISAAAVQGLLELLVEGGADNVNQCFLEAARYGSTELVRILLQIAQRNSLDIDVDLALGFAAHYGKIETMGCLVEEGNAVGFLGPLMRAAERGCLQVVEWFVNHGCREMELCLALTAATSSSQIAVAAYLLPLVPQHVLAPLSIEIIKAAGERSTGSLHGVDFLLRSDFLNDPAATYAVADSIARCTDEAVDAKLRSFMNEHWSEAAFSAGFESAQQHFVNFMRIMERGESPIRLGDLPLELVIAMAYLPLYKECMNSIGRLLPQRLRGQLVEAASRLEDRQVERDSQSRELLAILEHHIPRFMTQT

SEQ ID NO: 21076 - DNA, 1656 bp, Sorghum bicolor
  misc_feature: Ceres ANNOT ID no. 8684851
  misc_feature: Up-regulated in root tissues in response to salicylic acid treatment
  misc_feature: Encodes the peptide sequence at SEQ ID NO 21077
atgacgacgacgacgacgacgtcatccaaggcgacggggccatggagcaggctgtcggcggcggaggcggccgtgaaccgcgccgtggccgggagccgcgtgggggcctacttcaagctggacgcgcggaagagcaccttcaccaaggagctccgcgcgggcgccgccacgttcctcaccatggcctacatcatctccgtcaacgccgccgtcctcaccgactccggcgggccgtgcacggcgcgggactgcacccccgtggccaccgccaactccacggtcgtcgtcccgcctggcccggagtgcacggtcgtcggggccaacccggggtaccagcagtgcctggcgcgcaccaagagcgacctcatcgtggccacggccgtggccgccatggcgggctccttcgccatgggcgtcttcgccaaccttcccttggcgcttgcgcccggcatgggcgccaacgcctacttcgcctacaacatggtggggttccacgggtcaggccccatcggctaccgcacggcgctggccgtcgtgatgctggagggactcgtcttcttcgcgctgtccgccgtgggtctccggtcaaggctggcccggatgatcccgcggaacatccggctggcctcggcgttggggatcggcctgttcctggccttcacgggcctgcaggcgcaccagggcgtcgggctcgtcggcgccagcccgtcgacgctggtcacgctcacggcctgctccgacgtggacccggccacgggcgcctgcctcggcggcaccatgcggtcaccgacgttctggctcggcgccgtggggttcctcatcacggccacctgcctcgccagggacgtcaaagggagcatgatctacggcatcctcttcgtcaccgtcgtgtcctggatcagaggcaccagcgtgacggtgttcccggacacggcggcgggcaatgccggcttcgagtacttcaagaaagtggtggactttcacatgatccggaccaccgccgggaagctcagcttcgccggcttccggcacggcaacgtgtggctggccttcttcacgctcctgtacgtggacgtcctggacacgacggggacaatgtactcgatggcggagtacgccgggttcgtggacgaggacggcggcggcgggttcgagggcgagtaccgcgcgttcctggtggacgccgggtcgacggtgctcagcgcggggctggggagctcgacggtgaccacctacatcgagtcgacggcggggatccgggaaggcgggcggacggggatcaccgccgtcaccgtggccgcctgcttcctggcgtcgctcttcttcggcccgctgctcatgagcgtgccgccgtgggcagtgggaccgtcgctggtgctcgtgggcgccatgatgatgcgcgtcgccagggacatcgagtggggcgacatgaaggagggcgtcccggcgttcgtcaccatggcgctcatgccgctgtccttctccatcgcctacggcatcatcgccgggctgggagtctacgtcgcgctgcactggtacgactgggcgagacacgggtacggcaagctcagcaacgcgctggacgagcgccggaaccaggtggccgccgccgccggcgaaatcggcacggcgccggcagcgcacgacgtcgtctga

SEQ ID NO: 21077 - protein, 551 aa, Sorghum bicolor
  misc_feature: Ceres ANNOT ID no. 8684851
  misc_feature: Up-regulated in root tissues in response to salicylic acid treatment
  misc_feature (109)..(502): Pfam ID: Xan_ur_permease Pfam Description: Permease family
MTTTTTTSSKATGPWSRLSAAEAAVNRAVAGSRVGAYFKLDARKSTFTKELRAGAATFLTMAYIISVNAAVLTDSGGPCTARDCTPVATANSTVVVPPGPECTVVGANPGYQQCLARTKSDLIVATAVAAMAGSFAMGVFANLPLALAPGMGANAYFAYNMVGFHGSGPIGYRTALAVVMLEGLVFFALSAVGLRSRLARMIPRNIRLASALGIGLFLAFTGLQAHQGVGLVGASPSTLVTLTACSDVDPATGACLGGTMRSPTFWLGAVGFLITATCLARDVKGSMIYGILFVTVVSWIRGTSVTVFPDTAAGNAGFEYFKKVVDFHMIRTTAGKLSFAGFRHGNVWLAFFTLLYVDVLDTTGTMYSMAEYAGFVDEDGGGGFEGEYRAFLVDAGSTVLSAGLGSSTVTTYIESTAGIREGGRTGITAVTVAACFLASLFFGPLLMSVPPWAVGPSLVLVGAMMMRVARDIEWGDMKEGVPAFVTMALMPLSFSIAYGIIAGLGVYVALHWYDWARHGYGKLSNALDERRNQVAAAAGEIGTAPAAHDVV

SEQ ID NO: 21078 - DNA, 3360 bp, Sorghum bicolor
  misc_feature: Ceres ANNOT ID no. 8685150
  misc_feature: Up-regulated in shoot tissues in response to aminocyclopropane carboxylic treatment
  misc_feature: Up-regulated in root tissues in response to aminocyclopropane carboxylic treatment
  misc_feature: Up-regulated in shoot tissues in response to salicylic acid treatment
  misc_feature: Encodes the peptide sequence at SEQ ID NO 21079
atggcagaccttgtggttggcctggccaagacagtggtggagggggccttgaccaaggctcagtcagcgattgaggaggaggcaaaattgcagcaaagtgtgcagcacaaccttgtattcattgctggtgagtttgagatgatgcactccttcctcaacgttgccaatgaggagcgtgtcaagaacaacgttgtgaggacctgggtgaggcaggttcgtgatctggcatatgatgtggaggactgcatagagtttgtcatccacctggacaacaagccaaggtggtggcgccgtatgcttcctctttgcctggcagcatcagcattgcccttagatgaggcggtaactgagatagagcggctcaaggttagggttgaggatgtgagtcgaaggaactcacgctacagcctcatcagcgactctggatccaagcccatcatgcagcaacagatggcacccaacactgcttttggcacaatggcgcttgacatgctggttgaggcgagggacaccgcaaaaaagcagcaaggttttggagacctcacccagctactcacaaaggaacaagctgaccttggggtaatctcagtgtggggaacaggcagtgaacttggtacaacatccatcatcagaaagacgtaccaggacccagaactctgtcgaaaaattggatgtcgtggctgggtgaagcttacacaacctttcaatccccacgagttcctccgcagtatggtggctcagttctacagaaacagttgtctgcaaaaaggaatcgttataaatgtggaggaactgaagaggattgaggtaatggcgacaacggaaggcagactcattgaggcatttatggataaagtaaatgagaacagatacctagtcgtcctggaaaatctgtccacaattggagattgggacaccatcaggacttacctgccagacaggaagaatggaagttggatcattgtatccacacagcagtgcgaaattgcaagcttgtgcattgggcattcataccaagtatcggaggtgaagcagtactcagcagagcactctgtatgtgtcttcttcgaggaggtcagagggagtattcatttgctgctcatcaattccaaattccgtttcttgcaagcgaaatggtattctggtgttgggaaatcagcccttgttaggaacatgtactttgacagaattcatcgaaatgaccaattatttgagaagtatggttgggtggatgtaacccacccattcaatttaagggacttctcccgcagtttgcttttggatttttattcagaacctgttcaagccatgagaatcagagaccctacacaagagtgtcataagattatacaggataatcggtgccttgttgttattgatgatctgcagtccatcgaagaatgggacttaatacaagctgccttggtgtctagaccttctagaagtattatcattgtaattacaactgaagctagcattgccacacattgtgcagacaatgaaggggtcgtatttaatgtcaaaggtctagaagacaaagcagccctcaagctcttcaaaaagcagtgcggtggtcttcccaaggtgatagttgccgtagctatttttttggcacctaaaacagtcacatggatggatagtgcaagttctttgaacctcaaatttatgcaagagctggagagcagcccagagtttgcttgcctgcagccactctttggttggctgcactcctactttcgaacttgcccagatttcctcaagccatgtatcttctatctgtcaatttttcctcgaggtcacaggatccggagaaggcgattggtgagacggtggattgcagagggctatgccagggacacggacaaaatttctgcggatgagagaggggagcacttcttctgcaggctcctcgatctgagcataataatgcagaaaacatattcagtcaccaccacattcggtggcagaagaatgactttgtgccaagtcaatagttttgtccgggagtatatcatctcacgtcaaatggaagagaaccttgtatttgaactgggaggcagttgcaccctaacctctcagcgcacggggcgtcacctcatcatactgaaaagctgggacagagacagaattgtgtttgagagcattgacttctcacggctacggtctttgacagtgtttggagaatggaggccattcttcatatctgataggatgaggttacttcgggttctggatcttgaggatgcatctggtttaaaagatgaagatgttaaacaaatgatgaagctgctttgtcgcctcaagtatctttccttacgaggatgcagtgagatctctaggctgccgaattcattgggttgtttgaggcagcttgagactctggatgtcagacatacatccatagcaaccatgccaacaaccatcaccaagctgaagaaactgcagtaccttcgtgctagtaccaccaaaccaactgaggaacaaccaatacctgatactgctggtgcacccaaacctaccgagaaacaaccaaccccacgcaccacagtatcatggacatcatctttgttctgcagacatcgacagctagagggtgttgaggtgcctactgggatagacaaaatgactgcattgcacaccatcggtgttgttaatgtcgattctgctcgagggagggccatcttgaaagaggtcaggaagctcactcaattgcgcaagcttggagtgtctggaatcagtaggaacaacagcaaagatttctgtttggccatctcaagtcatgcgcatttagagtccttatcggttaggctcaagaaggacaatcaggattgcttgtatgtcaccccagacggctatcttccccccaagaacctacagagctttaaactgtatggtcttgcagacaagtttccagagtggatcaataagcttgacaatctcaggaagttagttttggagatgactatattaactgaagatactattaatggactcagggatcttaaaatatctattctacgtctcattgccaagcagcttcctgatggtaagctcaatttttgtgtcatgttgaatggacagcaattacgctgctatgaaacagtgaaggtactcgagatttcttgcagctccagcttagatgtgacttttggatcacaagcactacacaatcttgagctgttgaaagtttcctgctgtagtggttcagggtcggtaatgaagttgtctgggctagaaaaactgtctgaatctgaactcaaggaagtccagattaagggttcccatgatgacaaactcaaaaaagacgtggaggaacaacttggcaggcatcaaaagaaacctgttttgaagatggaataa

SEQ ID NO: 21079 - protein, 1119 aa, Sorghum bicolor
  misc_feature: Ceres ANNOT ID no. 8685150
  misc_feature: Up-regulated in shoot tissues in response to aminocyclopropane carboxylic treatment
  misc_feature: Up-regulated in root tissues in response to aminocyclopropane carboxylic treatment
  misc_feature: Up-regulated in shoot tissues in response to salicylic acid treatment
  misc_feature (339)..(620): Pfam ID: NB-ARC Pfam Description: NB-ARC domain
MADLVVGLAKTVVEGALTKAQSAIEEEAKLQQSVQHNLVFIAGEFEMMHSFLNVANEERVKNNVVRTWVRQVRDLAYDVEDCIEFVIHLDNKPRWWRRMLPLCLAASALPLDEAVTEIERLKVRVEDVSRRNSRYSLISDSGSKPIMQQQMAPNTAFGTMALDMLVEARDTAKKQQGFGDLTQLLTKEQADLGVISVWGTGSELGTTSIIRKTYQDPELCRKIGCRGWVKLTQPFNPHEFLRSMVAQFYRNSCLQKGIVINVEELKRIEVMATTEGRLIEAFMDKVNENRYLVVLENLSTIGDWDTIRTYLPDRKNGSWIIVSTQQCEIASLCIGHSYQVSEVKQYSAEHSVCVFFEEVRGSIHLLLINSKFRFLQAKWYSGVGKSALVRNMYFDRIHRNDQLFEKYGWVDVTHPFNLRDFSRSLLLDFYSEPVQAMRIRDPTQECHKIIQDNRCLVVIDDLQSIEEWDLIQAALVSRPSRSIIIVITTEASIATHCADNEGVVFNVKGLEDKAALKLFKKQCGGLPKVIVAVAIFLAPKTVTWMDSASSLNLKFMQELESSPEFACLQPLFGWLHSYFRTCPDFLKPCIFYLSIFPRGHRIRRRRLVRRWIAEGYARDTDKISADERGEHFFCRLLDLSIIMQKTYSVTTTFGGRRMTLCQVNSFVREYIISRQMEENLVFELGGSCTLTSQRTGRHLIILKSWDRDRIVFESIDFSRLRSLTVFGEWRPFFISDRMRLLRVLDLEDASGLKDEDVKQMMKLLCRLKYLSLRGCSEISRLPNSLGCLRQLETLDVRHTSIATMPTTITKLKKLQYLRASTTKPTEEQPIPDTAGAPKPTEKQPTPRTTVSWTSSLFCRHRQLEGVEVPTGIDKMTALHTIGVVNVDSARGRAILKEVRKLTQLRKLGVSGISRNNSKDFCLAISSHAHLESLSVRLKKDNQDCLYVTPDGYLPPKNLQSFKLYGLADKFPEWINKLDNLRKLVLEMTILTEDTINGLRDLKISILRLIAKQLPDGKLNFCVMLNGQQLRCYETVKVLEISCSSSLDVTFGSQALHNLELLKVSCCSGSGSVMKLSGLEKLSESELKEVQIKGSHDDKLKKDVEEQLGRHQKKPVLKME

SEQ ID NO: 21080 - DNA, 1308 bp, Sorghum bicolor
  misc_feature: Ceres ANNOT ID no. 8685877
  misc_feature: Up-regulated in root tissues in response to methyl jasmonate treatment
  misc_feature: Up-regulated in shoot tissues in response to methyl jasmonate treatment
  misc_feature: Encodes the peptide sequence at SEQ ID NO 21081
atggaatgccgcagcatttcggagaccctgctacgcgccaatgccgcgctctgcgtgctcgcgccggccgtctgcgggctgcgcggtgcccaccgccgcagcattcacttcgcgccaggcccgtccgcgcccgacgaggacgatgtgcgagaccgcgccccgcctccgcggcgctggtaccgggcagcatacgcccggctcctccggcatgcggggacactggcgggggtggaccacgcgggcggccttccgcggcacagggcgacgggatccctcgtctcatgcccgcacgccgccgctcgggccgcgcactttgacgtgctcgcgggtgagttcgtcgtcgccgccgccgccgcgagccgtggccacccgccgccgaagatggaggcgacgtcgctgagctcgttgacgcaggtctgcgacgtgctcggcgtaacggcgcagcggagaaagagcgtgcggctcaccgtctgcccgcaggtgactcagcaccacatctggcggggcgcgctcgaggcggtgctcggggatctccaggccgatatggcgtcgctggacagcccgtccccagcgacccagatggccgagcagatcgcgtccgcctgcacccgcttcctgtccgagacggcgacgtcctcgtcgccgtcctggatgcgcccgacgccgtttaagaaaccagcagaaccgccgcctccggccaagaagtggcaagaagtgctggacatgtttactgacctcgccaggagcctggagaccgaggatcgactcaccgggcacgcgcagaaggtggaggccatgaaggaggggctgttccagatacgcgacgtcgtcattgagcgggacatcgccttcaaggaggcgcgccggcaggactgcctagtgcagaggaagctgtccaagagcctggggcactcctccaagtgcctgtacacgctgctcctcttctacctctatggcaccgtccgggacatggaggtgcacgccggcaagtgcatttctggcaagggaggcaggaatgtcgtcgttcacgccgcgcaatttctgaccgatggcgatgaatcaactatcaggagcggcatcaagcagctgagccgcgctctcggcatcttccggtttgtttgggaggccgcaaatactgactgtgatgctgccaatcagaatggcaaagatgtggtggtcaagaaaaagaatgaagatgcaaagggtgtgttggagctgcaaggtcatctgtggagcttcggtgttgaggagaagactctgacgtacagaggagatgtgttccaagtgcatcagattcagttaccatga

SEQ ID NO: 21081 - protein, 435 aa, Sorghum bicolor
  misc_feature: Ceres ANNOT ID no. 8685877
  misc_feature: Up-regulated in root tissues in response to methyl jasmonate treatment
  misc_feature: Up-regulated in shoot tissues in response to methyl jasmonate treatment
MECRSISETLLRANAALCVLAPAVCGLRGAHRRSIHFAPGPSAPDEDDVRDRAPPPRRWYRAAYARLLRHAGTLAGVDHAGGLPRHRATGSLVSCPHAAARAAHFDVLAGEFVVAAAAASRGHPPPKMEATSLSSLTQVCDVLGVTAQRRKSVRLTVCPQVTQHHIWRGALEAVLGDLQADMASLDSPSPATQMAEQIASACTRFLSETATSSSPSWMRPTPFKKPAEPPPPAKKWQEVLDMFTDLARSLETEDRLTGHAQKVEAMKEGLFQIRDVVIERDIAFKEARRQDCLVQRKLSKSLGHSSKCLYTLLLFYLYGTVRDMEVHAGKCISGKGGRNVVVHAAQFLTDGDESTIRSGIKQLSRALGIFRFVWEAANTDCDAANQNGKDVVVKKKNEDAKGVLELQGHLWSFGVEEKTLTYRGDVFQVHQIQLP

SEQ ID NO: 21082 - DNA, 2007 bp, Sorghum bicolor
  misc_feature: Ceres ANNOT ID no. 8685878
  misc_feature: Up-regulated in shoot tissues in response to salicylic acid treatment
  misc_feature: Encodes the peptide sequence at SEQ ID NO 21083
atgccggcgtggtggaaaggcaagggcaggagcaagtctagcaaggccggagcggcggcggcgccggccgggtcgatcccggcggccgttgcaatcgcaggcgaggtgaaggaggagaaggggaagaagaaggcgagcagcttcgacgaggcgctcctcgccaagggcgtccgcgggaagcagcaaccagcggcagcggcgggggaggttattgggcttccgctccctcgcccggcgtccttgccgctgccgtccgcctcggcctccgcctccgcctcggcgtccagcggcggcggctcctcgctggggtcctcggcgtccgacgaccagctggatctcggggtttacaggttgtcagaaacaagcagcactcttctgggcagaacagtagcaattgaatctcggaaacaaagtcatatgccagcagaggggaccattttcaccaataatcaggctgtggagcatacccgaatgtctgaaacatctgtttccccaaggaaagaatttcaccttcaaaatctggatcttgcaaatgatcgaactacatactgtcgtggtcggaaatcaacagaaattgtgttcagtacacaagtgcccacttctcctcctagctcaagaggacatcactatacaaattcccctgtgccatcaagaacatttgggcaatgccctacatctcctacttcatggcaggaggattcgcgaagctcaagctcaccccaacctcttcctcttcctccaggctccccatgcttgccttcccgttctctacagtggaagaaggggaagttgctaggtagtgggacgtttgggcaagtatacatgggattcaacagtgaaggcggtcaaatgtgtgcaattaaagaggttaaagtcatttcagatgattctaactcaaaagagtgcctcaggcagctaaatcaggaaatcatgctgctgagagagctgtcacatccaaacattgttcagtactatggcagtgatttgtgcaatgagacactctcagtctatctcgagtatgtttctgggggctctatccataagttgcttcaggaatatggtccgtttggggaggcagttcttcggaattacacagcacaaatcctttctggccttgcgtacttgcatgggcggaatacagtgcatagagatatcaaaggggcaaacatacttgtcgatcctaatggtgacatcaagcttgctgattttggtatggccaagcatatatcagcatatacatctatcaaatccttcaaagggagcccttactggatggccccagaggtaattatgaatagcaatggttacagcctttcagtagacatttggagccttggctgcaccatacttgagatggcaacagcaaagcctccttggagtcagtatgaaggggtggcagcaatattcaaaattgggaacagcaaagacatacctgatatcccagatcatctttcttctgaggcaaaaagcttcctgaaactctgcttgcagcgtgatcctgctgcccgccctacagctgctcagctgatggatcacccttttgtcaaggaccatgctacagccaggagttccaggtctggcatcacgagggatatgtttcctacttcaactgatggaaaaaacagcatggtaaagattgcaacttcatcatacagaagcttatctcctttaagagatcctgatatcatgataagaaacttgccaggaccaacatcccccattccttcgacatcaaatcgcaggatcacagcattgaacccatccactgttcggatgaacatgtcgctgcctgtctctccctgctctagcccgctacggcagtacaggcagtccaaccgaagttgcttgccatcccctcctcacccagcctattcagctggagcagccaactacagtcctatcaacaatgcactctacccgatgcgaccaagcagcggtctcacagatccatggctcgaaatctctcggccgaaaacacaaacttttgattctccaagaagattgtag

SEQ ID NO: 21083 - protein, 668 aa, Sorghum bicolor
  misc_feature: Ceres ANNOT ID no. 8685878
  misc_feature: Up-regulated in shoot tissues in response to salicylic acid treatment
  misc_feature (259)..(527): SWISSPROT Homolog: EC 2.7.11.25 Mitogen-activated protein kinase kinase kinase
  misc_feature (259)..(515): Pfam ID: Pkinase Pfam Description: Protein kinase domain
MPAWWKGKGRSKSSKAGAAAAPAGSIPAAVAIAGEVKEEKGKKKASSFDEALLAKGVRGKQQPAAAAGEVIGLPLPRPASLPLPSASASASASASSGGGSSLGSSASDDQLDLGVYRLSETSSTLLGRTVAIESRKQSHMPAEGTIFTNNQAVEHTRMSETSVSPRKEFHLQNLDLANDRTTYCRGRKSTEIVFSTQVPTSPPSSRGHHYTNSPVPSRTFGQCPTSPTSWQEDSRSSSSPQPLPLPPGSPCLPSRSLQWKKGKLLGSGTFGQVYMGFNSEGGQMCAIKEVKVISDDSNSKECLRQLNQEIMLLRELSHPNIVQYYGSDLCNETLSVYLEYVSGGSIHKLLQEYGPFGEAVLRNYTAQILSGLAYLHGRNTVHRDIKGANILVDPNGDIKLADFGMAKHISAYTSIKSFKGSPYWMAPEVIMNSNGYSLSVDIWSLGCTILEMATAKPPWSQYEGVAAIFKIGNSKDIPDIPDHLSSEAKSFLKLCLQRDPAARPTAAQLMDHPFVKDHATARSSRSGITRDMFPTSTDGKNSMVKIATSSYRSLSPLRDPDIMIRNLPGPTSPIPSTSNRRITALNPSTVRMNMSLPVSPCSSPLRQYRQSNRSCLPSPPHPAYSAGAANYSPINNALYPMRPSSGLTDPWLEISRPKTQTFDSPRRL

SEQ ID NO: 21084 - DNA, 1767 bp, Sorghum bicolor
  misc_feature: Ceres ANNOT ID no. 8688076
  misc_feature: Down-regulated in shoot tissues in response to salicylic acid treatment
  misc_feature: Encodes the peptide sequence at SEQ ID NO 21085
atggcgctctctgtggagaagacctcgtctgggcgggagcacaaggtcaaggacctctcgcaggcggacttcggccgcctggagatcgagctggccgaggtcgagatgcccggtctcatggcgtgccgcgccgagtttggcccgtccaagcccttcgccggcgctaggatctctgggtcgctccacatgaccatccagactgccgtcctcatcgagaccctcaccgcgctcggcgcggaggtccgctggtgctcctgcaacatcttctccacgcaggaccacgccgccgccgccatcgcgcgtgactcggccgccgtgttcgcctggaagggggagaccctcgaggagtactggtggtgcaccgagcgctgcctcgactggggcgagggcggcggtcccgacctcatcgtcgacgacggaggtgacgcaacgctgctcatccacgagggtgtcaaggccgaggaggagtacgagaagaccggcaagatccccgacccggagtccacagacaacgctgagttcaagatcgtgctcaccatcatccgcgacgggcttaaggctgaccctaagaagtaccgcaagatgaaggagaggcttgtcggcgtctctgaggagaccaccaccggagtcaagaggctctaccagatgcaggagaccggcgccctcctcttccctgctattaacgtcaacgactccgtcaccaagagcaagtttgacaacctgtatggttgccgccactccctccctgatggtctgatgagggccacagacgttatgattgctggcaaggttgccgtggtctgtggatacggtgatgttggcaagggctgtgctgctgcactcaagcaggctggtgcccgtgtcattgtgactgagatcgaccccatctgtgccctccaggctctgatggagggtcttcaggtccttacattggaggatgttgtctctgaggctgacatctttgtgaccaccaccggcaacaaggatatcatcatggttgaccacatgaggaagatgaagaacaatgccattgtctgcaacattggccactttgacaatgaaattgatatgcttggtctcgagacctaccctggtgttaagcgcatcaccatcaagccccagactgaccgctgggtgttccctgagaccaaaactggcatcattgtccttgctgagggtcgtttgatgaaccttgggtgtgctactggccatcctagctttgtaatgtcctgctcattcactaaccaggtcattgcccagcttgagctctggaaggagaagagctctggcaagtatgagaagaaggtgtatgtgctccccaagcaccttgatgagaaggttgctgctctccacttgggcaagcttggtgccaagctgaccaagctcaccaaatcccaggctgactacatcagcgtgccgatcgagggcccctacaagcctgcccactaccgctatcttcatgcttccaagacgaggaaattattcacaagtgaggctgagatccaagtgaccttcagtgaagacttggagacgcccttgttgtacggttttgtgatgggcaccagaaagactcttctcagggctgcaaggatggctggttggctccattatcttagtgaaaagaggtttccaaaaacaagacaggttggatttgatcttgttcttggttcaaatggcaagcagttccgaacctgcagtattgaggttgttcgatttgtaaagttacttgatgaggctaaatcttggagcacatcagaattactatag

SEQ ID NO: 21085 - protein, 588 aa, Sorghum bicolor
  misc_feature: Ceres ANNOT ID no. 8688076
  misc_feature: Down-regulated in shoot tissues in response to salicylic acid treatment
  misc_feature (1)..(485): SWISSPROT Homolog: EC 3.3.1.1 Adenosylhomocysteinase
  misc_feature (12)..(484): Pfam ID: AdoHcyase Pfam Description: S-adenosyl-L-homocysteine hydrolase
  misc_feature (240)..(403): Pfam ID: AdoHcyase_NAD Pfam Description: S-adenosyl-L-homocysteine hydrolase, NAD binding domain
MALSVEKTSSGREHKVKDLSQADFGRLEIELAEVEMPGLMACRAEFGPSKPFAGARISGSLHMTIQTAVLIETLTALGAEVRWCSCNIFSTQDHAAAAIARDSAAVFAWKGETLEEYWWCTERCLDWGEGGGPDLIVDDGGDATLLIHEGVKAEEEYEKTGKIPDPESTDNAEFKIVLTIIRDGLKADPKKYRKMKERLVGVSEETTTGVKRLYQMQETGALLFPAINVNDSVTKSKFDNLYGCRHSLPDGLMRATDVMIAGKVAVVCGYGDVGKGCAAALKQAGARVIVTEIDPICALQALMEGLQVLTLEDVVSEADIFVTTTGNKDIIMVDHMRKMKNNAIVCNIGHFDNEIDMLGLETYPGVKRITIKPQTDRWVFPETKTGIIVLAEGRLMNLGCATGHPSFVMSCSFTNQVIAQLELWKEKSSGKYEKKVYVLPKHLDEKVAALHLGKLGAKLTKLTKSQADYISVPIEGPYKPAHYRYLHASKTRKLFTSEAEIQVTFSEDLETPLLYGFVMGTRKTLLRAARMAGWLHYLSEKRFPKTRQVGFDLVLGSNGKQFRTCSIEVVRFVKLLDEAKSWSTSELL

SEQ ID NO: 21086 - DNA, 921 bp, Sorghum bicolor
  misc_feature: Ceres ANNOT ID no. 8689434
  misc_feature: Down-regulated in root tissues in response to aminocyclopropane carboxylic treatment
  misc_feature: Down-regulated in shoot tissues in response to aminocyclopropane carboxylic treatment
  misc_feature: Up-regulated in root tissues in response to salicylic acid treatment
  misc_feature: Encodes the peptide sequence at SEQ ID NO 21087
atgtatatactcctacttgacagggttgctgtggtgaccggtggcaacaaagggatcgggctagaggtgtgccggcagctggccagcaataagggccttatcgttgtcttaacagcccggaatgaccagaggggcgcatccgccgtccagaagctcaaagaagcaggacattctaatgtcattttccatcagctggacaccaccgatgctctgagcatctctcgattggctgatttcttgaagagccgtttcggcaggatagacatcctggtgaacaacgccgcacttggtggtgttgagtacgtccaggatcctgcgtatagttcaacatccagcgagctagagctgcgtggcatgaacaagcagcagatggcagaatggatgttctcaaaggtcaaggagactttggacgccgctaaggaaggtctgcggaccaactactacggcaacaaagctgtaacccaagccttgcttcccctgctcaaagcttcctccgatggcagaatcgttttcgtctcctctgactacgggctgatagggcaactcaaagacgaggagctgaagaaggagctagacgacattgagaggctcacggaggagaggctggatgagatgctcgccacgtacctcaaagacttcgaggcgggggcgttggcggcgcgcggctggccgacgaatttctcagcgtacaaggtgggcgccgttgccatgaacgcctacgcgaggatcaccgcgaggatgcaccccgagctgcgcgtcaactgcgccaaccctggctacgtgaggaccgacatgtccgtgtactccgggtcgctgacgccggcggaaggcgcaagcaatctgctaaaggtggcgctgctgccggaaggcgggccgaccggctcctacttcagcgacggtcaggttgcgtcgtttgtgtga

SEQ ID NO: 21087 - protein, 306 aa, Sorghum bicolor
  misc_feature: Ceres ANNOT ID no. 8689434
  misc_feature: Down-regulated in root tissues in response to aminocyclopropane carboxylic treatment
  misc_feature: Down-regulated in shoot tissues in response to aminocyclopropane carboxylic treatment
  misc_feature: Up-regulated in root tissues in response to salicylic acid treatment
  misc_feature (9)..(117): SWISSPROT Homolog: EC 1.1.1.184 Carbonyl reductase (NADPH)
  misc_feature (223)..(269): SWISSPROT Homolog: EC 1.1.1.289 Sorbose reductase
  misc_feature (8)..(187): Pfam ID: adh_short Pfam Description: short chain dehydrogenase
MYILLLDRVAVVTGGNKGIGLEVCRQLASNKGLIVVLTARNDQRGASAVQKLKEAGHSNVIFHQLDTTDALSISRLADFLKSRFGRIDILVNNAALGGVEYVQDPAYSSTSSELELRGMNKQQMAEWMFSKVKETLDAAKEGLRTNYYGNKAVTQALLPLLKASSDGRIVFVSSDYGLIGQLKDEELKKELDDIERLTEERLDEMLATYLKDFEAGALAARGWPTNFSAYKVGAVAMNAYARITARMHPELRVNCANPGYVRTDMSVYSGSLTPAEGASNLLKVALLPEGGPTGSYFSDGQVASFV

SEQ ID NO: 21088 - DNA, 3060 bp, Sorghum bicolor
  misc_feature: Ceres ANNOT ID no. 8690591
  misc_feature: Down-regulated in shoot tissues in response to aminocyclopropane carboxylic treatment
  misc_feature: Down-regulated in shoot tissues in response to salicylic acid treatment
  misc_feature: Encodes the peptide sequence at SEQ ID NO 21089
atgggccccgttcgactcgtcctcctcctcctcgccgccgtcttcgctgccgcgggcgtgggcgaggcggtgtacatcccctacaacacgtcggcgggggtggtgccggggaagctcaacgtgcacgtcgtgccgcacacccacgacgacgtcggctggctcaagaccgtggaccagtactacgtcggatccaacaactcaatccagggggcatgcgtgcagaacgtgctggattcgctcatcccggcgctgctcaaggacgagaaccgaaagttcatctatgttgagcaggcattcttccaaagatggtggaggaaccagaatgacatgatcaaggatacggtgaaagggctcatcagctctggacggctggaattaataaatggtggcatgtgcatgcatgatgaggcggctgtacactacattgacatgatcgatcagactacacttgggcacaggtacatcaaggaggagtttggccagatcccacggattggctggcagattgatccgtttgggcactctgcagttcaggcttaccttcttggtgcagaagtaggatttgatgctttctatttcttccggattgattaccaagaccgtgatacacggaagggaacaaaagaacttgaggttgtatggaggggctccaagaccttgggctcatcagctgatatctttgctggcatctttccaaaaaactacgaaccacctcctggtgaattttattttgaagttgatgataattcccctgttgtccaggatgatccccttcttttcgattataatgttgaggaacgagtaaatgattttgttgctgcagctgtagcacaggcaaatatcacgaggacaaaccatatcatgtttacgatgggaacagacttcaaataccaatatgcagagagttggttcagaaatatggacaaactaattcactatgtgaacaaggatggccgtgtcaatgctctttattccacaccttcaatttataccgatgcgaaatatgctgcaaatgagctgtggcctctcaagactaatgatttcttcccatatgcagacaacccaaatgcctattggacagggtactttacaagcagacctgccttaaaacgatatgtccgcatgatgagtgggtattacctggcagctagacagctggagttctttaaagggagacatagctcaggtctctcaacagatagtctaggtgatgctctagctcttgcgcagcaccatgatgctgttacaggaacagagaaacaacatgttgcaaatgattatgcaaagagattgtcaattggatatacacaagcccaggagctcgtttcaacttctcttgcttgcttgacagagtcaggctcaaaatcgcattgctcatccccaatgacgaaattttcacaatgtcttctgctaaatgttacatattgccctccttctgagatggacttaacaaaaggaaaaagcttggttgttcttgtatacaactcgcttgggtggaaacgagaagacatccttcgtataccagttttcagtgattccattgttgttcatgattctgaaggaagagaaattgaatcacaacttctgcctatagctactgcctcgttgaacataagagacaagcatgtcaaggcttacctgggcacaacgccaggtgcaaagcccaagttttggcttgcttttcctgtgtctataccacctcttggtttcaatacttattttgtctcaaactcgaagaaatcagcacatatgtcttcaaagtccagtcagtactcacctcaaggaagtgaaagtagtaatctacaagttggtcaagggaacttgaaacttcaatataatgcagctggaacattatccctgtactccgatagtaagactcaggttcaagcaaattttgagcagaaatacaagtattacattggacaggatggaaatgcaactgatcctcaggcttctggagcatacatattccgccctaatggcacagttccaatcaagactgatgatcaggttcctcttacggttctgcgtgggcccatagtggatgaagtgcaccagcagataaattcatggatatatcagattaccagagtttacaaggggaaggactatgtggaaactgaatttatagttggacctataccagtagatgatggaaatgggaaagaattagcaactgaaattgttacaaacatggcgacaaacaaaacattttacactgattccagtggacgtgatttcatcaaaaggataagagattatcgatcggagtggaagattgaagtgcaccagcctattgctggaaactattatcctattaatcttggcatttatgtggaggatggcaacaaagagttgtctgtactggtagacaggtcaattggaggttccagtataaaggatggacaaatagaactaatgctacacaggaggctactccatgatgatgggcgaggcgtcgccgaggcgctaaatgaaacagtctgtctcgataagcaatgtgaaggactaattatacaaggaaaatactacgttaaaatagatccacaaggagaaggagctcggtggcgtcggacatttggccaggaaatatactctcctctcctccttgctttcacagagcaggatggaggcaactgggcgaattcgcatgttgcaaaattctctgccatggattcaacttacagcttgcctgataatgttgcaatgcttacccttgaggagcttgaagatggaagtgttctccttcggtttgctcatctatacgaggccggggaggacaaggatctttcagctttagcgagtattgacctcaagagagtgttcccagataataagattggcaagatcatcgagacaagcctatcggcaaaccaagaacgcacggccatggagaagaagcgcttgaagtggaaggtgcaaggttctgctgctgacgagaaggtggtccggggtggtcctgtggatccttctaagcttgttgttgagctggggccaatggagatccgcacattcatcgtcagtttcgatcacaacattagggacaaacagctgctctga

SEQ ID NO: 21089 - protein, 1019 aa, Sorghum bicolor
  misc_feature: Ceres ANNOT ID no. 8690591
  misc_feature: Down-regulated in shoot tissues in response to aminocyclopropane carboxylic treatment
  misc_feature: Down-regulated in shoot tissues in response to salicylic acid treatment
  misc_feature (28)..(529): SWISSPROT Homolog: EC 3.2.1.24 Alpha-mannosidase
  misc_feature (489)..(1006): Pfam ID: Glyco_hydro_38C Pfam Description: Glycosyl hydrolases family 38 C-terminal domain
  misc_feature (40)..(353): Pfam ID: Glyco_hydro_38 Pfam Description: Glycosyl hydrolases family 38 N-terminal domain
  misc_feature (357)..(431): Pfam ID: Alpha-mann_mid Pfam Description: Alpha mannosidase, middle domain
MGPVRLVLLLLAAVFAAAGVGEAVYIPYNTSAGVVPGKLNVHVVPHTHDDVGWLKTVDQYYVGSNNSIQGACVQNVLDSLIPALLKDENRKFIYVEQAFFQRWWRNQNDMIKDTVKGLISSGRLELINGGMCMHDEAAVHYIDMIDQTTLGHRYIKEEFGQIPRIGWQIDPFGHSAVQAYLLGAEVGFDAFYFFRIDYQDRDTRKGTKELEVVWRGSKTLGSSADIFAGIFPKNYEPPPGEFYFEVDDNSPVVQDDPLLFDYNVEERVNDFVAAAVAQANITRTNHIMFTMGTDFKYQYAESWFRNMDKLIHYVNKDGRVNALYSTPSIYTDAKYAANELWPLKTNDFFPYADNPNAYWTGYFTSRPALKRYVRMMSGYYLAARQLEFFKGRHSSGLSTDSLGDALALAQHHDAVTGTEKQHVANDYAKRLSIGYTQAQELVSTSLACLTESGSKSHCSSPMTKFSQCLLLNVTYCPPSEMDLTKGKSLVVLVYNSLGWKREDILRIPVFSDSIVVHDSEGREIESQLLPIATASLNIRDKHVKAYLGTTPGAKPKFWLAFPVSIPPLGFNTYFVSNSKKSAHMSSKSSQYSPQGSESSNLQVGQGNLKLQYNAAGTLSLYSDSKTQVQANFEQKYKYYIGQDGNATDPQASGAYIFRPNGTVPIKTDDQVPLTVLRGPIVDEVHQQINSWIYQITRVYKGKDYVETEFIVGPIPVDDGNGKELATEIVTNMATNKTFYTDSSGRDFIKRIRDYRSEWKIEVHQPIAGNYYPINLGIYVEDGNKELSVLVDRSIGGSSIKDGQIELMLHRRLLHDDGRGVAEALNETVCLDKQCEGLIIQGKYYVKIDPQGEGARWRRTFGQEIYSPLLLAFTEQDGGNWANSHVAKFSAMDSTYSLPDNVAMLTLEELEDGSVLLRFAHLYEAGEDKDLSALASIDLKRVFPDNKIGKIIETSLSANQERTAMEKKRLKWKVQGSAADEKVVRGGPVDPSKLVVELGPMEIRTFIVSFDHNIRDKQLL

SEQ ID NO: 21090 - DNA, 3417 bp, Sorghum bicolor
  misc_feature: Ceres ANNOT ID no. 8690675
  misc_feature: Down-regulated in root tissues in response to salicylic acid treatment
  misc_feature: Down-regulated in shoot tissues in response to salicylic acid treatment
  misc_feature: Encodes the peptide sequence at SEQ ID NO 21091
atggatcccaactccggatccgcgtctcgccacgggcgcctcctcatctcgccgtcgctctccactccgaccttctccacccgctccccgtccccctcaccggccgcgtcccccgcgccgcaccaccaccaccaggagcgccgcaactccacgtcctccccgaaaccactggtccccttcccggcctcctcttccgccagccggccccgctcctccttcggcggcgcggggccccgcggcgccgcggcgggggcggcctcggcctcgggcccggcgttcgcccacaacgcgcgcctcgcggcggcgctggtgcccgccgcggccttccttctcgaccttggcgggctccccgtcttcgccgtcctcgccatcggcctcgcggcggcgtacctcctcgacgcgctccagctgcgccagggcgccttcttcaccatgtgggcggcgctgctcgcggccgatgtcgccttcttcttctccgcctccctctcgtctgccgccgccgcctctctgccactcaccgtcctcgcgctgcttctatgcgccgagacctccttcctcattggcgtatgggcatcgctgcagttccgatggatccagctcgagaacccgaccattgttgccgccctagagcggttgctcttcgcgtgtgtgcccatcgccgcgcctgccctcttcacgtgggctctcgtatctgcggtcggcatgaccaatgcatcctactactttgccgcgttctgcatggtgttctactggatgttctccataccccgtccgtccagcttcaatagccggaagcaggatgctccaatgctggacagtgatggcattcttggccccttggagagctgtgtgcattctctgtatgtgctgtttgtgccggtgttgttccatgctgcatcccatcatgccacactcttcacttcgtgggccagtgtgtctgaattgctgctgctgttcttcataccgttcttgttccagctttatgcttccactcgtggtgcactgtggtggatcaccagggatgcacgcgcaatggaccagataagaattgcgaatgggttcgttgcactggtcgtggtggtgctttgccttgaggtgcgagttgtattccactcgtttggaagatacattcatgctccaccaccgttgaattacctgcttgtaactgtcacaatgcttggtggcgctttgggccttgcagcacatgctgcgggcaaggtcggggatgctgctagctcggtggcttttacaggggtggcagtgctagtcagtggagcaggagctgtagtcattggattccccgtgatgtttctgccactgccgatgatttctggctattatgttgcaaggttctttactaagaaaagtttgtcatcatactttacctttgtggcacttgcaagcttgatggtcctttggtttgtggtgcacaattattgggatctgaatatttggcttgctggcatgccattgaagtccttcaccaagtatattgttgcagctgtcatcatggcaatggctgttcctggtttggcacttctcccaacaaaacttcgttttcttctggaacttggtcttattggtcatacattgttgctatgctacatcgagaaccgattgttcaactatgcctccatgtattactatggatttgaagaggatatcatctatcctaattatatggtttttattacaacctttttgggcttggctcttgtaagaagattacatgtagatcagagactagggcccaaagctgcttggattttaacttgtctatattcatcaaaattagcaatgctgtttatgacatcaagatcagttatatgggtctcagctgttctgctacttgctgttaccccccctttacttctttacagagacaagtccaaaggagcttctaagatgaaagtctggcaagcttatttccatgcatctgtaatagcgttttctgcctggctctgtcgggaaacaatttttgaagctttacaatggtggaatggaagacctccttcagatggtttgttactgggttcatatattctgttgacaggagttgcatgcattccaatagtcgttctccatttcccacatgttcagtcagcgaagagattcctggtccttgttgtggctacaggccttctcttcgttgttatgcagcctcctattaagctatcatgggtataccggtcggattttatcacagcagcacatttatctgatgatgacatttcaatatatgggtttgtagcatctaagcccacatggccgtcatggctgcttattgcaactgtggtacttacactagcagcagttacatccatcatcccagtgaagtatgttgttgagctgagggctttgtatgcagtggcagttgggattactctaggcatctacatatctgttcagtacttcttccaggcagttgttctgtatcctcttcttgttgcaacaattgtctctgcggcagtctttgtcgtattcacacatcttccttctgaatctagcacaagggttttgccatgggtgttctctttcttggtagctttgttcccagtcacctatctgcttgaaggacacttaagatccaaaagttttgcagatgaggatgaagcagagaagttcaccaacatgttggctatagaaggggctagaatgtcacttttgggtctctatgctgctatcttcatgattattgcattagaaatcaagtttgagctggctttgctattgcgtgaaaaggctgcagacagaggtatgcatggtccatctagtcggagttctgccttcccacccaaagcaaggctgctccagcaacgaagagctcatgctgcaccaaccttcaccatcaagaggttggcagcagaggcagcatggatgcctgctatcggcaatgtttctactgtgctgtgttttggcatctgcctggttctaaatataacactcactggtggttcgaaccgtgctattttcttcctggcgcccatccttctgcttttgaaccaggattcagatatctttgcaggatttggtgataggcagcgctattttccagtgacagtttctatttctggttatttattattgacagcattgtatagaatatgggaggagacttggcctggcaatggaggatgggctcttgacattgggggcccaggctggctgtttgctgtgaagaattttgctcttcttgtgctcgcattaccgaatcacatactcttcaatcgcttcatgtgggactatgtcagacagacagacgccaagctactgctgacactacctctcaacttgccttcgattataatgacagacatacttgctattcgggtgttaggattgctaggagctatgtactctcttgcccagtacatgatatcaaggcgtataagaattgctgggatgagatacatttga

SEQ ID NO: 21091 - protein, 1138 aa, Sorghum bicolor
  misc_feature: Ceres ANNOT ID no. 8690675
  misc_feature: Down-regulated in root tissues in response to salicylic acid treatment
  misc_feature: Down-regulated in shoot tissues in response to salicylic acid treatment
MDPNSGSASRHGRLLISPSLSTPTFSTRSPSPSPAASPAPHHHHQERRNSTSSPKPLVPFPASSSASRPRSSFGGAGPRGAAAGAASASGPAFAHNARLAAALVPAAAFLLDLGGLPVFAVLAIGLAAAYLLDALQLRQGAFFTMWAALLAADVAFFFSASLSSAAAASLPLTVLALLLCAETSFLIGVWASLQFRWIQLENPTIVAALERLLFACVPIAAPALFTWALVSAVGMTNASYYFAAFCMVFYWMFSIPRPSSFNSRKQDAPMLDSDGILGPLESCVHSLYVLFVPVLFHAASHHATLFTSWASVSELLLLFFIPFLFQLYASTRGALWWITRDARAMDQIRIANGFVALVVVVLCLEVRVVFHSFGRYIHAPPPLNYLLVTVTMLGGALGLAAHAAGKVGDAASSVAFTGVAVLVSGAGAVVIGFPVMFLPLPMISGYYVARFFTKKSLSSYFTFVALASLMVLWFVVHNYWDLNIWLAGMPLKSFTKYIVAAVIMAMAVPGLALLPTKLRFLLELGLIGHTLLLCYIENRLFNYASMYYYGFEEDIIYPNYMVFITTFLGLALVRRLHVDQRLGPKAAWILTCLYSSKLAMLFMTSRSVIWVSAVLLLAVTPPLLLYRDKSKGASKMKVWQAYFHASVIAFSAWLCRETIFEALQWWNGRPPSDGLLLGSYILLTGVACIPIVVLHFPHVQSAKRFLVLVVATGLLFVVMQPPIKLSWVYRSDFITAAHLSDDDISIYGFVASKPTWPSWLLIATVVLTLAAVTSIIPVKYVVELRALYAVAVGITLGIYISVQYFFQAVVLYPLLVATIVSAAVFVVFTHLPSESSTRVLPWVFSFLVALFPVTYLLEGHLRSKSFADEDEAEKFTNMLAIEGARMSLLGLYAAIFMIIALEIKFELALLLREKAADRGMHGPSSRSSAFPPKARLLQQRRAHAAPTFTIKRLAAEAAWMPAIGNVSTVLCFGICLVLNITLTGGSNRAIFFLAPILLLLNQDSDIFAGFGDRQRYFPVTVSISGYLLLTALYRIWEETWPGNGGWALDIGGPGWLFAVKNFALLVLALPNHILFNRFMWDYVRQTDAKLLLTLPLNLPSIIMTDILAIRVLGLLGAMYSLAQYMISRRIRIAGMRYI

SEQ ID NO: 21092 - DNA, 1206 bp, Sorghum bicolor
  misc_feature: Ceres ANNOT ID no. 8690866
  misc_feature: Up-regulated in shoot tissues in response to methyl jasmonate treatment
  misc_feature: Encodes the peptide sequence at SEQ ID NO 21093
atggccggcgcgactgtgaccgtggaggaggtgaggaaggcgcagcgcgcgacggggccggccaccgtgctggcgatcgggacggcgacgccggccaactgcgtgcaccaggcggattacccggactactacttccggatcacaaagagcgagcacatgaccgaactcaaggagaagttcaagaggatgtgcgacaagtcgcagatccggaagcggtacatgcacttgaccgaggagtacctggcggagaaccctaacatgtgcgcgtacatggcgccttcgctggacgcccgccaggacatcgtggtggtggaggtccccaagctaggcaaggccgcggcgcagaaggcgatcaaggaatgggggcagccgaaatccaagatcacccacctcgtcttctgcaccacctccggcgtcgacatgccgggcgccgactaccagctcaccaagatgctgggcctaaggccctcggtgaaccgcctgatgatgtaccagcaggggtgcttcgcgggcggcacggtgctgcgcgtggccaaggatctcgccgagaacaaccgcggggcgcgcgtcctggtggtgtgctctgagatcaccgccgtcacgttccgtggcccctccgagtcccacctcgactccatggtcggccaggcgctgttcggcgatggcgcggcggcggttattgtcggtgctgaccctgacgaacgcgtggaacgcccactgttccagctcgtgtcggcatcacagaccatcctcccagactctgagggcgccattgatggccacctccgtgaggtcgggctcacgttccacctgctcaaggatgtccctgggctcatctccaagaacatcgagcgctcgctggaggaggcgttcaagccgctagggatcaccgactacaactccatcttctgggtggcgcaccccggtgggccagcgatcctggaccaggtggaggccaaggtcgggctaaagaaggagaggatgcgcgcgacgcgacatgtcctgtccgagtacggcaacatgtctagcgcctgcgtgctcttcatcctcgacgagatgcgcaagcgctccgccgaggatggccaggccaccaccggcgaaggttttgactggggtgtcctctttggctttggccccgggctcaccgtcgagactgtcgtgctccacagcgtccccatcaccaccggagcgaccattaccgcctga

SEQ ID NO: 21093 - protein, 401 aa, Sorghum bicolor
  misc_feature: Ceres ANNOT ID no. 8690866
  misc_feature: Up-regulated in shoot tissues in response to methyl jasmonate treatment
  misc_feature (1)..(401): SWISSPROT Homolog: EC 2.3.1.74 Naringenin-chalcone synthase
  misc_feature (6)..(232): Pfam ID: Chal_sti_synt_N Pfam Description: Chalcone and stilbene synthases, N-terminal domain
  misc_feature (242)..(392): Pfam ID: Chal_sti_synt_C Pfam Description: Chalcone and stilbene synthases, C-terminal domain
MAGATVTVEEVRKAQRATGPATVLAIGTATPANCVHQADYPDYYFRITKSEHMTELKEKFKRMCDKSQIRKRYMHLTEEYLAENPNMCAYMAPSLDARQDIVVVEVPKLGKAAAQKAIKEWGQPKSKITHLVFCTTSGVDMPGADYQLTKMLGLRPSVNRLMMYQQGCFAGGTVLRVAKDLAENNRGARVLVVCSEITAVTFRGPSESHLDSMVGQALFGDGAAAVIVGADPDERVERPLFQLVSASQTILPDSEGAIDGHLREVGLTFHLLKDVPGLISKNIERSLEEAFKPLGITDYNSIFWVAHPGGPAILDQVEAKVGLKKERMRATRHVLSEYGNMSSACVLFILDEMRKRSAEDGQATTGEGFDWGVLFGFGPGLTVETVVLHSVPITTGATITA

SEQ ID NO: 21094 - DNA, 1206 bp, Sorghum bicolor
  misc_feature: Ceres ANNOT ID no. 8690831
  misc_feature: Up-regulated in shoot tissues in response to methyl jasmonate treatment
  misc_feature: Up-regulated in root tissues in response to salicylic acid treatment
  misc_feature: Encodes the peptide sequence at SEQ ID NO 21095
atggccgccgcgactgtgaccgtcgaggaggtgaggaaggcgcagcgcgcgacgggcccggccaccgtgctggcgatcgggacggcgacgccggccaactgcgtgcaccaggccgactacccggactactacttccggatcacaaagagcgagcacatgaccgaactcaaggagaagttcaagaggatgtgcgacaagtcgcagatccggaagcggtacatgcacctgacggaggagtacctggcggagaaccccaacatgtgcgcgtacatggcgccgtcgctggacgcccgccaggacatcgtggtggtggaggtgcccaagctaggcaaggccgcggcgcagaaggcgatcaaggagtgggggcagccgaaatccaagatcactcacctcgtcttctgcaccacctccggcgtcgacatgccgggcgccgactaccagctcaccaagatgctgggcctgcggccctcggtcaaccgcctgatgatgtaccagcaggggtgcttcgcgggcggcacggtgctgcgcgtggccaaggacctcgccgagaacaaccgtggggcgcgcgtcctggtggtgtgctccgagatcaccgccgtcacgttccgtggaccctccgagtcccacctcgactccatggttggccaagcgctgttcggcgacggtgctgcggcggttattgtgggagctgaccctgacgagcgcgtggagcgcccgctgttccagctcgtgtcggcgtcgcagacaatcctgccggactccgagggcgccatcgacggccacctccgtgaggtcgggctcacgttccacctgctcaaggacgtgcccgggctcatctccaaaaacatagagcgctcgctggaggaggcgttcaagccgctggggatcaccgactacaactccatcttctgggtggcgcaccctggcgggccagcaatcctggaccaggtggaggccaaggtcgggctagagaaggagcggatgcgtgccacgcgccatgtcctgtccgagtacggcaacatgtctagtgcgtgcgtgctcttcatcctcgacgagatgcgcaaacgctccgccgaggacggccaggcaaccaccggcgaaggcttcgactggggcgtgctcttcggcttcggtcctgggctcaccgtcgagaccgtcgtgctccacagcgtccccatcaccaccggagcggccatcaccgcgtga

SEQ ID NO: 21095 - protein, 401 aa, Sorghum bicolor
  misc_feature: Ceres ANNOT ID no. 8690831
  misc_feature: Up-regulated in shoot tissues in response to methyl jasmonate treatment
  misc_feature: Up-regulated in root tissues in response to salicylic acid treatment
  misc_feature (1)..(401): SWISSPROT Homolog: EC 2.3.1.74 Naringenin-chalcone synthase
  misc_feature (6)..(232): Pfam ID: Chal_sti_synt_N Pfam Description: Chalcone and stilbene synthases, N-terminal domain
  misc_feature (242)..(392): Pfam ID: Chal_sti_synt_C Pfam Description: Chalcone and stilbene synthases, C-terminal domain
MAAATVTVEEVRKAQRATGPATVLAIGTATPANCVHQADYPDYYFRITKSEHMTELKEKFKRMCDKSQIRKRYMHLTEEYLAENPNMCAYMAPSLDARQDIVVVEVPKLGKAAAQKAIKEWGQPKSKITHLVFCTTSGVDMPGADYQLTKMLGLRPSVNRLMMYQQGCFAGGTVLRVAKDLAENNRGARVLVVCSEITAVTFRGPSESHLDSMVGQALFGDGAAAVIVGADPDERVERPLFQLVSASQTILPDSEGAIDGHLREVGLTFHLLKDVPGLISKNIERSLEEAFKPLGITDYNSIFWVAHPGGPAILDQVEAKVGLEKERMRATRHVLSEYGNMSSACVLFILDEMRKRSAEDGQATTGEGFDWGVLFGFGPGLTVETVVLHSVPITTGAAITA

SEQ ID NO: 21096 - DNA, 1206 bp, Sorghum bicolor
  misc_feature: Ceres ANNOT ID no. 8690851
  misc_feature: Up-regulated in shoot tissues in response to methyl jasmonate treatment
  misc_feature: Up-regulated in root tissues in response to salicylic acid treatment
  misc_feature: Encodes the peptide sequence at SEQ ID NO 21097
atggccgccgcgactgtgaccgtggaggaggtgaggaaggcgcagcgcgcgacgggcccggccaccgtgctggcgatcgggacggcgacgccggccaactgcgtgcaccaggccgactacccggactactacttccggatcacaaagagcgagcacatgaccgacctcaaggagaagttcaagaggatgtgcgacaagtcgcagatccgaaagcggtacatgcacctgacggaggagtacctggcggagaaccctaacatgtgtgcgtacatggcgccgtcgctggacgcccgccaggacatcgtggtggtggaggtccccaagctgggcaaggccgcggcgcagaaggcgatcaaggagtgggggcagccgaaatccaagatcacccatctcgtcttctgcaccacctccggcgtcgacatgcccggcgccgactaccagctcaccaagatgctcggcctgcggccctcggtgaaccgtctgatgatgtaccagcaggggtgcttcgcgggcggcacggtgctgcgcgtggccaaggacctcgccgagaacaaccgcggggcgcgcgtcctggtggtgtgctccgagatcaccgcggtcacgttccggggaccctccgagtcccaccttgactccatggttggccaagcgctgttcggcgacggcgctgcggcggttattgtgggagctgaccctgacgagcgcgtggagcgcccgctgttccagctcgtgtcggcgtcgcagacaatcctgccggactccgagggcgccatcgacggccacctccgcgaggtcgggctcacgttccacctgctcaaggacgtgcccgggctcatctccaagaacatagagcgctcgctggaggaggcgttcaagccgctggggatcaccgactacaactccatcttctgggtggcgcaccctggcgggccagcgattctggaccaggtggaggccaaggtcgggctggagaaggagcggctgcgtgccacgcgccatgtcctatctgagtacggcaacatgtccagcgcgtgcgtgctcttcatcctcgacgagatgcgcaagcgctccgccgaagacggccaggccaccaccggtgaaggcttcgactggggcgtgctcttcggcttcggccccgggctcaccgtcgagaccgtcgtgctccacagcgttcccatcaccaccggagcggccatcaccgcctga

SEQ ID NO: 21097 - protein, 401 aa, Sorghum bicolor
  misc_feature: Ceres ANNOT ID no. 8690851
  misc_feature: Up-regulated in shoot tissues in response to methyl jasmonate treatment
  misc_feature: Up-regulated in root tissues in response to salicylic acid treatment
  misc_feature (1)..(401): SWISSPROT Homolog: EC 2.3.1.74 Naringenin-chalcone synthase
  misc_feature (6)..(232): Pfam ID: Chal_sti_synt_N Pfam Description: Chalcone and stilbene synthases, N-terminal domain
  misc_feature (242)..(392): Pfam ID: Chal_sti_synt_C Pfam Description: Chalcone and stilbene synthases, C-terminal domain
MAAATVTVEEVRKAQRATGPATVLAIGTATPANCVHQADYPDYYFRITKSEHMTDLKEKFKRMCDKSQIRKRYMHLTEEYLAENPNMCAYMAPSLDARQDIVVVEVPKLGKAAAQKAIKEWGQPKSKITHLVFCTTSGVDMPGADYQLTKMLGLRPSVNRLMMYQQGCFAGGTVLRVAKDLAENNRGARVLVVCSEITAVTFRGPSESHLDSMVGQALFGDGAAAVIVGADPDERVERPLFQLVSASQTILPDSEGAIDGHLREVGLTFHLLKDVPGLISKNIERSLEEAFKPLGITDYNSIFWVAHPGGPAILDQVEAKVGLEKERLRATRHVLSEYGNMSSACVLFILDEMRKRSAEDGQATTGEGFDWGVLFGFGPGLTVETVVLHSVPITTGAAITA

SEQ ID NO: 21098 - DNA, 1206 bp, Sorghum bicolor
  misc_feature: Ceres ANNOT ID no. 8690833
  misc_feature: Up-regulated in shoot tissues in response to methyl jasmonate treatment
  misc_feature: Encodes the peptide sequence at SEQ ID NO 21099
atggccgccgcgactgtgaccgtcgaggaggtgaggaaggcgcagcgcgcgacgggcccggccaccgtgctggcgatcgggacggcgacgccggccaactgcgtgcaccaggcggactacccggactactacttccggatcacaaagagcgagcacatgaccgaactcaaggagaagttcaagaggatgtgcgacaagtcgcagatccggaagcggtacatgcacctgacggaggagtatctggcggagaaccccaacatgtgcgcgtacatggcgccgtcgctggacgcccgccaggacatcgtggtggtggaggtgcccaagctaggcaaggccgcggcgcagaaggcaatcaaggagtgggggcagccgaaatccaagatcacccacctcgtcttctgcaccacctccggcgtcgacatgccgggcgctgactaccagctcaccaagatgcttggcctccggccctccgtcaaacgcctgatgatgtaccagcaggggtgcttcgcgggcggcacggtgctgcgcgtggccaaggacctcgccgagaacaaccgcggagcgcgtgtcctggtggtgtgctccgagatcactgccgtcacattccggggaccctccgagtcccacctcgactccatggtcgggcaggcgctgttcggtgatggcgcggcggcggttattgtcggtgctgaccccgacgagcgtgtggaacgcccgctgttccagctcgtgtcggcatcacagaccatcctcccagactctgagggcgccatcgatggccacctccgtgaggtcgggctcacgttccacctgctcaaggacgtgcccgggctcatctccaagaacatcgagcgctcgttggaggaggcgttcaagccactagggatcaccgactacaactccatcttctgggtggcgcaccccggtgggccagcaatcctggaccaggtggaggccaaggtcgggctaaagaaggagcggatgcgcgcgacgcgacatgtcctgtccgaatacggcaacatgtctagcgcctgcgtgctcttcatcctcgacgagatgcgcaagcgctctgccgaggatggccaggccaccaccggtgaaggcttggactggggtgtcctcttcggcttcggccccgggctcaccgttgagaccgtcgtgctccatagcgtccccattaccaccggcgcagccatcaccgcctga

SEQ ID NO: 21099 - protein, 401 aa, Sorghum bicolor
  misc_feature: Ceres ANNOT ID no. 8690833
  misc_feature: Up-regulated in shoot tissues in response to methyl jasmonate treatment
  misc_feature (1)..(401): SWISSPROT Homolog: EC 2.3.1.74 Naringenin-chalcone synthase
  misc_feature (6)..(232): Pfam ID: Chal_sti_synt_N Pfam Description: Chalcone and stilbene synthases, N-terminal domain
  misc_feature (242)..(392): Pfam ID: Chal_sti_synt_C Pfam Description: Chalcone and stilbene synthases, C-terminal domain
MAAATVTVEEVRKAQRATGPATVLAIGTATPANCVHQADYPDYYFRITKSEHMTELKEKFKRMCDKSQIRKRYMHLTEEYLAENPNMCAYMAPSLDARQDIVVVEVPKLGKAAAQKAIKEWGQPKSKITHLVFCTTSGVDMPGADYQLTKMLGLRPSVKRLMMYQQGCFAGGTVLRVAKDLAENNRGARVLVVCSEITAVTFRGPSESHLDSMVGQALFGDGAAAVIVGADPDERVERPLFQLVSASQTILPDSEGAIDGHLREVGLTFHLLKDVPGLISKNIERSLEEAFKPLGITDYNSIFWVAHPGGPAILDQVEAKVGLKKERMRATRHVLSEYGNMSSACVLFILDEMRKRSAEDGQATTGEGLDWGVLFGFGPGLTVETVVLHSVPITTGAAITA

SEQ ID NO: 21100 - DNA, 2916 bp, Sorghum bicolor
  misc_feature: Ceres ANNOT ID no. 8690935
  misc_feature: Up-regulated in root tissues in response to methyl jasmonate treatment
  misc_feature: Up-regulated in shoot tissues in response to methyl jasmonate treatment
  misc_feature: Up-regulated in root tissues in response to salicylic acid treatment
  misc_feature: Up-regulated in shoot tissues in response to salicylic acid treatment
  misc_feature: Encodes the peptide sequence at SEQ ID NO 21101
atggcgccgccgcgccggacctctctccggtggccggccggccggggtttcctccagctgacgacggaaaaagaagagcggccggccggccgatcgaaaatcgccatgcataacccgaggccgggcggcggtgacatcgtcgagatgtcgtcgtcgtcgtccgccgccgcgccgcacgaggcgggagccagggacagggagcgcgtgatcccacacagcggcccgctgagcaagaagaccggggcgaggaagagcgcgcggttcgccgagtccgtgtccgcgcctctcaccgcgccgccgccgccgcgcgcgtcgtccgccaacaacaacgacgacgacgacgactacgtggagatcaccctcgacgtgcgcgacgactcggtggcggtgcacagcgtcaagcccgcccacggcggcggcggcggcggagacgactcggacgtgacgctgctggcgcgcacgctggagaaccggcgggcgtccggccactcggtgatccggaacgcctcgtcgcggatcaagcaggtgtcgcaggagctccgccgcatcgcctccatcaaccgccgcggcggcggcggcggggcgaggctggaccggtccaagtccgcggccgcgcacgcgctcaaggggctcaagttcatcagcaaggccgagggcgccgccggatgggaggccgtcgagaagcgcttcgacaagctcgccgagaacgggctcctccaccgctccaagttcggccagtgcatcgggatgaaggagccggagttcgccggcgagctgttcgacgcgctgtctcggcgccgcaacatctccggcgacagcatcagcaaggccgagctgctcgagttctgggaccaaatctccgacaccagcttcgacggccgcctgcagaccttcttcgacatggtcgacaaggacgcggacggcaggatcaccgaggaggaggtcaaagagatcatcacgctgagcgcgtcagcgaacaagctgtcgaagatcacagatcaagcggaggagtacgctcgtctaatcatggaggagctagaccctgccaacctgggctacatcgagctctacaacctggagatgctgctcctccaagctccgtcccaatccgtgcggatcggcaccaccaacagccggaacctgagccagatgctgtcgcagagcctccgcccgacgccggagccgaacccgctccggcgctggtaccgccgcgtgcactacttcctggaggacaactggcggcgcgtgtgggtgctcctcctgtggctctccatctgcgccgcgctcttcgcctggaagttcacccagtaccgccgccgctacgtcttccacgtgatgggctactgcgtctgcgtcgcgaagggcggcgccgagacgctcaagttcaacatggcgctcatcctcctgcccgtctgccggaacaccatcacctggctccgcaaccggaccaccgccgtggcgcgcgtcgtccccttcgacgacagcctcaacttccacaaggtggtcgccgtcgggatcaccgtgggcgccgcgctccacatcgtctcccacctgacgtgcgacttcccgcggctcctccacgccaccgacgaggcgtacgcgccgctggggcagtacttcgggacgcggcggccgccggactactggtggttcgtgaagggcacggaggggtggacggggctggtgatgctggtgctcatggcggtggcgttcacgctggcgacgccgtggttcaggagagggagggtggcgctgccgggccccgtgctcaggcggctcaccgggttcaacgcgttctggtactcgcaccactgcttcgtggcggtgtacgcgctgctcgtcgtgcacgggcagtacctgtacctgacgcacaagtggtacaagaagtcgacgtggatgtacctggccgtgcccgtggcgctgtacgcgtgcgagaggctgacgagggcgctcaggtccagtgtccgccccgtgaagatactcaaggtggcggtttaccctgggaacgtcctgtcgctgcatttctccaagccgcaggggtttcggtacaggagtggacagtacatcttcgtcaactgcgccgccgtctcgccgttccagtggcacccgttctccatcacgtcggcaccacaggacgactacgtgagcgtgcacatcaggacgctgggtgactggacacgcgagctcaagaacgtcttctcgagggtgtgccggccgccgacggagggcaagagcgggctgctccgcgccgagtacgaccgcgacggcagcgccatggccaaccccagcttccccaaggtgctgatcgacggcccctacggcgcgccggcgcaggactacaagcagtacgacatcgtgcttctcgtcgggctgggcatcggcgccacgcccatgatctccatcatcaaggacatcatcaacaacatgaagcagccggacggcgacctggaagccggcgccggcgccgacacgtcggcgtcctccatggcgtcgtcgttccgcacgcggcgcgcctacttctactgggtgacccgggagcagggctccttcgagtggttccgcggcgtcatggacgaggtggccgagacggacaagaagggcgtcatcgagctccacaactactgcaccagcgtgtacgaggaaggcgacgcccggtcggcgctcatcgccatgctccagtcgctcaaccacgccaagcacggcgtcgacgtcgtgtccgggacacgcgtcaagacgcacttcgccaggcccaactggcgcaacgtctacaagcgcatcgccctcaaccaccagaaccagcgcgtcggagtgttctattgtggtgctccggtgctgacaaaggagctgcgcgagctcgcgcaggatttctcgcggaaaaccaacaccaagttcgagttccacaaggagaacttctaa

SEQ ID NO: 21101 - protein, 971 aa, Sorghum bicolor
  misc_feature: Ceres ANNOT ID no. 8690935
  misc_feature: Up-regulated in root tissues in response to methyl jasmonate treatment
  misc_feature: Up-regulated in shoot tissues in response to methyl jasmonate treatment
  misc_feature: Up-regulated in root tissues in response to salicylic acid treatment
  misc_feature: Up-regulated in shoot tissues in response to salicylic acid treatment
  misc_feature (592)..(745): SWISSPROT Homolog: EC 1.6.3.1 NAD(P)H oxidase
  misc_feature (783)..(954): Pfam ID: NAD_binding_6 Pfam Description: Ferric reductase NAD binding domain
  misc_feature (196)..(293): Pfam ID: NADPH_Ox Pfam Description: Respiratory burst NADPH oxidase
  misc_feature (655)..(777): Pfam ID: FAD_binding_8 Pfam Description: FAD-binding domain
  misc_feature (454)..(614): Pfam ID: Ferric_reduct Pfam Description: Ferric reductase like transmembrane component
  misc_feature (294)..(322): Pfam ID: efhand Pfam Description: EF hand
MAPPRRTSLRWPAGRGFLQLTTEKEERPAGRSKIAMHNPRPGGGDIVEMSSSSSAAAPHEAGARDRERVIPHSGPLSKKTGARKSARFAESVSAPLTAPPPPRASSANNNDDDDDYVEITLDVRDDSVAVHSVKPAHGGGGGGDDSDVTLLARTLENRRASGHSVIRNASSRIKQVSQELRRIASINRRGGGGGARLDRSKSAAAHALKGLKFISKAEGAAGWEAVEKRFDKLAENGLLHRSKFGQCIGMKEPEFAGELFDALSRRRNISGDSISKAELLEFWDQISDTSFDGRLQTFFDMVDKDADGRITEEEVKEIITLSASANKLSKITDQAEEYARLIMEELDPANLGYIELYNLEMLLLQAPSQSVRIGTTNSRNLSQMLSQSLRPTPEPNPLRRWYRRVHYFLEDNWRRVWVLLLWLSICAALFAWKFTQYRRRYVFHVMGYCVCVAKGGAETLKFNMALILLPVCRNTITWLRNRTTAVARVVPFDDSLNFHKVVAVGITVGAALHIVSHLTCDFPRLLHATDEAYAPLGQYFGTRRPPDYWWFVKGTEGWTGLVMLVLMAVAFTLATPWFRRGRVALPGPVLRRLTGFNAFWYSHHCFVAVYALLVVHGQYLYLTHKWYKKSTWMYLAVPVALYACERLTRALRSSVRPVKILKVAVYPGNVLSLHFSKPQGFRYRSGQYIFVNCAAVSPFQWHPFSITSAPQDDYVSVHIRTLGDWTRELKNVFSRVCRPPTEGKSGLLRAEYDRDGSAMANPSFPKVLIDGPYGAPAQDYKQYDIVLLVGLGIGATPMISIIKDIINNMKQPDGDLEAGAGADTSASSMASSFRTRRAYFYWVTREQGSFEWFRGVMDEVAETDKKGVIELHNYCTSVYEEGDARSALIAMLQSLNHAKHGVDVVSGTRVKTHFARPNWRNVYKRIALNHQNQRVGVFYCGAPVLTKELRELAQDFSRKTNTKFEFHKENF

SEQ ID NO: 21102 - DNA, 2130 bp, Sorghum bicolor
  misc_feature: Ceres ANNOT ID no. 8691829
  misc_feature: Up-regulated in shoot tissues in response to methyl jasmonate treatment
  misc_feature: Up-regulated in root tissues in response to methyl jasmonate treatment
  misc_feature: Encodes the peptide sequence at SEQ ID NO 21103
atggcctcgagatcacaaacaatctcatcacctgcactactacttgggttcctcgtgctactgctgcccctgcagttcactgatgcatcatcaggccaaacgacgatctacgttgtgtacatgggtaggaagatgcacgatgacccatccgtggtcatggcatctcaccacgccgcgctgacctccattcttgggagcaaggatgaagccctcaactccatagtctacagctacaagcacggattctccggtttcgcggcgaagctcaccgaggcgcaggcagaggcacttcggaagtaccctggtgttgtgagagtgaggcctaacacttaccatgaactgcacacgactcggagctgggattttcttggcatgagctacggccaacaggcatcgtcgtcgtcgtcgtcgtcgtcacggctccttaggaaggccaattacggcgaagatgtcatcgtcggcatcatagactcaggcatctggccggaatcacggagcttcgatgacagcgggtacggccccgtgccgaaacggtggaaaggcgtgtgccagaccggccaggcgttcaacgcgagcagctgcaaccggaaggtcatcggcgcgcggtggtacgccggggacggcgtcgacgagtacaagtcgccgagggacgcgcacggccacggcacgcacaccgcgtcgacggtcgccggctccccggtgcggggcgcgagccacggcgccggcagcggcctggccgccggcacggcgcgcggcggggcgccgcgcgcgcggctcgcgatctacaaggcgtgccaccgcgtcggcatccagacggcctgcggcgacgcgtctgtgatcgcggccgtcgacgacgccatcggggacggcgtcgacgtgctgtccctttcgctgggaggcggcgacgagatccgcgagacgctgcacgccgtgagggccgggatcaccgtggtgttctccgcggggaacgaaggccccgtgcagcagtccgtcgtcaacaccctgccgtggctcatcacggtggccgccgccaccgtggatcgcaccttcccgacagtcgtcacactcagcgaaggagagaagctggtgggtcaatcattgtattaccacaaacgctcagcagcatccaagagcaacgacagctttagttcgctccatttcacggtcggctgcgagaaggagcagctggagtccgaaaacatcaccggaaaaatcgtggtatgcattgaaccgtcggcggggttagccagcgctgcgctaggcggcatcgccggcggagccaagggcatcatcttcgagcagcacaacaccgacgccctcgacacccagataatgttctgcgaaggccacataccctgcattgtggtggacaaggataccagattcaggatcttagaaagcagaagcaagatggcgaagatttctccggcggcgaccatggtcgggccggagcccgacatagctgcacctggagtgagcatattggcagccaagcgtgactcgtacgagctcatgtccggtacatccatggcatgccctcatgtctccgcgatcgtcgccttgctcaagtcggttcacccggactggtcgcctgccatgatcaaatctgccattgttaccacagcatcggtgacggatcgattcggcctgccaatccaagccaactcagtgcaaaggaaaccggctgaccccttcgacttcggcggtggccacatacagccagacagggccatggatcctggcctggtatacgacctgaaaccggacgactacaccaacgacgacatcgccattgaacagctcaacctcccctccatcgccgtgcctgacctcaagaattccaccacgttcacccgcacggtgaccaacgtcgggccggcgaaggcgacgtaccgggcggtggtggaggcgccggcgggggtgaagatgagcgtggagcctccggtgatcgccttccagaaaggtggccctaggaacgcgacgtttaaggtgacgttcatggcgaagcagagagtgcagggtggctatgcgtttgggagcctgacatggctggatgacggcaagcactcggtgaggatccctgtagccgttcggaccgtcgtccgggacttcgtcgctgatgtatcttga

SEQ ID NO: 21103 - protein, 709 aa, Sorghum bicolor
  misc_feature: Ceres ANNOT ID no. 8691829
  misc_feature: Up-regulated in shoot tissues in response to methyl jasmonate treatment
  misc_feature: Up-regulated in root tissues in response to methyl jasmonate treatment
  misc_feature (28)..(234): SWISSPROT Homolog: EC 3.4.21.25 Cucumisin
  misc_feature (481)..(548): SWISSPROT Homolog: EC 3.4.21.62 Subtilisin
  misc_feature (35)..(115): Pfam ID: Subtilisin_N Pfam Description: Subtilisin N-terminal Region
  misc_feature (135)..(557): Pfam ID: Peptidase_S8 Pfam Description: Subtilase family
MASRSQTISSPALLLGFLVLLLPLQFTDASSGQTTIYVVYMGRKMHDDPSVVMASHHAALTSILGSKDEALNSIVYSYKHGFSGFAAKLTEAQAEALRKYPGVVRVRPNTYHELHTTRSWDFLGMSYGQQASSSSSSSSRLLRKANYGEDVIVGIIDSGIWPESRSFDDSGYGPVPKRWKGVCQTGQAFNASSCNRKVIGARWYAGDGVDEYKSPRDAHGHGTHTASTVAGSPVRGASHGAGSGLAAGTARGGAPRARLAIYKACHRVGIQTACGDASVIAAVDDAIGDGVDVLSLSLGGGDEIRETLHAVRAGITVVFSAGNEGPVQQSVVNTLPWLITVAAATVDRTFPTVVTLSEGEKLVGQSLYYHKRSAASKSNDSFSSLHFTVGCEKEQLESENITGKIVVCIEPSAGLASAALGGIAGGAKGIIFEQHNTDALDTQIMFCEGHIPCIVVDKDTRFRILESRSKMAKISPAATMVGPEPDIAAPGVSILAAKRDSYELMSGTSMACPHVSAIVALLKSVHPDWSPAMIKSAIVTTASVTDRFGLPIQANSVQRKPADPFDFGGGHIQPDRAMDPGLVYDLKPDDYTNDDIAIEQLNLPSIAVPDLKNSTTFTRTVTNVGPAKATYRAVVEAPAGVKMSVEPPVIAFQKGGPRNATFKVTFMAKQRVQGGYAFGSLTWLDDGKHSVRIPVAVRTVVRDFVADVS

SEQ ID NO: 21104 - DNA, 1299 bp, Sorghum bicolor
  misc_feature: Ceres ANNOT ID no. 8691878
  misc_feature: Up-regulated in root tissues in response to methyl jasmonate treatment
  misc_feature: Up-regulated in shoot tissues in response to methyl jasmonate treatment
  misc_feature: Encodes the peptide sequence at SEQ ID NO 21105
atgagaagcaagcaaggtcaacattatgctgaaagaataagcacaaccagaaggcatgaccacgccgtcctcgctggtgaagaaatggcggctcctgcaccagctgcatctgcatcatcggacgaagcaacagcagctcactcgaggaggaagcagcagaggaacccggcgagcctgtacaccaataatgtacctgcagctgagactgagataatcgagtcgctccccctggagacgcggctcatggtgcgccgccggcagtacggaggcttctggcaagctgagttcatactcaagggcttggctgccgctggcgcatcgtcatggttccagccggagacatcagacatcttccttgccagcctacccaagtccggcaccacctggctcaaggcccttgccttcgcgacgctcaaccgtgccacccactcgccgtccgacggccaacacccgctcaaccaccggaacccgcacgactgtgtcggcttcctggagttcatgatcatccagcagcagcagcagcagcagcagcagcaggaggacgacgacgacgacgacgacgccgacggcagagctgtaaggggtttgtatgaggcgctcccttcttctccacggctgtttgcaacgcaccttccctactcccagcttccccatgccatcacggcggagggttcccggtgccggatcgtgtacgtgtgccgggatcccaaggacgtgctcgtttcctactggtacttctacaagaaggtggcagcgacggtacccgccaccgccaccgccggcgacggcgatggccaggccgacctgcaggacgacgacactgcaggcgtgaccgaattcgaggaggcttttgagctcttctgtgaggggcggttccccggagggccacactggctccacgccctagaatactggcacgcgagccagaagaggcccaaccatgtgctgttcctcaggtacgaagacatgctgggagatccggtgggcagcctcaagaagctggcagcgttcatggggtgcggcttctctgaggaggacgaggaggatggggtggtggatcagatcgtggagctgtgcagcttggagaatctcaagagcaaggacgtcaacaagaacgggagtactacgcggctgggcatcaagagtgagacattcttcaggaaggggcaggtcggcgactggaaaaactacatgactgtggacatggcggcgaggctggataagattgttgaggaggccactcgaggttctgggctcacctttgggggggagtcctcactactcctccataaaggttaa

SEQ ID NO: 21105 - protein, 432 aa, Sorghum bicolor
  misc_feature: Ceres ANNOT ID no. 8691878
  misc_feature: Up-regulated in root tissues in response to methyl jasmonate treatment
  misc_feature: Up-regulated in shoot tissues in response to methyl jasmonate treatment
  misc_feature (281)..(421): SWISSPROT Homolog: EC 2.8.2.3 Amine sulfotransferase
  misc_feature (114)..(418): Pfam ID: Sulfotransfer_1 Pfam Description: Sulfotransferase domain
MRSKQGQHYAERISTTRRHDHAVLAGEEMAAPAPAASASSDEATAAHSRRKQQRNPASLYTNNVPAAETEIIESLPLETRLMVRRRQYGGFWQAEFILKGLAAAGASSWFQPETSDIFLASLPKSGTTWLKALAFATLNRATHSPSDGQHPLNHRNPHDCVGFLEFMIIQQQQQQQQQQEDDDDDDDADGRAVRGLYEALPSSPRLFATHLPYSQLPHAITAEGSRCRIVYVCRDPKDVLVSYWYFYKKVAATVPATATAGDGDGQADLQDDDTAGVTEFEEAFELFCEGRFPGGPHWLHALEYWHASQKRPNHVLFLRYEDMLGDPVGSLKKLAAFMGCGFSEEDEEDGVVDQIVELCSLENLKSKDVNKNGSTTRLGIKSETFFRKGQVGDWKNYMTVDMAARLDKIVEEATRGSGLTFGGESSLLLHKG

SEQ ID NO: 21106 - DNA, 1374 bp, Sorghum bicolor
  misc_feature: Ceres ANNOT ID no. 8691962
  misc_feature: Up-regulated in shoot tissues in response to methyl jasmonate treatment
  misc_feature: Up-regulated in root tissues in response to methyl jasmonate treatment
  misc_feature: Up-regulated in root tissues in response to salicylic acid treatment
  misc_feature: Up-regulated in shoot tissues in response to salicylic acid treatment
  misc_feature: Encodes the peptide sequence at SEQ ID NO 21107
atgaaaccggcgacagcaaacggatccagattcggatccgactcggggcctatcgccggcgacacccgtgattggtcccgcttgccggaggacctgctggtcagcgtcctgcgggcgctgcacgtcgacgatgccgtccgctccggcgccgtctgcgcctcctggaactcggcgtacgccgcgttccgacggctccgcgtcccgtcgccgaagcagcccccctgcctgctctacgcgcccgacgccctcagccccggcgccgccgcgctccactgcccgtccaccggcgccacgctgcggatcccctccccgcgggccccgctcgcccgccggcccctgctgggctccggccacggctggctcgtcaccgccgacgaggcctccaacctgcaccttctcaaccccgtcaccggcgcccaggtcgcgctcccgcccatcaccgcgctccaccacgtcgagagcggcacggacgaggatggcgaccccgcgtacctcgtctacgagaacctgttggagtacaattacatcacgcaccggggcgaggtgaacaccaagccgaccatcctggagatggacgacgcgtacgagtgcatgtacttccgcgtcgtgctgtcggccggcccatccgccgggcgcggctgcgtcgtgctgctgctgcacatgccgctgggagaggtctccttcgccaggctcggcgacgaccggtggacttgggtcgcaccgggagacgacgacacgggtctcccgtggaggtacggctaccgggacgccatgtacagtgccgccgatggcttgttctacctgctcggtttagacgcctccatgtgcagcttggaccttaacgggccttcgccggtggcacgtaagatcctcgacagcgtgccgaaatctgccgatgcgagcaaatacctcgttcagacaccggccggtgacatcttgcaggtttggaggtccagggaagaagtcgactcggaaataccggcagagtatccaccggactacgtggtggacgaaagcatagggggtccggacccatgtttggagctcaacaccattgagatgcagctgtacaaggttgacctccatggacgcagggtggagctgatcaagagcctgccggagtatgcattgtttcttggctacaatggttctatgtgtctaccggtgaaggatttccctgggttaaagccgaattgtgcctacatgactgacgactccatggagtatattaatttctggaagcataaccggagagaaattggtatttggagtttggcagagcgaagcatgtcgaagcttgttgatgtctcacagactatttatccttggctgaattggccatctcctatctggattcaaccatcctttttctag

SEQ ID NO: 21107 - protein, 457 aa, Sorghum bicolor
  misc_feature: Ceres ANNOT ID no. 8691962
  misc_feature: Up-regulated in shoot tissues in response to methyl jasmonate treatment
  misc_feature: Up-regulated in root tissues in response to methyl jasmonate treatment
  misc_feature: Up-regulated in root tissues in response to salicylic acid treatment
  misc_feature: Up-regulated in shoot tissues in response to salicylic acid treatment
MKPATANGSRFGSDSGPIAGDTRDWSRLPEDLLVSVLRALHVDDAVRSGAVCASWNSAYAAFRRLRVPSPKQPPCLLYAPDALSPGAAALHCPSTGATLRIPSPRAPLARRPLLGSGHGWLVTADEASNLHLLNPVTGAQVALPPITALHHVESGTDEDGDPAYLVYENLLEYNYITHRGEVNTKPTILEMDDAYECMYFRVVLSAGPSAGRGCVVLLLHMPLGEVSFARLGDDRWTWVAPGDDDTGLPWRYGYRDAMYSAADGLFYLLGLDASMCSLDLNGPSPVARKILDSVPKSADASKYLVQTPAGDILQVWRSREEVDSEIPAEYPPDYVVDESIGGPDPCLELNTIEMQLYKVDLHGRRVELIKSLPEYALFLGYNGSMCLPVKDFPGLKPNCAYMTDDSMEYINFWKHNRREIGIWSLAERSMSKLVDVSQTIYPWLNWPSPIWIQPSFF

SEQ ID NO: 21108 - DNA, 1374 bp, Sorghum bicolor
  misc_feature: Ceres ANNOT ID no. 8691979
  misc_feature: Up-regulated in shoot tissues in response to methyl jasmonate treatment
  misc_feature: Up-regulated in root tissues in response to methyl jasmonate treatment
  misc_feature: Up-regulated in root tissues in response to salicylic acid treatment
  misc_feature: Up-regulated in shoot tissues in response to salicylic acid treatment
  misc_feature: Encodes the peptide sequence at SEQ ID NO 21109
atggaaccggcgacagccaacggatccagattcggatccgactcggggcttatcgccggcgacacccgtgattggtcccgcttgccggaggacctgctggtcagcgtcctgcgggcgctgcacgtcgccgatgccgtccgctccggcgccgtctgcacctcctggaacgcggcgtacgccgcgttccgacggttccgcctcccgtcgccgaagcagcccccctgcctgctctacgcgtccgacgccctcggccccggcgccgccgcgctccactgcccgtccaccggcgccacgctgcggatccccttcccgcgggccccgctcgcccgccggcccctgctgggctccggccacggctggctggtcaccgccgacgaggcctccaacctgcaccttgtcaaccccgtcaccggcgcccaggtcgcgctcccgcccatcaccgcgctccaccacgtcgagaggggcgcggacgagcagggcgaccccgcgtacctcgtctacgagaacctgattatgtacaactacagcaagcaccggttcgaggtgaacaccaagccgggtatcctggacatggacgacgcgtacgagtgcatgtacttccgcgtcgtgctctcggccggcccatccgccggccgcggctgcgtcgtgctgctgctgcacatgccgcagggagagatctccttcgccaggctcggcgacgaccggtggacttgggtcccacagggagacgacgacacgggtctcccgtggaggtacggctaccgtaacgccatttacagtgccgccgatggcttgttctacctgctcggtttagacgcctccatgtgcagcttggaccttaacgggccttcgccggtggtacgtaagatcctcgacagcgtgccgaaatctgccgacgcgagcaaatacctcgttcagacaccggccggtgacatcttgcaagtttggaggtccagggaagaagtcgactcggaaataccggcagagtatccaccggactacgtggtggacgaaagcatagggcctcaggacccatgtttggagctcaacaccattgagatgcagctgtacaaggttgacctccatggacacagggtggagctgatcaagagtctgccggagtatgcattgtttcttggctacaatggttctatgtgtctaccggtaaaggatttccctgggttaaagccgaattgtgcctacatgactgacgactccatggagtatattaatttctggaagcataaccgtagagaaattggtatttggagtttggcagagcgaagcatgtcgaagcttgttgatgcctcacagactatttatccttggctgaattggccatctcctatctggattcaaccatcctttttctag

SEQ ID NO: 21109 - protein, 457 aa, Sorghum bicolor
  misc_feature: Ceres ANNOT ID no. 8691979
  misc_feature: Up-regulated in shoot tissues in response to methyl jasmonate treatment
  misc_feature: Up-regulated in root tissues in response to methyl jasmonate treatment
  misc_feature: Up-regulated in root tissues in response to salicylic acid treatment
  misc_feature: Up-regulated in shoot tissues in response to salicylic acid treatment
MEPATANGSRFGSDSGLIAGDTRDWSRLPEDLLVSVLRALHVADAVRSGAVCTSWNAAYAAFRRFRLPSPKQPPCLLYASDALGPGAAALHCPSTGATLRIPFPRAPLARRPLLGSGHGWLVTADEASNLHLVNPVTGAQVALPPITALHHVERGADEQGDPAYLVYENLIMYNYSKHRFEVNTKPGILDMDDAYECMYFRVVLSAGPSAGRGCVVLLLHMPQGEISFARLGDDRWTWVPQGDDDTGLPWRYGYRNAIYSAADGLFYLLGLDASMCSLDLNGPSPVVRKILDSVPKSADASKYLVQTPAGDILQVWRSREEVDSEIPAEYPPDYVVDESIGPQDPCLELNTIEMQLYKVDLHGHRVELIKSLPEYALFLGYNGSMCLPVKDFPGLKPNCAYMTDDSMEYINFWKHNRREIGIWSLAERSMSKLVDASQTIYPWLNWPSPIWIQPSFF

SEQ ID NO: 21110 - DNA, 1350 bp, Sorghum bicolor
  misc_feature: Ceres ANNOT ID no. 8691973
  misc_feature: Up-regulated in shoot tissues in response to methyl jasmonate treatment
  misc_feature: Up-regulated in root tissues in response to methyl jasmonate treatment
  misc_feature: Up-regulated in root tissues in response to salicylic acid treatment
  misc_feature: Up-regulated in shoot tissues in response to salicylic acid treatment
  misc_feature: Encodes the peptide sequence at SEQ ID NO 21111
atggaaccggcgacagccaacggatccagattcggatccgactcggggcctatcgccggcgacacccgtgactggtccctcttgccggaggacctgctggtcagcatcctgcgggcgctgcacgtcgccgacgccgtccgctccggcgccgtctgcacctcctggaacgcggcgtacgccgcgttccgacggttccgcctcccgtcgccgaagcagcccccctgcctgctctacgcgtccgacgccctcggccccggcgccgccgcgctccactgcccgtccaccggcgccacgctgcggatccccttcccgcgggccccgctcgcccgccggcccctgctgggctccggccacggctggctggtcaccgccgacgaggcctccgacctgcaccttctcaaccccgtcaccggcgcccaggtcgcgctcccgcccatcaccgcgctccaccacgtcgagaggggcgcggacgagcagggcgaccccgcgtacctcgtctacgagaacctgtctgtgtacaactacagcgagcgccggttcgaggtgaacaccaagccgggtatcctggacatggacgacgcgtacgagtgcatgtacttccgcgtcgtgctctcggccggcccatccgccggccgcgcctgcgtcgtgctgctgctgcacatgccgcagggagaggtctccttcgccaggctcggcgacgaccggtggacttgggtcgcgcagggagacgacggctaccgtaacgccatttacagtgccgccgatggcttgttctacctgctcggtttagacgcctccatgtgcagcttggaccttaacgggccttcgccggtggtacgtaagatcctcgacagcgtgccgaaatctgtcgatgcgagcaaatacctcgtacagacaccggccggtgacatcttgcaagtttggaggtccagggaagaagtcgactcggaaataccggcagagtatccaccggactacgtggtggacgaaagcatagggcctcaggacccatgtttggagctcaacaccattgagatgcagctgtacaaggttgacctccatggacacagggtggagctgatcaagagcctgccggagtatgcattgtttcttggctacaatggttctatgtgtctaccggtgaaggatttccctgggttaaagccgaattgtgcctacgtgactgacgactccatggagtatattaatttctggaagcataaccggagagaaattggtatttggagtttggcagagcgaagcatgtcgaagcttgttgatggctcacagactatttatccttggctgaattggccatctcctatctggattcaaccatcctttttctag

SEQ ID NO: 21111 - protein, 449 aa, Sorghum bicolor
  misc_feature: Ceres ANNOT ID no. 8691973
  misc_feature: Up-regulated in shoot tissues in response to methyl jasmonate treatment
  misc_feature: Up-regulated in root tissues in response to methyl jasmonate treatment
  misc_feature: Up-regulated in root tissues in response to salicylic acid treatment
  misc_feature: Up-regulated in shoot tissues in response to salicylic acid treatment
MEPATANGSRFGSDSGPIAGDTRDWSLLPEDLLVSILRALHVADAVRSGAVCTSWNAAYAAFRRFRLPSPKQPPCLLYASDALGPGAAALHCPSTGATLRIPFPRAPLARRPLLGSGHGWLVTADEASDLHLLNPVTGAQVALPPITALHHVERGADEQGDPAYLVYENLSVYNYSERRFEVNTKPGILDMDDAYECMYFRVVLSAGPSAGRACVVLLLHMPQGEVSFARLGDDRWTWVAQGDDGYRNAIYSAADGLFYLLGLDASMCSLDLNGPSPVVRKILDSVPKSVDASKYLVQTPAGDILQVWRSREEVDSEIPAEYPPDYVVDESIGPQDPCLELNTIEMQLYKVDLHGHRVELIKSLPEYALFLGYNGSMCLPVKDFPGLKPNCAYVTDDSMEYINFWKHNRREIGIWSLAERSMSKLVDGSQTIYPWLNWPSPIWIQPSFF

SEQ ID NO: 21112 - DNA, 4188 bp, Sorghum bicolor
  misc_feature: Ceres ANNOT ID no. 8692248
  misc_feature: Up-regulated in shoot tissues in response to salicylic acid treatment
  misc_feature: Up-regulated in root tissues in response to salicylic acid treatment
  misc_feature: Encodes the peptide sequence at SEQ ID NO 21113
atggcggaccttgtgcttgggttggccaagtcggcggtggaggggacgttgacgatggccaagtcggcgatcgaggaggaggtgaagctgaagaagagtatgcagcgcgaccttttgcttatctcggacgagttcgagatgatgcactctttcctcaacgttgccaaggagcgtaccagtgacgaaatggtgaggaccttggtaaggcaggtccgcaacatggccttagatgtggaggactgcatcgaatccgttgtcctggtggatgctaagtcccactggtggcgccggtttctcacatcctgcatgctaccagtaccaccatatgcgccggctgccgccctggacgatgcagttgctgctgcagagttgctgaagtccagggtggaagccatgggccagaggaaccagcgctactggcacatccgcgaccactctggctcctccaagtccaagtccatcgagaagactaatcagcaggccgtggccaatgctgcggcagtgggcatccttaaagaggccaggaacgccaagaagaaggatagcggctcaacaaatctcgccgagttgatcaagaataaagacgatgtcccgccgcttcaagtaatctcggtgtggggagcagtaggtgatcttggggtggcatccatcatcaagaaggcccacgacaacccagaaatatgcagcaagttcactcaccgtgcttgggtgaagctgacccaatccttcaatccccatgagttcatgaggggcttgatggctcaattctccacaaactatcaacaaggaagcccagtagatttgccgaaacagatagatgcgatgatgggtatggaaggtacactactcaccgaggagttcgccaagcaagtgagcaacaacagatacctaatcttcctggaagatttgtccagcacagttgattgggaggctgtcaagatgtacctacctgacaagaagaatggtagctgcatcgttgtgcacacccaacagctcgaagttgctagcttgtgcgtcggacaatcacaccgggtaatggagctagagcggttttcagatgaccattctgtttgtgtctttttcaatgagaagcgcagccaaagatatctcatagacctcatcaacaagaaagacgacggccatgctccgcttcaagtgatctcagtgtgtggagaagacgatggccatcttgaggtggcatccatcatcaacaagacctgtggtgacgaggacaacgacccagaaatctgtaagaaattcaggtaccgtgcgtgggtaaagctgaggcatcccttcagcgagcaggagttcatcttcagattgctggctcaagtgtgcacaaactattgtttgcgccatggaagcgcccaagatttcatgaaactgaatggtctggacaaggttaccgaaggcgtacaaatcgagcagcttgtgaaacaagtgatgagcgatcagagatacctagtcttcctggatgatgtgcacttcaaggaagactgggacgccgtcagtaaatacctacctgacaagaaaaatggcagctgcattgtcgtgcacacccagcagcgcgatgttgcaagccattgcgttggagaatcagatggaatattggagatggagctcttctcaactgaccattctgtcagtgtccttttgaaagaggttgcacccgaagctgacatgcatatgatacgttgccagggtgaggacgaggagagggctatcaagatggaatatgcaaaggaatggataaataataatcgtaaacctgttggccgcggggcagatatagagaatcttagcgccaacaaagcaggggttcgacccgtgttcgggatagctggtgttggcaaatcttatatcgtcaaacacgtctactgcaagcatgtggttaaccaacgcagttacttccaaaagtttggttgggtggatgtgccccatccgttcaacatacgggacttctcatggagcctactcttggatttgcactcaggatccctccaacatggtaccatgttgagaatcagagaccccattcaagggtgtcgtgagcttctaaaaaggcatgcttgtctcattgttattgacggtttgcagtccagggaagagtgggactcgataaaagatgccttggcctttgaagctgatgctgacaagaatcgaagccgtatcattgtcattgcaaatgaagaaagtgtcgcctcatactgttcacctaattggtggaacgtcgaaggcctggaacaggatgatgcgtttaagctcttcgaacaaacggcatctaagcggggtaacgacagtttatggccctctgatccgagccctgccgagattgagcaagcaaaaattgtgctacataagtgcggtggactccccaaagtgatagttgctgtagctgactttttcgccgctggatggagattcaacccaattcatctaatgaaggtgttggagaccaacccagcgtttacttgtttaagggatatgtttgcctgggtgaattcctacttcgtatcctgcccagattcgctcaagccatgcatcttctatctatcaatattccccgtgaaccataagattcgtcggaggcgtctggtgcgtcggtggatcgccgagggctactctacggacaccaaggaaagcaccgccgacgagaaaggggagaggtcgtttaccgacctctgcaggctaaacatgatccaggtgcctggatcgacaagcctgtcctatttgacgaggatgccctcgtgccaggtcaatggcttcttccgcgagtacatcatgtctcggtcaatggaagagaaccttgtgtttgcgctggagggccattgcagtctcaactcgcaacgcaccggacggcatctcaccatagggagcacctgggaccgagatgtaagcgtgtatcagagcatcgacttctcacgtctgcggtcactgacagtcttcggcaagtgggagtcattcttcatctctgacaagatgaggatagtccgggtgctggacctggagaacgcatcatcggtgacggatgctgacctcgaacagattgtcaagctgctgcctcgcctcaagttcctctccctaagagaatgcaaagagatcactcgtctcccggattgttttgatcgcctgaggcagctacagactctggatattagacacaccatggttgtgtcgctaccactatgcatcaccaagctacagaagctccagcatattcgtgccggcactagcattactacagcacaattggatgatgatgtctccagcagcggcactgctcaaagactacctgcagcagcagaagcaggatcggcatcgtcgtcgtcgatggacaggcagccacgagctgctgctgctctggtgtcccggtcccggctccggctgccggggttgtgcgcacgccgccgccgcggccagcggctttgtggctctcgcaatggaggcgttgaggcgcccccaggtattggggaaatgatggccctacacaacatcagtgtcattgacgtcagtgttgcaagcggccgggcaatcattgatgagctcaagaaccttacccaactgcgcaagcttggagtctctggcgtcagacgagaaaactgtatcgagttttgttctgccatttcgggtcacccgcatttggaatccttgtcagtgtgggtggaccataatcaagctggctgcttggttgccatttcctcgccccctgaggaactacagagccttaagctgtacgggtgtatagacaagctgccagcctggatcaaactgctgccgaatctcagtaaactgaaactacagatcgacaggataatgcagcaggacgtggaccttctcatggatttaccaagtctaaacattctatgcctttgttccaaggagttccaatatggagagctccggttcgagggaccctgtcgccggctatgggtgctcgagattgattgcaactgcaggttaaagactgttaagtttcggggtacttggttttcaatgccacagcttgaggtcctcaagatccgctgccaaaataatgtgtcgtccttggagttttctgggctacagcagcttcgcaagctcagggaggtctcgctcaccggatcctacgatgacaaagtgaagcaacagttgaagagccaacttggtgagaaccagagggacatcaagcctgttctgaagcacaactag

SEQ ID NO: 21113 - protein, 1395 aa, Sorghum bicolor
  misc_feature: Ceres ANNOT ID no. 8692248
  misc_feature: Up-regulated in shoot tissues in response to salicylic acid treatment
  misc_feature: Up-regulated in root tissues in response to salicylic acid treatment
  misc_feature (579)..(880): Pfam ID: NB-ARC Pfam Description: NB-ARC domain
MADLVLGLAKSAVEGTLTMAKSAIEEEVKLKKSMQRDLLLISDEFEMMHSFLNVAKERTSDEMVRTLVRQVRNMALDVEDCIESVVLVDAKSHWWRRFLTSCMLPVPPYAPAAALDDAVAAAELLKSRVEAMGQRNQRYWHIRDHSGSSKSKSIEKTNQQAVANAAAVGILKEARNAKKKDSGSTNLAELIKNKDDVPPLQVISVWGAVGDLGVASIIKKAHDNPEICSKFTHRAWVKLTQSFNPHEFMRGLMAQFSTNYQQGSPVDLPKQIDAMMGMEGTLLTEEFAKQVSNNRYLIFLEDLSSTVDWEAVKMYLPDKKNGSCIVVHTQQLEVASLCVGQSHRVMELERFSDDHSVCVFFNEKRSQRYLIDLINKKDDGHAPLQVISVCGEDDGHLEVASIINKTCGDEDNDPEICKKFRYRAWVKLRHPFSEQEFIFRLLAQVCTNYCLRHGSAQDFMKLNGLDKVTEGVQIEQLVKQVMSDQRYLVFLDDVHFKEDWDAVSKYLPDKKNGSCIVVHTQQRDVASHCVGESDGILEMELFSTDHSVSVLLKEVAPEADMHMIRCQGEDEERAIKMEYAKEWINNNRKPVGRGADIENLSANKAGVRPVFGIAGVGKSYIVKHVYCKHVVNQRSYFQKFGWVDVPHPFNIRDFSWSLLLDLHSGSLQHGTMLRIRDPIQGCRELLKRHACLIVIDGLQSREEWDSIKDALAFEADADKNRSRIIVIANEESVASYCSPNWWNVEGLEQDDAFKLFEQTASKRGNDSLWPSDPSPAEIEQAKIVLHKCGGLPKVIVAVADFFAAGWRFNPIHLMKVLETNPAFTCLRDMFAWVNSYFVSCPDSLKPCIFYLSIFPVNHKIRRRRLVRRWIAEGYSTDTKESTADEKGERSFTDLCRLNMIQVPGSTSLSYLTRMPSCQVNGFFREYIMSRSMEENLVFALEGHCSLNSQRTGRHLTIGSTWDRDVSVYQSIDFSRLRSLTVFGKWESFFISDKMRIVRVLDLENASSVTDADLEQIVKLLPRLKFLSLRECKEITRLPDCFDRLRQLQTLDIRHTMVVSLPLCITKLQKLQHIRAGTSITTAQLDDDVSSSGTAQRLPAAAEAGSASSSSMDRQPRAAAALVSRSRLRLPGLCARRRRGQRLCGSRNGGVEAPPGIGEMMALHNISVIDVSVASGRAIIDELKNLTQLRKLGVSGVRRENCIEFCSAISGHPHLESLSVWVDHNQAGCLVAISSPPEELQSLKLYGCIDKLPAWIKLLPNLSKLKLQIDRIMQQDVDLLMDLPSLNILCLCSKEFQYGELRFEGPCRRLWVLEIDCNCRLKTVKFRGTWFSMPQLEVLKIRCQNNVSSLEFSGLQQLRKLREVSLTGSYDDKVKQQLKSQLGENQRDIKPVLKHN

SEQ ID NO: 21114 - DNA, 2358 bp, Sorghum bicolor
  misc_feature: Ceres ANNOT ID no. 8692226
  misc_feature: Up-regulated in shoot tissues in response to salicylic acid treatment
  misc_feature: Encodes the peptide sequence at SEQ ID NO 21115
atggcccctcaagatgatacatttcacactcttgaggacatgttatgtaataaaataggagagccattgagtcttaagcaacacttcttggaaaccatcacaaataacttctccaaggacaaccttattggttgtggcggatatggggaagtttacaagggagttcttaaagatggccttgttgcagtcaagaagttacactcagcgcatgcaattgaagatgaaccatttcatcgtgaggttgattgtctaatgaatattaggcaccacaatatagtcttgtttgttgggtactgtgctgaaacacatgaagaggttttgcatcaaaaagggaaatatatttttgcagaaaaacgagaaaggttgctttgcttcgagtatttgcataatggaagccttcacaagcatattactgctggaccatgtgggcttccatggcgtgtttgttaccaaataataaaaggaatttgtctgggcttgcactatctccacgagaagcacataattcatttagatctcaagccagacaatatattgcttgacgatggcatgatacctaaaattgcagattttggtttgtcaaggctgttgggggaaaaaagccgcacaatcacacaactaagactcggaacaccgggttacatggcacctgagtatatagatgatggagtgatcacaatcaagtcagacatatatagcttgggtgtgataatcagacacatgatgatgggacgtaactcaggagataccactgatcaagatatactggagagctggatgattaggctggaaaaggattcatcacaaatgaggcagcagacgcaattattggaaataggctacaaagagcaaataaaagcgtgcatcgagatgttacatagatgcacgcggcctaaaccaaaggacaggccaacgatagaggatatcctacttacactggaggaaacagaagctagggtcaaattggtcgctgggcctacttcaaatactgttcagcttgagcttgccaaatttgggccatggggtggagatggagggaagccacgagacatcaaaatggtgccttacctcttggacaacataacaattagcagtggaactattatcgattctattgggttttcatacactgaccactatggacagtaccacactatagggccttggggtggtaaggagggtaagaataagatagtttcacttaggacaaaagataaaccatcactcttttgtgtgatggaggtactgggcatcaaattgttgctgctaggacatttttttgacatgattcaactaggtccttcagagtttcttacaggagtatctggaacaatcggtccattcaaaagtctaataaacgttataacatcacttacgtttgtcaccaatactcgtagttatggaccatttggaaaaggccgaggaacacaattccacattcaaatgcaaaacaatggcagggttattggtttctttggtcgttccaaccaatatctcaatgcgattggtgtctacacaaaccaaaatcctgatgtgtatgccaaatttggcccatggggtggagatggaggaaatccacaggacatcaaaatgctaccctaccgtttagatacggttaaaattagcagtggagttattatcgattcaattgagtttacatacaccgaccatgatggccagtaccacactataggcccttggggagtatctggaaccatcggtacattcaatagtcaagtaaaggtaataacgtctcttacatttgtcaccaacaacgctcatagctatggaccatttggaaaagggagaggaacatctttccacattccaatgcatggcaatggctgcattgttggtttctttgggcgctctggacgatatctcaatgcaataggtgtctacgcaaatcctgagtttaaattaattaggaaagaagaggttgaggttgccaggattggaccttggggcggagatggaaatgttcttcatgacatcacagaaaaaccaaatcacctgcaaagagtgacaattttcagtgggactatcataaattcaattgagtatttgtacagtgacgacaatgggcagcagcacactgctggtccatggggcggctgtggaggaaatggccgaaaggtttctggaacatttcatccatgtgcatgggacaaatccataccgaatgttgtatcgtctcttacacttgtcaccaacacaggcaaaacacatgggcctttcggaaagcagatcggagctgatttccacgttccaatggggagcaacagcaggatcgttggcttctttgcccacggaggcaattacatcgaggcaattggtgcctacgttcgcactctgtaa

SEQ ID NO: 21115 - protein, 785 aa, Sorghum bicolor
  misc_feature: Ceres ANNOT ID no. 8692226
  misc_feature: Up-regulated in shoot tissues in response to salicylic acid treatment
  misc_feature (34)..(304): SWISSPROT Homolog: EC 2.7.11.1 Non-specific serine/threonine protein kinase
  misc_feature (37)..(313): Pfam ID: Pkinase Pfam Description: Protein kinase domain
  misc_feature (346)..(508): Pfam ID: Jacalin Pfam Description: Jacalin-like lectin domain
  misc_feature (524)..(637): Pfam ID: Jacalin Pfam Description: Jacalin-like lectin domain
  misc_feature (659)..(784): Pfam ID: Jacalin Pfam Description: Jacalin-like lectin domain
MAPQDDTFHTLEDMLCNKIGEPLSLKQHFLETITNNFSKDNLIGCGGYGEVYKGVLKDGLVAVKKLHSAHAIEDEPFHREVDCLMNIRHHNIVLFVGYCAETHEEVLHQKGKYIFAEKRERLLCFEYLHNGSLHKHITAGPCGLPWRVCYQIIKGICLGLHYLHEKHIIHLDLKPDNILLDDGMIPKIADFGLSRLLGEKSRTITQLRLGTPGYMAPEYIDDGVITIKSDIYSLGVIIRHMMMGRNSGDTTDQDILESWMIRLEKDSSQMRQQTQLLEIGYKEQIKACIEMLHRCTRPKPKDRPTIEDILLTLEETEARVKLVAGPTSNTVQLELAKFGPWGGDGGKPRDIKMVPYLLDNITISSGTIIDSIGFSYTDHYGQYHTIGPWGGKEGKNKIVSLRTKDKPSLFCVMEVLGIKLLLLGHFFDMIQLGPSEFLTGVSGTIGPFKSLINVITSLTFVTNTRSYGPFGKGRGTQFHIQMQNNGRVIGFFGRSNQYLNAIGVYTNQNPDVYAKFGPWGGDGGNPQDIKMLPYRLDTVKISSGVIIDSIEFTYTDHDGQYHTIGPWGVSGTIGTFNSQVKVITSLTFVTNNAHSYGPFGKGRGTSFHIPMHGNGCIVGFFGRSGRYLNAIGVYANPEFKLIRKEEVEVARIGPWGGDGNVLHDITEKPNHLQRVTIFSGTIINSIEYLYSDDNGQQHTAGPWGGCGGNGRKVSGTFHPCAWDKSIPNVVSSLTLVTNTGKTHGPFGKQIGADFHVPMGSNSRIVGFFAHGGNYIEAIGAYVRTL

SEQ ID NO: 21116 - DNA, 1818 bp, Sorghum bicolor
  misc_feature: Ceres ANNOT ID no. 8692565
  misc_feature: Up-regulated in root tissues in response to methyl jasmonate treatment
  misc_feature: Up-regulated in shoot tissues in response to methyl jasmonate treatment
  misc_feature: Down-regulated in shoot tissues in response to salicylic acid treatment
  misc_feature: Encodes the peptide sequence at SEQ ID NO 21117
atgcggggcgccgacctcatcaacgcggcgctccccgacgagctcctcgacgacgtgatccgccgcgtcggcggggccaagcgcgacctcgacgcctgcgcgctcgtctgccgccgctggcgccgcctggagcgcgcctcccgccgctccgcgaggctcgcggcctccggggaccgcgccgacgaggtgctgcgcctcgtcgccgagcgcttcacggcgctcgccgaggtgtcggtcgacgagcgcctcaccgcctccatccgccgccggaggaggctgcccctcgcatcgaatcttactcttcatatatccccgttcccattggaccagccagtcggcgatcaagggtctgagcacagctgtttgaccgatgttggcttgggtcatctcgcaaggggttgcacagggcttgagaagttgagtctggtgtggtgttctgccatatcctcaacaggcttagtgaggatagctgagcattgcaagaagttgacttctttggatctccaggcctgctttattggagatccaggacttactgctatcggggtaggatgcaagctgcttaggaaattgaacttgcgatttgttgaaggcaccacagatgaaggcttgattggattagtaaagaactgtgggcaatcgctggtctcacttgctgttgcaaattgtcaatggttgactgatgcatctttatatgctgttggatcccattgccctaacctagaaattctatcggtggaatcagattgtgttcgaagtttcggaataatatctgttgctaaaggatgccgacaattaaaaactttgaagctacaatgtattggtgctggggatgacgccctagatgctgtcggttcattttgtccgcttttagaaatcttgtcactcaacaactttgaagggtttacagacaggagccttacttcaattgcgaaagggtgcaagaatctcacagatcttgttctcaatgagtgccatttactaactgatagaagccttgaatttgtagctcgtagctgcaaaaaattagcacgtttgaagatcagtggttgtcagaacatggaatctgttgcattggagcacattgggcgatggtgtccgggccttttggagctctctctaattttctgccccaggatccagaacagtgcatttctggagattggtagaggctgctcacttctcaggactctttttttggttgactgttcaagaataagtgatagtgccttgtcccacatagctcaaggctgcaagaacttaacagaactttctatccggcgtggttatgaggtaggagacagagcattgttgtctattgctgagaattgtaaatcacttagagagttaacgcttcagttttgtgagagggtatctgatgcagggctgtctgcaattgcggaaaactgccctctgcagaagttaaacttgtgtgggtgccatctaatcaccgatagtggcttgactgcaattgccagaggatgccctgatctagtcttcctagatataagtgttcttcggatcataagtgacatagcgcttgctgagatagccgatggttgccctaagctcaaagaaattgcactctcccactgcccagatgtcaccaacgttggtctggaccaccttgtcagagggtgtctgcagctggagtcctgccagatggtctactgccggcgaatcaccagctctggggtagcgaccatcgtctcgggctgcaccaggctgaagaagctcctcgtcgaggagtggaaggtgagtgagaggacccggcggagagcaggacctgtcttgtcgttcctctgcaccgggctctag

SEQ ID NO: 21117 - protein, 605 aa, Sorghum bicolor
  misc_feature: Ceres ANNOT ID no. 8692565
  misc_feature: Up-regulated in root tissues in response to methyl jasmonate treatment
  misc_feature: Up-regulated in shoot tissues in response to methyl jasmonate treatment
  misc_feature: Down-regulated in shoot tissues in response to salicylic acid treatment
  misc_feature (317)..(503): SWISSPROT Homolog: EC 1.14.11.27 [Histone H3]-lysine-36 demethylase
MRGADLINAALPDELLDDVIRRVGGAKRDLDACALVCRRWRRLERASRRSARLAASGDRADEVLRLVAERFTALAEVSVDERLTASIRRRRRLPLASNLTLHISPFPLDQPVGDQGSEHSCLTDVGLGHLARGCTGLEKLSLVWCSAISSTGLVRIAEHCKKLTSLDLQACFIGDPGLTAIGVGCKLLRKLNLRFVEGTTDEGLIGLVKNCGQSLVSLAVANCQWLTDASLYAVGSHCPNLEILSVESDCVRSFGIISVAKGCRQLKTLKLQCIGAGDDALDAVGSFCPLLEILSLNNFEGFTDRSLTSIAKGCKNLTDLVLNECHLLTDRSLEFVARSCKKLARLKISGCQNMESVALEHIGRWCPGLLELSLIFCPRIQNSAFLEIGRGCSLLRTLFLVDCSRISDSALSHIAQGCKNLTELSIRRGYEVGDRALLSIAENCKSLRELTLQFCERVSDAGLSAIAENCPLQKLNLCGCHLITDSGLTAIARGCPDLVFLDISVLRIISDIALAEIADGCPKLKEIALSHCPDVTNVGLDHLVRGCLQLESCQMVYCRRITSSGVATIVSGCTRLKKLLVEEWKVSERTRRRAGPVLSFLCTGL

SEQ ID NO: 21118 - DNA, 1569 bp, Sorghum bicolor
  misc_feature: Ceres ANNOT ID no. 8692722
  misc_feature: Down-regulated in shoot tissues in response to salicylic acid treatment
  misc_feature: Encodes the peptide sequence at SEQ ID NO 21119
atggtgttctcggtgttgcttgctgcttacgcactggcattgctggcgttcaccatcgccactctgcatggatccatgcagaggcggaagcctatttccagcagcgccgccgccgctgctcccagcagaccgccgcctcctggccccgccggccacccactcctcggcagcctactctacgtcatcggccctctccgccacaaccctcaccggagcctcgtcgccctcgccgaagcctacgggcccatcgtgtacctccggctcggcctgacccgcgccatggccgtgatctcctccgccgccatcgcgcacgaagccctcgcgaagaacgacgcggcgctcgcggcccgcctcgtcccggacaacgtgcgcgcgctgtcgtacggcgccacgtccatggtcttcctcccgagctccgaccagctgtggcggcagctccgcgtcctgatcggcgccggcttctcctccagccacggcctcgaggccatccgccccgtcctggaccgccgcgcccaacagctcgccgagcacgtgagggcgtgctccggctccggtgccggcacgccggtgaacatccgggaggccgtgaacggcacggtgctcaacgtcgtgtcgaacgtcctcttctccgaggacgtcgtggacctgcgtgatgaccagaagcaggcacagtcgttcaagagcctcgtcgtgcccgtgctcgaggaatggtccaagcccagcgtctccgacgccttccctttcctggcgccgctggaacacctcctcggctcgcgccgccgcatctccacgcacctagccaagctgttcaggttctttgatgaagtgatcattgagaaacggttagcttccggcaagaagcacaatgacatcttggatatcctcctctccaagatggccatgtccaagctcacgcgccaacagatcactacatttctaacagatatgttcatcgcggcgagtgacacgagcacggtgacggtgcaatgggcgatggcggagctgcttcaccacccagacaagatggcgaaggtgaaggctgagcttgctgagcaactagggtttaaaggtttcgtcacggagagcgacctcagcaagctgccgtacctccatgccgtggtgaaggagacacttcgtctccacccagcagtgcctctgataccgcgtgaggtggttgcagacgacggcgtgtttctaggtggattccatgtgccgaaagggacgggcatcgtcgtcaacctgtgggcgattggaagggacgagaacgcctggcctcgtccccaggagttcatcccggagaggttcttggctgctggccaggaggtgcactcgtcaatggtgaaagaggcgtatcggccgtttggtgccgggcgaagggtgtgccctggaatggagtacaccgccaggtctgtgccgttgctgttggcatcgattctgcacagaaatgagtggagactacctgctgatggtgatggggttggattggagggcatggacctcagggaccgctatggcaccgtgctgaatcccgcgacccccttgcatgctgtgctggtgtctaccgtgtga

SEQ ID NO: 21119 - protein, 522 aa, Sorghum bicolor
  misc_feature: Ceres ANNOT ID no. 8692722
  misc_feature: Down-regulated in shoot tissues in response to salicylic acid treatment
  misc_feature (61)..(514): SWISSPROT Homolog: EC 1.14.13.21 Flavonoid 3'-monooxygenase
  misc_feature (46)..(510): Pfam ID: p450 Pfam Description: Cytochrome P450
MVFSVLLAAYALALLAFTIATLHGSMQRRKPISSSAAAAAPSRPPPPGPAGHPLLGSLLYVIGPLRHNPHRSLVALAEAYGPIVYLRLGLTRAMAVISSAAIAHEALAKNDAALAARLVPDNVRALSYGATSMVFLPSSDQLWRQLRVLIGAGFSSSHGLEAIRPVLDRRAQQLAEHVRACSGSGAGTPVNIREAVNGTVLNVVSNVLFSEDVVDLRDDQKQAQSFKSLVVPVLEEWSKPSVSDAFPFLAPLEHLLGSRRRISTHLAKLFRFFDEVIIEKRLASGKKHNDILDILLSKMAMSKLTRQQITTFLTDMFIAASDTSTVTVQWAMAELLHHPDKMAKVKAELAEQLGFKGFVTESDLSKLPYLHAVVKETLRLHPAVPLIPREVVADDGVFLGGFHVPKGTGIVVNLWAIGRDENAWPRPQEFIPERFLAAGQEVHSSMVKEAYRPFGAGRRVCPGMEYTARSVPLLLASILHRNEWRLPADGDGVGLEGMDLRDRYGTVLNPATPLHAVLVSTV

SEQ ID NO: 21120 - DNA, 3258 bp, Sorghum bicolor
  misc_feature: Ceres ANNOT ID no. 8692785
  misc_feature: Up-regulated in root tissues in response to salicylic acid treatment
  misc_feature: Encodes the peptide sequence at SEQ ID NO 21121
atggcatcaggcggcggcggcggtgttggtgtgtgcaacaagagataccgacgatcggacggcgacgacgacgacggcgagacgagcggccgcaacaagagatgcggcgtcggcccaagctcggggcccaacgacgacggcgagagcggcgacttcttcgacggttggcatgctgctgacgacgacggcgccggcggcggcgaggattacatgtacgggtacgacgaggatgaggacgaagccgatcaatcagcagagggcgacgccgccgacgcctcggcgagcgacgacacggagcagaggtacgtggtcctcaccgagtccgacgtccgcgcgcggcaggaggcggacacggccaaggtcgccgaggtgctctccatcccgtcgggcttcgcggcggtcctgctgcgccacttcaagtggcgtgtggggcgggtccaggaggagtggttcacggacgagcggcgcgtccgcgccgccgtcggcctgccggcaccggaacacggcgacgagctagtcccctgtacgcgcagcgcgcgggctgaggtctgcggcatctgcttcgatccgtacccggccgggcggacgaggtcggcggggtgcggacactactactgcgacgggtgctgggccgggtacgtcgccgcggcggtgggggatggtccgcggtgcctttcgatgcggtgcccggacccgtcctgctcggcgcccgtcgtccgggagctcgtcgacaaggtgttggcggcgggcgccaaggaaagggcccggtacgcgcggttctggctccggtcgtacgtggaggagagcggcgggcggatcaagtggtgcggcggcgccgggtgcaatcgctccgtggaggtcctcggggatgccgctgacgcggcggcggcgacggacgtgttctgcgactctgggtgtaggcacggcttctgctgggcctgcggcgaggaggcgcaccggccggtgtcgtgcggcacggtgcgcgcgtggctggccaagaacgcctccgactcggagacggccaactgggtggtggcgcacaccaagcggtgccccaagtgccggcggcccatcgagaagaaccacggctgcaaccacatgacgtgcggcgcgccctgccgccaccagttctgctggctctgcttcgacccctgggacaaccaccgaggctgcacgcgctacgactaccgccagcggcagcaggtggaggccgccgccgcggacgaggaggaggcgcggcggaggcacgccaaggagtcgctggaaaggtacctctaccactacgagcggtgggcgggcaacggcaagtcgctgcacaaggcgctcgcggacgcggacgagctggagcggtcggagctcgagaggatggccaggatggtggacgtcccggcgatggagctcgggttcgtcaccgaggcgtaccgccagatcgccgacggccggcgcgtgctgcggtgggcgcacgcctacgcctacttcctgttcctggacccggagcgcgacggcgccaagcgcgacctgttcgacgacctgcagagccaggccaaccggtggctcgagtgcctgcacagctgcgccgagctggagaggaaggagctcttcggtggtggtgccaatggtgacggcgagcccagcaccgtcgtcgccgtcgaggcgttcagggcgtacaaggagaaggtcgccaacctcaccggagtgacgcggaaattcatggggaaccttgtgaaagcgttcaagaccaacctgccggaagtggtggtgacgccggcggcattcgatttcgatcacatagtgaatggaccaaccatgggcagccaaacagctggtgttggaggcattatttctactgcaactgttacactggaacaaccagccatggaaccgatggtctccggatctgctggtttctggcactcagcactgcagcagccttcatcgtcatctcttatttcacaagaagcaaatatcgcaaatgatagtgtgcaagaacacagacctataagaagccctgttcagcatccagttcgtcctggtaggcatggcggcctcctcagcaatccgtcacagtttcaaccgattcactcaacttttttcggagaagctacgacctcgatgggaccgccgaacataggggcaataacaccattacaattcaacatgtcaaacatgatatcaagtggcgcgacatcgacgccccttgtcaccttctcgatgtctgcacctggacaaccaattggtaatcaagacatggtacagagcacagctcttggctcctttggctcaaacacttctactgcatgggacaattcagatatagctgaatcatcctctcagcctaacagcatggccatgaatcgacaagcaggaatcaatcccctcagttctgccatgaacgcgcctattggaatgcatcacaatgcccaacaaccgccaccgaaatatgtcaaaatttgggagggaaccttatctgggcaaaggcaaggacggcctgtatttattagtagactcgaaggttggagtggaatagtgtccaaaacagttgcagcagactggccagaaactatgcagattgttcgtctcatagcacaggagcatatgaacaacaaacaatatgttggaaaggcagactttctaatatttcggactttaaatcagcatgggtttcttggacaactacaagagaggaagctgtgtgctgtgatacagttaccatcgcaaactctactactttcaatgtctgacaaagcaggtcgtatgattggcatgctcttccctgagaatatggtgatattcaaaccagaggtcgtaactcagccatcactagtgcggcaggaaaagctacaacaaccgcaagaacttctacaccatcaacaaatacagctacaacaacaacaaaaacagcagatgcaacaaatgttgcatcaacgacaacatatgcgggcgtcaactcaaaatctgccaatgcagcaacagaagctgcaccagcaacagcttcaacaccaagaacaactacatttacaacaacaactaatacaacatatgcagcaacaacaacctcaataccatcaacacctacaacaacaaatacaacatcaacaacaactgatacaacaaatacaacaactaaggcatcaacagcaacatatgcatcaaatgcagccccaacaacaaccactgcctcagatggtcgatacagaattaggtaatgatgatgatgcaagggaagattgggttacagagcctgggcagcatgcctag

SEQ ID NO: 21121 - protein, 1085 aa, Sorghum bicolor
  misc_feature: Ceres ANNOT ID no. 8692785
  misc_feature: Up-regulated in root tissues in response to salicylic acid treatment
  misc_feature (255)..(324): Pfam ID: IBR Pfam Description: IBR domain
MASGGGGGVGVCNKRYRRSDGDDDDGETSGRNKRCGVGPSSGPNDDGESGDFFDGWHAADDDGAGGGEDYMYGYDEDEDEADQSAEGDAADASASDDTEQRYVVLTESDVRARQEADTAKVAEVLSIPSGFAAVLLRHFKWRVGRVQEEWFTDERRVRAAVGLPAPEHGDELVPCTRSARAEVCGICFDPYPAGRTRSAGCGHYYCDGCWAGYVAAAVGDGPRCLSMRCPDPSCSAPVVRELVDKVLAAGAKERARYARFWLRSYVEESGGRIKWCGGAGCNRSVEVLGDAADAAAATDVFCDSGCRHGFCWACGEEAHRPVSCGTVRAWLAKNASDSETANWVVAHTKRCPKCRRPIEKNHGCNHMTCGAPCRHQFCWLCFDPWDNHRGCTRYDYRQRQQVEAAAADEEEARRRHAKESLERYLYHYERWAGNGKSLHKALADADELERSELERMARMVDVPAMELGFVTEAYRQIADGRRVLRWAHAYAYFLFLDPERDGAKRDLFDDLQSQANRWLECLHSCAELERKELFGGGANGDGEPSTVVAVEAFRAYKEKVANLTGVTRKFMGNLVKAFKTNLPEVVVTPAAFDFDHIVNGPTMGSQTAGVGGIISTATVTLEQPAMEPMVSGSAGFWHSALQQPSSSSLISQEANIANDSVQEHRPIRSPVQHPVRPGRHGGLLSNPSQFQPIHSTFFGEATTSMGPPNIGAITPLQFNMSNMISSGATSTPLVTFSMSAPGQPIGNQDMVQSTALGSFGSNTSTAWDNSDIAESSSQPNSMAMNRQAGINPLSSAMNAPIGMHHNAQQPPPKYVKIWEGTLSGQRQGRPVFISRLEGWSGIVSKTVAADWPETMQIVRLIAQEHMNNKQYVGKADFLIFRTLNQHGFLGQLQERKLCAVIQLPSQTLLLSMSDKAGRMIGMLFPENMVIFKPEVVTQPSLVRQEKLQQPQELLHHQQIQLQQQQKQQMQQMLHQRQHMRASTQNLPMQQQKLHQQQLQHQEQLHLQQQLIQHMQQQQPQYHQHLQQQIQHQQQLIQQIQQLRHQQQHMHQMQPQQQPLPQMVDTELGNDDDAREDWVTEPGQHA

SEQ ID NO: 21122 - DNA, 1068 bp, Sorghum bicolor
  misc_feature: Ceres ANNOT ID no. 8692793
  misc_feature: Up-regulated in shoot tissues in response to methyl jasmonate treatment
  misc_feature: Up-regulated in root tissues in response to salicylic acid treatment
  misc_feature: Up-regulated in shoot tissues in response to salicylic acid treatment
  misc_feature: Encodes the peptide sequence at SEQ ID NO 21123
atggccgcgacagccagcggcgcggcggacgagccggcggtcgcctgcgacgacagcgcctgctccacgcccttcgtcagcgcgccgtccagcccgacccgcgaccgggaccgggacccttacccgtcccacttcttcttcagcgcgccgaccagccccacccgcggcggcggggggaaggacgccgccgttcccggcgtcctcgacttcgacttcgacttctcctcgcggttcccgtcgccctctgctgcggccatgtcctccgccgacgagctcttccacaacggccagatccgccccgtccgcctcgccgccgcgctgctccagccccacccggaccccgccgtgcttctcgacttcccccacgacgccgccgcggacacggacgcggtgcgggaggaggtggaggtggaggcggacgagcgtggccgcgtccggacccgctccgtgcgccggaaggcgcgctccatgtctccgttccgcacgcactggcggaccgcgtcccacgtgcctgcagcaccgacggtgcccgtcccggagcacgagtctgcagatgaggcgcggcagactgcgacccctgcggcgtcgcgctcgtcgtcgtcctcgtccaccgcctcctccgcctcgtccgcgtcctcctcgtcctcccgcggatcccgccgatggggtgggttcctcaaggacctgctccaccggagcaagtcggacggcggcaagaccacacaccacgcccagcattcccaccacgctgctgctccagcttcgccaaccgcgcagtccaagacgagcactcgtccgtctccgtcacccgcggcggcgaaggggactaggggtgggacgccggggcaccgcggcggcggcggcggcaggaggaggtcggcgcacgagcggctgtacgaggcgcggcgcgccgaggccgaggagatgcgtcgccggacgtcgctgccgtaccgtcagggcctgctactcttcggctgcatcgggctcggcaaccgcagcagctacggcgctgtgcacggcctcgccaggggactcaacgccgccgccgccgtctcctccaggtcgtga

SEQ ID NO: 21123 - protein, 355 aa, Sorghum bicolor
  misc_feature: Ceres ANNOT ID no. 8692793
  misc_feature: Up-regulated in shoot tissues in response to methyl jasmonate treatment
  misc_feature: Up-regulated in root tissues in response to salicylic acid treatment
  misc_feature: Up-regulated in shoot tissues in response to salicylic acid treatment
MAATASGAADEPAVACDDSACSTPFVSAPSSPTRDRDRDPYPSHFFFSAPTSPTRGGGGKDAAVPGVLDFDFDFSSRFPSPSAAAMSSADELFHNGQIRPVRLAAALLQPHPDPAVLLDFPHDAAADTDAVREEVEVEADERGRVRTRSVRRKARSMSPFRTHWRTASHVPAAPTVPVPEHESADEARQTATPAASRSSSSSSTASSASSASSSSSRGSRRWGGFLKDLLHRSKSDGGKTTHHAQHSHHAAAPASPTAQSKTSTRPSPSPAAAKGTRGGTPGHRGGGGGRRRSAHERLYEARRAEAEEMRRRTSLPYRQGLLLFGCIGLGNRSSYGAVHGLARGLNAAAAVSSRS

SEQ ID NO: 21124 - DNA, 1119 bp, Sorghum bicolor
  misc_feature: Ceres ANNOT ID no. 8693048
  misc_feature: Down-regulated in shoot tissues in response to methyl jasmonate treatment
  misc_feature: Down-regulated in root tissues in response to methyl jasmonate treatment
  misc_feature: Down-regulated in root tissues in response to aminocyclopropane carboxylic treatment
  misc_feature: Down-regulated in shoot tissues in response to salicylic acid treatment
  misc_feature: Encodes the peptide sequence at SEQ ID NO 21125
atggccgcgtcttctcatgccatagcccccacggatgctgagctgctgcaagctcaagctgatctatggcgccacagcctctactacctcacgtccatggcgctgaaatgcgcggtcgagctccacatccccaccgccatacacaacctaggaggagctaccacactgccagacctggtaaccgcgctatccctcccgaagaccaagcttccattcctaggccggatcatgcggttgctggtcacgtcaggtatctttgcttctgacggcgccaatggcgatggagcggcggcggaggccgtgtaccgcctcaacccactctcctggctcctggtagaaggtgtggaatccgaggaccacacctaccagaagtacttcgtgctcgccaccgtctcccagcactacgttgacgccggcctgtctctggccgactggttcaggaaggatctgcctgagccgctgccatcgcctttcgagtgtttacatggcgtccccctcgcccatgagagcacaaagctcctggacgaggagcttgacaggattgtggaagaaggtgtcgccgcgcacgacaatctggcaatcggaaccataatacgggagtgcagtgatattttcagtggtcttcactcactgacttattgctgtggtagacagggaaacatcagtgccacggcgatcatcaaggctttccctgacatcaaatgcactgtgctaaaccttccgagggttattgagacagcaccagctgatgatgctgttagctctgtcacgggtgatttgttccacaccataccacctgctcaagctgtgatgctcaagcttgtactccacttctggagcgatgaggattgtgtgaagatcctggagcaatgcaggaaggcaattccttctagagaagagggagggaaggtgatcatcatagaaatacttcttgggccttatatggggcccataatgtatgaagcacagctgctgatggacatgctcatgatggtgaataccagaggcaggcagcgtactgaaaatgactggcgccagatctttactaaagctggtttctctgactataagattgttaagaaaataggagctcgtggtgtcatcgaagtctacccataa

SEQ ID NO: 21125 - protein, 372 aa, Sorghum bicolor
  misc_feature: Ceres ANNOT ID no. 8693048
  misc_feature: Down-regulated in shoot tissues in response to methyl jasmonate treatment
  misc_feature: Down-regulated in root tissues in response to methyl jasmonate treatment
  misc_feature: Down-regulated in root tissues in response to aminocyclopropane carboxylic treatment
  misc_feature: Down-regulated in shoot tissues in response to salicylic acid treatment
  misc_feature (1)..(372): SWISSPROT Homolog: EC 2.1.1.146 (Iso)eugenol O-methyltransferase
  misc_feature (90)..(349): Pfam ID: Methyltransf_2 Pfam Description: O-methyltransferase
  misc_feature (33)..(81): Pfam ID: Dimerisation Pfam Description: Dimerisation domain
MAASSHAIAPTDAELLQAQADLWRHSLYYLTSMALKCAVELHIPTAIHNLGGATTLPDLVTALSLPKTKLPFLGRIMRLLVTSGIFASDGANGDGAAAEAVYRLNPLSWLLVEGVESEDHTYQKYFVLATVSQHYVDAGLSLADWFRKDLPEPLPSPFECLHGVPLAHESTKLLDEELDRIVEEGVAAHDNLAIGTIIRECSDIFSGLHSLTYCCGRQGNISATAIIKAFPDIKCTVLNLPRVIETAPADDAVSSVTGDLFHTIPPAQAVMLKLVLHFWSDEDCVKILEQCRKAIPSREEGGKVIIIEILLGPYMGPIMYEAQLLMDMLMMVNTRGRQRTENDWRQIFTKAGFSDYKIVKKIGARGVIEVYP

SEQ ID NO: 21126 - DNA, 2043 bp, Sorghum bicolor
  misc_feature: Ceres ANNOT ID no. 8693154
  misc_feature: Down-regulated in root tissues in response to salicylic acid treatment
  misc_feature: Encodes the peptide sequence at SEQ ID NO 21127
atggctgcctcgccggaggatttcgtggctgaacccgccgagccgcccttctccccctccatcttcctcgacctgcccccgacgccctgccccgacggcaatggcgagggcaaggacccggcctccgacgacctcggcctccccttcatcgagcggatgctcatggaagaggggatccacgaagagttcttctaccagtaccccgaccaccccgcgctcctccaagcccaggaatcgtacgcacgggtcctctccgacgccaccgcggattccacttcgtacggcagccccaccgtgtcggtgtcctcctccggctccgacgacctcaccacggacgccagtaccggttccgagcagagcccggcgcaagcgcaactgagggatggtggcgcccggagtgacgccgccgccgcggaggaggagatggaggaaaaggccaacagcaccatgcttgcagccgtcgatgatgaccacgccgcactggcctcggcgttcttcagcgcccagcaggatgcggggagcaacgccatgctcaacttggcattcctcaagggcatggaagaggccaacaagttcctgcctagagacatcgacctgctgcgcggctctgccaccgtccttcaagtgaaggaagaggcagaggaggagggaactgccaatttgggcaggggccgcaagaacctgcacaactgggatgatgtcctggaggccaatttgggcagggagaggaagatgatggcgccggagccagaggaatctggtgaggtggttgatgaaatgattgccaatgggttccaattgttcctcagagaggtggagagcctccgcatcagtatgggcagcgaggctgagaagaagaagagcaggaaagggaatgcacggagcgccaatggagtggcggacttgtgcgccttgctcatgcattgtgcacaggctgtggcaatggacgaccgctgcagtgcggctgaactacttaggaagatcaagaagcactcttctccacggggagacgccgcacaaaggctggcacgttatttcgctgagggattggaggcacggctggctggttcagggagcccggtgtacaattcgctcatggcaaagcgcacctctgttgtggacttcctcaaagcctaccggctatacgcagcggcctgctgcttcagaatgatggcgttcaagttcgcgaacctgaccatttccaaggctattgcagggaggaagaaggtacacattgttgattacggcatacattacgggtcccagtggcctggtttgctgaaaattttaactctatggccgggagggccaccagaagtgaggattactggcattgatcttccccagcctgggttccgcccagctgctcgggtcaaggagacagggcgacggcttagcagttatgcctctcagtttggtgtaccgttcaagtaccgtggcattgcggctaagtgggagacggttggcgttgatgatttggacatcgaccctgatgaggtactcattgtcaatagcatcctccattttggaaacttgatggacgaaggtgtcgacatgagtagcccaagcccgagggatgttgttctcagcaacatccggaagatgcgaccagatgtgttcatccttttcatcatgaatggcacatatagctcaccgtattttgtaccacggttccgggaggcgctattccactactctgcaatgtttgacatgatggatgccacaactccacgggatagtgatctgcgcgttctggttgagcgtgatctcttcggccagtgtgcccaaaatgtcatcgcttgtgaaggcttggacagggtggagcgccctgagacatataagaagtggcagttgcggaaccaccgggcagggctgagacagctgtcattggatccagatattgtcaaggccgtgcaggagagtgtcagggacaaatttcatgaggactttgtcactgatgtggatcttcagtggctcctgggagggtggaagggacgcatactctatgcaatgtcgacatgggctgcagctgatgctatctag

SEQ ID NO: 21127 - protein, 680 aa, Sorghum bicolor
  misc_feature: Ceres ANNOT ID no. 8693154
  misc_feature: Down-regulated in root tissues in response to salicylic acid treatment
  misc_feature (276)..(584): Pfam ID: GRAS Pfam Description: GRAS family transcription factor
MAASPEDFVAEPAEPPFSPSIFLDLPPTPCPDGNGEGKDPASDDLGLPFIERMLMEEGIHEEFFYQYPDHPALLQAQESYARVLSDATADSTSYGSPTVSVSSSGSDDLTTDASTGSEQSPAQAQLRDGGARSDAAAAEEEMEEKANSTMLAAVDDDHAALASAFFSAQQDAGSNAMLNLAFLKGMEEANKFLPRDIDLLRGSATVLQVKEEAEEEGTANLGRGRKNLHNWDDVLEANLGRERKMMAPEPEESGEVVDEMIANGFQLFLREVESLRISMGSEAEKKKSRKGNARSANGVADLCALLMHCAQAVAMDDRCSAAELLRKIKKHSSPRGDAAQRLARYFAEGLEARLAGSGSPVYNSLMAKRTSVVDFLKAYRLYAAACCFRMMAFKFANLTISKAIAGRKKVHIVDYGIHYGSQWPGLLKILTLWPGGPPEVRITGIDLPQPGFRPAARVKETGRRLSSYASQFGVPFKYRGIAAKWETVGVDDLDIDPDEVLIVNSILHFGNLMDEGVDMSSPSPRDVVLSNIRKMRPDVFILFIMNGTYSSPYFVPRFREALFHYSAMFDMMDATTPRDSDLRVLVERDLFGQCAQNVIACEGLDRVERPETYKKWQLRNHRAGLRQLSLDPDIVKAVQESVRDKFHEDFVTDVDLQWLLGGWKGRILYAMSTWAAADAI

SEQ ID NO: 21128 - DNA, 2985 bp, Sorghum bicolor
  misc_feature: Ceres ANNOT ID no. 8693264
  misc_feature: Down-regulated in root tissues in response to methyl jasmonate treatment
  misc_feature: Down-regulated in shoot tissues in response to salicylic acid treatment
  misc_feature: Encodes the peptide sequence at SEQ ID NO 21129
atggccctcatcatagctgcagctagaggaaaccttcttgtcagaaagctcgccaatttaactccctcgcaaatgatgagcagcgaagtaattgaggctggaaagctagtgaacctgtggaatgaatgggggctacaaatcctggtccttgtaagcttcgggttacaagtattcctcctcgttttcggaggagtccgccggcatagcaactccaccgcactgatgttcttcctctggtcagcgtacctgctggccgattccacagcgatctacaccctgggccacctatctgtggacagcaggtcagatgagcaccagctggtggcgttctgggcaccgttcctactgttgcacctgggtggcccagacaacatcacagcctatgcactcgaggacaacgcgctctggctccgacacctgcaaactctcgctgtgcaggttctaggagctgcttatgtgatatacgagtacatcgtcaacaggggggcattgcttttgctggcctccatgtccatgttcgttgccggccttctcaagtatggtgagaggatatgggctctcaagtgtggcaacatcagcagcatccgtagcagcatcagcatccggaaggtcaagactgacccatatcagttattggctttgagtactagcgaagaggatttgctgcttggagcccactcccagttcgatatctgcaaaggtgtcttcgctgatatcataatgctaccaaatccctcacttcgttcgcaatccaaaccgcgttccgtgatatcttacctgggagatgatctgtacaagctggtcgagatggagctgtctctgatgtatgacttcctatacaccaaagcagcggtgatccacacatggtatggcttctgcatccatttcatttcgctgtttggcacagccaccacgttcctgttgtttcagctcagcatcaacaacagtggaaatcgatacagcagagtagatgtggctatcagttatgttttactggttggggctttggtcctggaaatcatatcagtgtgcagggctgtactgtccacctggacatgttctttgttgcaccgggggggcaggggatgggagtggcctctccacattatcacttcccttggtcagcgtgtccatccagcaagtaggagactctggtcgggctccattgggcagtacaacttgttccacctgtgcacccgcaacaccaacgagatagggagcagactagcaatgaaattggggctcgaggactggtggaacaagatgcacttctcaggcactttcccgcacgctaactcgtctttgtcaatacaacatatcaagaaattggttctgcaagcattgcgaagcaaagagcaagcactacaacacgaagatactgatttgaactcaagaggcagcttcatactgaaacgtatggaagcctacaaggactttgctcgctggagcgtcaacattgactttgacgagagcatccttgtttggcacattgcaactgaggtgtacatcaggaaatccaaggccaaacatgcaaaagagctccttgaggctactgaggtgctatccaactacttgatgttcttgctggtggtaaaacccaacatgctgcctggcgctgcacggcacaacatacatctcacctcctgcgaacaactagaaggacagtgccgaatgcgatttggtgataaggacaacccagtggcgccatctcctgtaagctggaacccgtactatattcttaaggaattgttccaccatgatggccccagttgctccaggatcccacgaagggagaagcttgcagaggtggcctggagtttctcccaatttgcactgggatcagtaagggcaccaaatccccatggggactccatccgcgacaatgctaatatgtatgcaatcttgctcgccaatgagcttctgagcatagagttgcagtggcaagatcagcgtgacactttggaactgatcctgggggtgtgggtggagatgtcgttgtatgctgcggatcattgcagccaagagtcccatgccaggcagctcagtaatggctgtgagttcattaccatcgtgtcattgctggcacaccacttcaagtactactctggggtcttcaggggcactgacaaccttggtgaagataaaccggcaagtgaaaataaccctgtttctgaaaagctcccccctggtagggtcaacccccttctccatcctctgacgactgcggactgcgggaagcgccagccgcggccgccgccgagaaggaggagcccgctccccaagcagaggggtggggatcagtgcgtgcgctccacgaggaggacgtggaagagctgggcagccgacgagaaggggttggggaggatggtttcgctgtcgactttgttccgctatgccgcgcacaagttcgagtactccatctccctctcgcggaagaaatataatgtgggccagatcaacagtacggagctaactgatgcgatatggaaaaactacatccatggcaagctcacctacacgcattggaccaaagggggagaagccatggctcccatcgtatctccaactggaggaaccctccttgtcagaaagctcgcaaatttgagccccacacaagtgtttgttggggacgttgtcttgttaaaagacccagagaaatctgatgatttaattattcgacgactggctgccctggaaggctatgagatggtctctaatgatgagaaggatgagccgtttgtacttgagaaagaccaatgctgggtcctggcagacaacctagcccttaagccaaaggaagctagagatagccgcttgtttggacctgtcccaatgactgacatccttggcagagtgatatactctttaagaacggctgttgatcacggtccagtcgagaacagcggcatggccatgaaacaggatggcccagtactcgcagtggagcttgatgtggaagagatggcaaagaataataaggcgtag

SEQ ID NO: 21129 - protein, 994 aa, Sorghum bicolor
  misc_feature: Ceres ANNOT ID no. 8693264
  misc_feature: Down-regulated in root tissues in response to methyl jasmonate treatment
  misc_feature: Down-regulated in shoot tissues in response to salicylic acid treatment
MALIIAAARGNLLVRKLANLTPSQMMSSEVIEAGKLVNLWNEWGLQILVLVSFGLQVFLLVFGGVRRHSNSTALMFFLWSAYLLADSTAIYTLGHLSVDSRSDEHQLVAFWAPFLLLHLGGPDNITAYALEDNALWLRHLQTLAVQVLGAAYVIYEYIVNRGALLLLASMSMFVAGLLKYGERIWALKCGNISSIRSSISIRKVKTDPYQLLALSTSEEDLLLGAHSQFDICKGVFADIIMLPNPSLRSQSKPRSVISYLGDDLYKLVEMELSLMYDFLYTKAAVIHTWYGFCIHFISLFGTATTFLLFQLSINNSGNRYSRVDVAISYVLLVGALVLEIISVCRAVLSTWTCSLLHRGGRGWEWPLHIITSLGQRVHPASRRLWSGSIGQYNLFHLCTRNTNEIGSRLAMKLGLEDWWNKMHFSGTFPHANSSLSIQHIKKLVLQALRSKEQALQHEDTDLNSRGSFILKRMEAYKDFARWSVNIDFDESILVWHIATEVYIRKSKAKHAKELLEATEVLSNYLMFLLVVKPNMLPGAARHNIHLTSCEQLEGQCRMRFGDKDNPVAPSPVSWNPYYILKELFHHDGPSCSRIPRREKLAEVAWSFSQFALGSVRAPNPHGDSIRDNANMYAILLANELLSIELQWQDQRDTLELILGVWVEMSLYAADHCSQESHARQLSNGCEFITIVSLLAHHFKYYSGVFRGTDNLGEDKPASENNPVSEKLPPGRVNPLLHPLTTADCGKRQPRPPPRRRSPLPKQRGGDQCVRSTRRTWKSWAADEKGLGRMVSLSTLFRYAAHKFEYSISLSRKKYNVGQINSTELTDAIWKNYIHGKLTYTHWTKGGEAMAPIVSPTGGTLLVRKLANLSPTQVFVGDVVLLKDPEKSDDLIIRRLAALEGYEMVSNDEKDEPFVLEKDQCWVLADNLALKPKEARDSRLFGPVPMTDILGRVIYSLRTAVDHGPVENSGMAMKQDGPVLAVELDVEEMAKNNKA

SEQ ID NO: 21130 - DNA, 1407 bp, Sorghum bicolor
  misc_feature: Ceres ANNOT ID no. 8693289
  misc_feature: Up-regulated in root tissues in response to methyl jasmonate treatment
  misc_feature: Up-regulated in shoot tissues in response to methyl jasmonate treatment
  misc_feature: Encodes the peptide sequence at SEQ ID NO 21131
atggccacgacgacggaggtggagggcccgccgccgccgccggcgaagcgcggcctcctgcggtacaactcgccgctggcgcaggtgtccctgctggggctcatctgcttctgctgcccgggaatgttcaacgcgctgtcgggcctcggcggcggcgggcaggtggacgccagcaccgccgacaacgccaacacggcgctctacgccttcttcgccgtcttcggcgtgctcggcggcgccgcccacaacctcctcggcccgcgcgtgacgctgatgctgggcgcgctcacctacccgctctacgccggctccttcctcttctacaaccaccacccgcacaagcaggcgttccccgtcacggccggcgcgctgctcggcgccggcgcgggcttcctctgggcggcgcagggcgccgtgatgacctcgtacccgccgcccaaccgccggggcacctacatctccctcttctggtgcctcttcaacctcggcggcgtcctcggcggcctgctccctttctccttcaactacaacagtggtgacgaccccaagaacgtcaacgacagcacctacatcgccttcatggccttcatgctcgtcggcgccgggctcaccgtgctcgtgctgccgcccgccaggatcgtccgcgacgacggcaccaaggccaccagggtcaccttctcgtccccggccaccgagggcgtcgagatcctcaagctcttcgccaactggaagatgctgctcgtgctcccggccgcctgggccagcaacttcttctacacctaccagttcaacaacgtcaacggcggactcttcacgctccgcaccaagggactcaacaacgtcttctactggggcgcgcagatgatcggctccgccggaatcggctacttcctcgacttcggattcgccagccgcaggaagagagggctggtcggagtcgtcgccgtcgccgtccttggaacggccatttggggagggggtctggcgaaccagctcaagtacagaactgtgccgttgctccaccccatcgatttcaaggatggccaccgctacgccggaccgttcctgctctacttcagctacggcctgctggatgccatgttccagagcctcatctactggatcatcggtgccctcgccaacgactcccaaatcctcagcaggtacgttgggttctacaagggagtgcagagtgcaggagcggcggtggcatggcaagtggacaagcaacacacgcccctgatatcccagctgattgtgaactgggggctcatgaccatcagctacccattgcttgtgctgctggtgttcctggccgtgaaggacgaggactactctgtttcttcagtggaggaggacggcaaggagaaagatagtaagctgtcagcaccaaccagcttccactaa

SEQ ID NO: 21131 - protein, 468 aa, Sorghum bicolor
  misc_feature: Ceres ANNOT ID no. 8693289
  misc_feature: Up-regulated in root tissues in response to methyl jasmonate treatment
  misc_feature: Up-regulated in shoot tissues in response to methyl jasmonate treatment
MATTTEVEGPPPPPAKRGLLRYNSPLAQVSLLGLICFCCPGMFNALSGLGGGGQVDASTADNANTALYAFFAVFGVLGGAAHNLLGPRVTLMLGALTYPLYAGSFLFYNHHPHKQAFPVTAGALLGAGAGFLWAAQGAVMTSYPPPNRRGTYISLFWCLFNLGGVLGGLLPFSFNYNSGDDPKNVNDSTYIAFMAFMLVGAGLTVLVLPPARIVRDDGTKATRVTFSSPATEGVEILKLFANWKMLLVLPAAWASNFFYTYQFNNVNGGLFTLRTKGLNNVFYWGAQMIGSAGIGYFLDFGFASRRKRGLVGVVAVAVLGTAIWGGGLANQLKYRTVPLLHPIDFKDGHRYAGPFLLYFSYGLLDAMFQSLIYWIIGALANDSQILSRYVGFYKGVQSAGAAVAWQVDKQHTPLISQLIVNWGLMTISYPLLVLLVFLAVKDEDYSVSSVEEDGKEKDSKLSAPTSFH

SEQ ID NO: 21132 - DNA, 957 bp, Sorghum bicolor
  misc_feature: Ceres ANNOT ID no. 8693278
  misc_feature: Down-regulated in root tissues in response to methyl jasmonate treatment
  misc_feature: Up-regulated in shoot tissues in response to methyl jasmonate treatment
  misc_feature: Encodes the peptide sequence at SEQ ID NO 21133
atggagagccagccgctgcaggacccgacggccacggctccggcacccggatctgcggagccagccggagctccgccggccgtcacccccggcaaggagttcacgcgcacctgcaagggcctcgtcgttgtgctcatcggtggatacgtgctgctccagctcctcccctcgtcactcaactacctcgccatcatcccctccaagacaatcccctatgtatggaccgtcttcaccgctggttacatcgagcaagtcctcccaggggccattggcagttctcttggtcttcttttttgtggaaaggacattgaaccagcatggggccgcaaggaattcttgaagttcattattttgatcaactccatctgtggcattcttgcgttctgctttgctattggactctactatgtcactggaaaggagagcttcctggtcacaccactttctggtttccacggttgccttgctggctttcttgtggccctgaagcaactcttaccaaaccttgagcttcctatgtgctttttctggaaaataaaggcaaagtggatgccattctttgttgtatgtttctcaagtatcatggccttcattgtgcctgattccattaacttcttgccgactttggtgtccgggatgtatgttagctggctttacctaagatacttccaaaggaacccactgactggacttaagggtgatcccagtgatgacttctccttccccagtttattcccagctgccatgagaccagttacagaccctgtggccaacctgtttgataggatgttgtgtgcaaggtctaggccttcggaagtagctctcccaatttcagatcctgccaaggcttcaagaagaagggagcgcggcgagagggttcttgaggaaaggttggcagctgacaatgctggtgacacagaagccacgcctcatggccacggcacagccgaagactga

SEQ ID NO: 21133 - protein, 318 aa, Sorghum bicolor
  misc_feature: Ceres ANNOT ID no. 8693278
  misc_feature: Down-regulated in root tissues in response to methyl jasmonate treatment
  misc_feature: Up-regulated in shoot tissues in response to methyl jasmonate treatment
MESQPLQDPTATAPAPGSAEPAGAPPAVTPGKEFTRTCKGLVVVLIGGYVLLQLLPSSLNYLAIIPSKTIPYVWTVFTAGYIEQVLPGAIGSSLGLLFCGKDIEPAWGRKEFLKFIILINSICGILAFCFAIGLYYVTGKESFLVTPLSGFHGCLAGFLVALKQLLPNLELPMCFFWKIKAKWMPFFVVCFSSIMAFIVPDSINFLPTLVSGMYVSWLYLRYFQRNPLTGLKGDPSDDFSFPSLFPAAMRPVTDPVANLFDRMLCARSRPSEVALPISDPAKASRRRERGERVLEERLAADNAGDTEATPHGHGTAED

SEQ ID NO: 21134 - DNA, 1398 bp, Sorghum bicolor
  misc_feature: Ceres ANNOT ID no. 8693334
  misc_feature: Up-regulated in shoot tissues in response to methyl jasmonate treatment
  misc_feature: Up-regulated in root tissues in response to methyl jasmonate treatment
  misc_feature: Up-regulated in shoot tissues in response to salicylic acid treatment
  misc_feature: Encodes the peptide sequence at SEQ ID NO 21135
atggccgggcagcagaaggaggcggcggcggtatccatggtgcaactgagcaccttcacaagggtgccgtcgatcccgagggaccagagctaccgtgatttcccggtgacggtgcgcgtcacggcggcgccgccggatttcgtccaaggcgaacgcaccctggtggatgtggtggcggcgatcgacctcaggtggagcatgggcttcgacgacaagtacggccaccaacccaacgaccggctggtgagggtgaaggaggccatggccaaggtgattgacaacctgggtgtcgacgcccagaaccgccttgccgttgtaggattcaaccaagaggttgccaccagcacggagcttctggaaatgactgcccaaggccagcaaagtgccattgagactgtgaatgcgctgaaagtcttgggtcggccgtccaccttttctgttggcttgaatgaggccaaaaagatcctagatggacgcagtctggcggagaaacggcgtagtctaggcttcatcatcttcgtctccaacggagatgacgttaccttcttagagaaagacatcccgacagcgtacccaatccacgcgttcggtctcacagcacaacacagtccctccaagctgaaagccatggccaaccagacacttggaagctacactcccatcgagaacgacgacctcgagacgaagctcgccgagaagctggaccagctttcggtcaggctcacctccgtcgtcgccgtcgacacgaccatcgacctcaccacactgcaccatggagtggttgtatccaagctagagtcgtcttgggcctataacgatgctcttgtattctacaagagcgaaatcggtggcggcaaaacgtccggcaaggtcgtcgtcggcgatgtctccgccggagaattgaaggagttcaccgtctacctggatgttccagctgcagaaggccagcaggacggcaccggcaccgatgatggcgacagtgtcttggagctgctgaaggttggaggggtgtataagcagagctcggacatggacaagaagaaggtgctgctcggcgagtccatggtgaccgtcgtcaggacagacgacggtggtgcgcttgacttgattgaggagcgggtggcgtactggtgcaaggtgaagctggacctgtcggcgatgtatgacaagttggagacggaggctgcaggggcgaagtccggtggcgatgtcacggaggctcttgctctccgggaggcgtccgtggaggccatcaacagagccatgtaccacgacatctacaacgccgtcctgctcgctctcaagctgaggcgtggcggcgacagtggcaacggcggcagctccgctatggaaaattcacctcccacgccactgcaccctgccaagacaccagtctaa

SEQ ID NO: 21135 - protein, 465 aa, Sorghum bicolor
  misc_feature: Ceres ANNOT ID no. 8693334
  misc_feature: Up-regulated in shoot tissues in response to methyl jasmonate treatment
  misc_feature: Up-regulated in root tissues in response to methyl jasmonate treatment
  misc_feature: Up-regulated in shoot tissues in response to salicylic acid treatment
  misc_feature (56)..(234): Pfam ID: VWA Pfam Description: von Willebrand factor type A domain
MAGQQKEAAAVSMVQLSTFTRVPSIPRDQSYRDFPVTVRVTAAPPDFVQGERTLVDVVAAIDLRWSMGFDDKYGHQPNDRLVRVKEAMAKVIDNLGVDAQNRLAVVGFNQEVATSTELLEMTAQGQQSAIETVNALKVLGRPSTFSVGLNEAKKILDGRSLAEKRRSLGFIIFVSNGDDVTFLEKDIPTAYPIHAFGLTAQHSPSKLKAMANQTLGSYTPIENDDLETKLAEKLDQLSVRLTSVVAVDTTIDLTTLHHGVVVSKLESSWAYNDALVFYKSEIGGGKTSGKVVVGDVSAGELKEFTVYLDVPAAEGQQDGTGTDDGDSVLELLKVGGVYKQSSDMDKKKVLLGESMVTVVRTDDGGALDLIEERVAYWCKVKLDLSAMYDKLETEAAGAKSGGDVTEALALREASVEAINRAMYHDIYNAVLLALKLRRGGDSGNGGSSAMENSPPTPLHPAKTPV

SEQ ID NO: 21136 - DNA, 1023 bp, Sorghum bicolor
  misc_feature: Ceres ANNOT ID no. 8693324
  misc_feature: Up-regulated in shoot tissues in response to salicylic acid treatment
  misc_feature: Encodes the peptide sequence at SEQ ID NO 21137
atgggcggcgcggcggcgggtaccaagtggatccaccacatccagcgcctcagcgcggcgaaggtgtcgacggaggcggtggagcggggccagagccgcgtcatcgacgcctcactcaccctcatccgcgagcgcgcaaagctcaaggcagagttgctgcgtgctctgggtggcgtgaaagcttcagcgtcgctcttaggggtccctcttggtcacaactcatcctttttacaaggccctgcatttgctcctccacgcataagggaggccatttggtgtggaagcacaaactctagcacagaggaaggcaaagaattgaatgatcctcgggtgctaactgatgttggagatgtccccattcaagagatccgtgactgtggcgtcgaagatgacagattgatgcatgtaattagtgagtctgtcaaaacagtgatggaggaggagcctcttcgaccgttggtgttaggaggcgatcactcgatatcttatccagtggttagagctgtgtctgaaaagcttggaggacctgttgacattcttcatcttgatgcacatccagatatctatgactgttttgaagggaacacttattcacatgcctcttcatttgccagaataatggaaggtggttatgccaggagactgctacaggttggattgagatcaattaccaaagaagggcgtgagcaagggaagagatttggtgtggaacagtatgagatgcgaaccttctcaaaggaccgagagaagcttgagaatctgaaacttggggaaggtgtaaagggagtgtatgtctcagttgatgtggactgccttgacccagcgtttgctcccggtgtctctcacattgagccaggaggcctctcgttccgcgatgtgctcaacatcctccagaatttgcagggtgacgttgtcgccgccgatgtggtggagttcaacccacagcgtgacacggtggatgggatgacagccatggtcgccgcgaaactggtccgggagctcactgctaagatttccaagtga

SEQ ID NO: 21137 - protein, 340 aa, Sorghum bicolor
  misc_feature: Ceres ANNOT ID no. 8693324
  misc_feature: Up-regulated in shoot tissues in response to salicylic acid treatment
  misc_feature (7)..(340): SWISSPROT Homolog: EC 3.5.3.1 Arginase
  misc_feature (59)..(339): Pfam ID: Arginase Pfam Description: Arginase family
MGGAAAGTKWIHHIQRLSAAKVSTEAVERGQSRVIDASLTLIRERAKLKAELLRALGGVKASASLLGVPLGHNSSFLQGPAFAPPRIREAIWCGSTNSSTEEGKELNDPRVLTDVGDVPIQEIRDCGVEDDRLMHVISESVKTVMEEEPLRPLVLGGDHSISYPVVRAVSEKLGGPVDILHLDAHPDIYDCFEGNTYSHASSFARIMEGGYARRLLQVGLRSITKEGREQGKRFGVEQYEMRTFSKDREKLENLKLGEGVKGVYVSVDVDCLDPAFAPGVSHIEPGGLSFRDVLNILQNLQGDVVAADVVEFNPQRDTVDGMTAMVAAKLVRELTAKISK

SEQ ID NO: 21138 - DNA, 2151 bp, Sorghum bicolor
  misc_feature: Ceres ANNOT ID no. 8693340
  misc_feature: Up-regulated in shoot tissues in response to methyl jasmonate treatment
  misc_feature: Down-regulated in root tissues in response to methyl jasmonate treatment
  misc_feature: Up-regulated in root tissues in response to salicylic acid treatment
  misc_feature: Up-regulated in shoot tissues in response to salicylic acid treatment
  misc_feature: Encodes the peptide sequence at SEQ ID NO 21139
atggcgtctgcggacgtgcacatggccggcggcggcgcggagacggagaccttcgcgttccaggccgagatcaaccagctgctctccctcatcatcaacactttctactccaacaaggagatcttcctcagggagctcatctccaacgcatcagatgcgcttgacaagatccggttcgagagcctgacggacaagtcgaagctggacgcgcagccggagctcttcatccggctggtcccagacaaggcaaccaagacgctgtccatcatcgactccggcgtggggatgaccaaatccgacctcgtcaacaacctgggcaccatcgcgcggtcaggcaccaaggagttcatggaggcgctggcggcgggcgccaccgacgtgtccatgatcggccagttcggggtcggcttctactccgcctacctcgtcgccgacaaggtcgtcgtcaccaccaagcacaacgacgacgaccagtacgtctgggagtctcaggccggtggctccttcaccgtcacgctcgacaccaccggggaacggcttggtcgcggcaccaagatcacgctgtttctcaaggacgatcagctcgagtacctcgaggagcgacgcctcaaggatctcgtcaagaagcactcggagttcatcagctaccccatctacctctggaccgagaagaccaccgagaaggagatcagcgacgacgaggatgacgaggacaagaaggagggcgacgtcgaggaggttgacgacgacgacggcgacaaggacgacaaggactccaagacgacgaagaagaagaagaaggtgaaggaggtgacgcacgagtgggtgcagatcaacaagcagaagcccatctggctgcgaaagcccgaggagatcacgcgcgaggagtacgcctccttctacaagtcgctgaccaacgactgggaggaccacctcgccgtgaagcacttcgccgtggaagggcagctggagttcaaggccatcctgttcgtgccccgccgcgcgccattcgacctcttcgacacccgcaagaagctcaacaacatcaagctctacgtccgccgcgtcttcatcatggacaactgcgaggagctcatcccggagtggctgggcttcgtcaagggcgtcgtcgactccgacgacctgccgctcaacatctcccgcgagacgctgcagcagaacaagatcctcaaggtgatccgcaagaacctcgtcaagaagtgcatcgagatgttcttcgagatcgccgagaacaaggacgactacgccaagttctacgacgccttctccaagaacatcaagctgggcatccatgaggactcgcagaaccgcgccaagctcgccgacctgctccgctaccactccaccaagagcggcgacgagatgacgagcctcaaggactacgtcacgcgcatgaaggaagggcagaaggacatctactacatcaccggcgagagcaagaaagccgtcgagaactcgccgttcctggagcggctcaagaagaaaggatacgaggtgctcttcatggtggacgccatcgacgagtacgccgtcgggcagctcaaggagtacgacggcaagaagctggtgtcggccaccaaggagggtctcaagctcgacgacgacgacgaggaggccaagaagcgccgggaggagcgcaagaagcagttcgaggatctctgcaaggtgatcaaggacatccttggtgaccgcgtcgagaaggtggtggtgtcggaccgcatcgtcgactcgccgtgctgcctcgtcaccggcgagtacggctggacggccaacatggagcggatcatgaaggcgcaggcgctgcgggacagcagcatgagcgcctacatgtcctccaagaagaccatggagatcaacccggacaacggcatcatggaggagctccggaaacgcgccgaggccgaccggaacgacaagtccgtcaaggacctcgtgctgctgctcttcgagacggcgctgctcacctccgggttcagcctcgacgaccccaacacgttcgccgcgaggatccataggatgctcaagctcggcctcaacattgacgaggatgctgctgccgacgaggacgctgacatgcctgcgcttgaagagggcgccgccgaggagagcaagatggaggaggtcgactga

SEQ ID NO: 21139 - protein, 716 aa, Sorghum bicolor
  misc_feature: Ceres ANNOT ID no. 8693340
  misc_feature: Up-regulated in shoot tissues in response to methyl jasmonate treatment
  misc_feature: Down-regulated in root tissues in response to methyl jasmonate treatment
  misc_feature: Up-regulated in root tissues in response to salicylic acid treatment
  misc_feature: Up-regulated in shoot tissues in response to salicylic acid treatment
  misc_feature (196)..(716): Pfam ID: HSP90 Pfam Description: Hsp90 protein
  misc_feature (38)..(193): Pfam ID: HATPase_c Pfam Description: Histidine kinase-, DNA gyrase B-, and HSP90-like ATPase
MASADVHMAGGGAETETFAFQAEINQLLSLIINTFYSNKEIFLRELISNASDALDKIRFESLTDKSKLDAQPELFIRLVPDKATKTLSIIDSGVGMTKSDLVNNLGTIARSGTKEFMEALAAGATDVSMIGQFGVGFYSAYLVADKVVVTTKHNDDDQYVWESQAGGSFTVTLDTTGERLGRGTKITLFLKDDQLEYLEERRLKDLVKKHSEFISYPIYLWTEKTTEKEISDDEDDEDKKEGDVEEVDDDDGDKDDKDSKTTKKKKKVKEVTHEWVQINKQKPIWLRKPEEITREEYASFYKSLTNDWEDHLAVKHFAVEGQLEFKAILFVPRRAPFDLFDTRKKLNNIKLYVRRVFIMDNCEELIPEWLGFVKGVVDSDDLPLNISRETLQQNKILKVIRKNLVKKCIEMFFEIAENKDDYAKFYDAFSKNIKLGIHEDSQNRAKLADLLRYHSTKSGDEMTSLKDYVTRMKEGQKDIYYITGESKKAVENSPFLERLKKKGYEVLFMVDAIDEYAVGQLKEYDGKKLVSATKEGLKLDDDDEEAKKRREERKKQFEDLCKVIKDILGDRVEKVVVSDRIVDSPCCLVTGEYGWTANMERIMKAQALRDSSMSAYMSSKKTMEINPDNGIMEELRKRAEADRNDKSVKDLVLLLFETALLTSGFSLDDPNTFAARIHRMLKLGLNIDEDAAADEDADMPALEEGAAEESKMEEVD

SEQ ID NO: 21140 - DNA, 1173 bp, Sorghum bicolor
  misc_feature: Ceres ANNOT ID no. 8693404
  misc_feature: Up-regulated in root tissues in response to methyl jasmonate treatment
  misc_feature: Up-regulated in shoot tissues in response to methyl jasmonate treatment
  misc_feature: Down-regulated in root tissues in response to aminocyclopropane carboxylic treatment
  misc_feature: Up-regulated in root tissues in response to salicylic acid treatment
  misc_feature: Encodes the peptide sequence at SEQ ID NO 21141
atgtttggtaatccatcgtacccagatcgaggccactcacacaatacaatggtacacatcagcgaggacagtagggagttgctccaagcccacgtcgagctatggaaccagacctacagctttatgaagtcggtggcactcgccgttgctttggacctccacatcgctgatgccatccaccgccgtggtggcgccgccaccctctcccagatacttggagagattggtgtccgcccatgtaagcttcctggcctccatcgcataatgcgcgttctcaccgtctcaggaaccttcaccatcatccagccatcagcggaaaccatgtcatcagagtcagacgggcgtgagcctgtctataagctgacaacagcgtccagcctcctcgtcagcagcgagagctcggcggcagcgagcttgtctcctatgctaaaccatgtgcttagccccttccgtgactcgccgctcagcatggggctcgctgcgtggttccggcatgatgaagatgaacaggcgcctggcatgtgcccgttcaccctgatgtacggcacaaccttgtgggaggtgtgcaggcgcgacgacgcaatcaacgcgttgttcaacaatgccatggccgcagacagcaacttcttgatgcagattctcttgaaggagttcagcgaggtcttccatgggatagactcgctggtcgacgtcgccggcggggttgggggagccaccatggccattgcggcggcatttccgtgtttgaagtgtaccgtgctggacctccctcacgttgttgccaaggctccttctagttctattggcaacgtgcagtttgttgggggtgacatgtttgagagcattccaccagcaaatgttgtcctcctcaagtggattttgcatgactggagcaatgatgagtgtatcaagatattgatgaattgcaagcaagctatcccttctagagatgcaggaggaaagataataatcattgatgttgtggttgggtctgattcatcagacaccaagcttctggagacgcaagtaatctatgatctccatctcatgaaaattggtggggttgaacgagatgagcaagagtggaagaaaatattcctcgaagctggatttaatgactacaagattataccgattttaggcctccgatcgatcattgagctatatccatga

SEQ ID NO: 21141 - protein, 390 aa, Sorghum bicolor
  misc_feature: Ceres ANNOT ID no. 8693404
  misc_feature: Up-regulated in root tissues in response to methyl jasmonate treatment
  misc_feature: Up-regulated in shoot tissues in response to methyl jasmonate treatment
  misc_feature: Down-regulated in root tissues in response to aminocyclopropane carboxylic treatment
  misc_feature: Up-regulated in root tissues in response to salicylic acid treatment
  misc_feature (159)..(390): SWISSPROT Homolog: EC 2.1.1.128 (RS)-norcoclaurine 6-O-methyltransferase
  misc_feature (111)..(367): Pfam ID: Methyltransf_2 Pfam Description: O-methyltransferase
  misc_feature (45)..(93): Pfam ID: Dimerisation Pfam Description: Dimerisation domain
MFGNPSYPDRGHSHNTMVHISEDSRELLQAHVELWNQTYSFMKSVALAVALDLHIADAIHRRGGAATLSQILGEIGVRPCKLPGLHRIMRVLTVSGTFTIIQPSAETMSSESDGREPVYKLTTASSLLVSSESSAAASLSPMLNHVLSPFRDSPLSMGLAAWFRHDEDEQAPGMCPFTLMYGTTLWEVCRRDDAINALFNNAMAADSNFLMQILLKEFSEVFHGIDSLVDVAGGVGGATMAIAAAFPCLKCTVLDLPHVVAKAPSSSIGNVQFVGGDMFESIPPANVVLLKWILHDWSNDECIKILMNCKQAIPSRDAGGKIIIIDVVVGSDSSDTKLLETQVIYDLHLMKIGGVERDEQEWKKIFLEAGFNDYKIIPILGLRSIIELYP

SEQ ID NO: 21142 - DNA, 2460 bp, Sorghum bicolor
  misc_feature: Ceres ANNOT ID no. 8693521
  misc_feature: Up-regulated in shoot tissues in response to salicylic acid treatment
  misc_feature: Encodes the peptide sequence at SEQ ID NO 21143
atggctcagcagacggcttcaccgttgaatgattcagcagttcttgacgccaaacccttgcgtatgttgacccccatgttccctgccccactagggcttcacacattcacccctcaaaactcaccgtcagttgtctgtgtgaccccatttggaccgtatgctggaggcactggattagggatggctgctggtgttccttcaatgtttgcagcaccagctcctcctacagatcccaggggagagcctgatagagttaatacaaatggagctgctcatgctaatggagctgcaaccaacagtttggccactccttccttacaaactcctctatcagctgggacaccagaatccagtaaaacgaagaggggcagacccaagcgtgtgtcagataatatggttccttcagctacttcaactcctctggctcccacggtttctccaattccttcacttcctaaagttccttcacctcctcaagaaaataataatgttgtttccccgacaccttcttcagccaccccacaggaatctggcaagaggaagaggggatggcccaagcgtgtgcaagacattcatgtcctggcaactcctttagctcctcaagctgataatacacctgttcttgagacgcctcctgcacccactgtacatgaatccggtacaaggaaaaggggacgtcccaaacatttacaggatagtttggatacttcaacactttcaattcactcaaaagatagcaagcccacttcccagacacctgcgaccacctcacctgaatttggtaaaaggaagaggggacgtccaaggcatgtgtccgatggttcagcagccccaaatcattcaggtttctcaactgttgatgcagcaaaacgtggacagcctaggaaaattgataccaatctgttgcagcttccaactttgtcttcagatgatcctagggaatctgcagataatgtactcatgatgtttgacgcactgcggcggaggcttatacagctggatgaggtgaagcaagctgcaaagcagcagcataacttgaaggctgggagcatcatgactaatgctgaacttcgtgtcaataagaacaagcagattggagaggttcctggtgttgaggttggtgacatgttctacttcagaattgagatgtgcctggtggggttgaatagtcagaacatggcaggtattgattatatgtctgccaagtttggtaatgaggaggatcctgtggctattagtgttgtgtcagctggtgtgtatgataataccgaagatgatccatatgttctagtttacactggacagggcatgtctggtaaagatgatcaaaaacttgagaggggtaatcttgcactggagaggagtttgcatagaggcaatccaattagagtcattcgcagcgtaagggatttgacttgtccaactagtaagatatacatatatgacggcctttacaagatcaaagaagcctgggtggagaaagcgaaatctggtttcaatgtttttaaacacaagttgctcagggaacctggccaagctgacggcattgcaatgtggaagaaaactgaaaaatggaggggagatccatcatctagagatcatgttatcttaggcgacatgtcatatggtgtggaaaataagcctgtttgccttgtaaatgaggttgacgatgataagggtcctagccagttcacctatatgaccaaattgaactgtgggaacttgcagtgctcgatgagaaagatgcaaggatgcaaatgtgcaagtttatgcctccctggtgataacaactgcccttgtacacaccaaaatgctggtgcacttccttacagtgcttcaggtatacttgttagccgcatgcctatgttatacgagtgtaatgattcctgcatttgttcaaataattgccggaaccgagttgtacagaaaggtgcccggatccattttgaagtgtttaagacaggagatcgtggttggggtcttcgtagttgggatccaattcgagctggaacatttatctgtgaatatgcaggtgaaatcattgacaaaaatagtgtgaatggagaagatgactacatctttgagacccctccttctgagccgagtttaaggtggaactatgcaccagaattactgggtgaacctaatctttctggctcaaatgagacacccaagcaattgccgatcatcattagtgcaaaacgaactggcaatgtagctcgctttatgaaccacagctgctcgcctaatgtcttttggcaaccagttttgtatgatcatggtgatgagggacatccacacattgcattctttgcaatgaagcatattcctccaatgacagagctcacatatgattatggtcagagccaaggtaatgttcaactgggatccaattctggttgtcggaagtctaaaaattgcttatgtcggtcccacaagtgcagaggctcctttggataa

SEQ ID NO: 21143 - protein, 819 aa, Sorghum bicolor
  misc_feature: Ceres ANNOT ID no. 8693521
  misc_feature: Up-regulated in shoot tissues in response to salicylic acid treatment
  misc_feature (313)..(819): SWISSPROT Homolog: EC 2.1.1.43 Histone-lysine N-methyltransferase
  misc_feature (361)..(512): Pfam ID: YDG_SRA Pfam Description: YDG/SRA domain
  misc_feature (641)..(794): Pfam ID: SET Pfam Description: SET domain
  misc_feature (539)..(639): Pfam ID: Pre-SET Pfam Description: Pre-SET motif
MAQQTASPLNDSAVLDAKPLRMLTPMFPAPLGLHTFTPQNSPSVVCVTPFGPYAGGTGLGMAAGVPSMFAAPAPPTDPRGEPDRVNTNGAAHANGAATNSLATPSLQTPLSAGTPESSKTKRGRPKRVSDNMVPSATSTPLAPTVSPIPSLPKVPSPPQENNNVVSPTPSSATPQESGKRKRGWPKRVQDIHVLATPLAPQADNTPVLETPPAPTVHESGTRKRGRPKHLQDSLDTSTLSIHSKDSKPTSQTPATTSPEFGKRKRGRPRHVSDGSAAPNHSGFSTVDAAKRGQPRKIDTNLLQLPTLSSDDPRESADNVLMMFDALRRRLIQLDEVKQAAKQQHNLKAGSIMTNAELRVNKNKQIGEVPGVEVGDMFYFRIEMCLVGLNSQNMAGIDYMSAKFGNEEDPVAISVVSAGVYDNTEDDPYVLVYTGQGMSGKDDQKLERGNLALERSLHRGNPIRVIRSVRDLTCPTSKIYIYDGLYKIKEAWVEKAKSGFNVFKHKLLREPGQADGIAMWKKTEKWRGDPSSRDHVILGDMSYGVENKPVCLVNEVDDDKGPSQFTYMTKLNCGNLQCSMRKMQGCKCASLCLPGDNNCPCTHQNAGALPYSASGILVSRMPMLYECNDSCICSNNCRNRVVQKGARIHFEVFKTGDRGWGLRSWDPIRAGTFICEYAGEIIDKNSVNGEDDYIFETPPSEPSLRWNYAPELLGEPNLSGSNETPKQLPIIISAKRTGNVARFMNHSCSPNVFWQPVLYDHGDEGHPHIAFFAMKHIPPMTELTYDYGQSQGNVQLGSNSGCRKSKNCLCRSHKCRGSFG

SEQ ID NO: 21144 - DNA, 2322 bp, Sorghum bicolor
  misc_feature: Ceres ANNOT ID no. 8693733
  misc_feature: Up-regulated in root tissues in response to aminocyclopropane carboxylic treatment
  misc_feature: Encodes the peptide sequence at SEQ ID NO 21145
atggtggtgggaacggcgctgctgcgcggcggggtctccatctccatctcctcggtgtggatcctcctgttcctctcctccctgctcctcctctcgccgtcggcggcgtccgtcgacttcagccactgcggcggctgcgacgacgccgacgacggcgccctctccagcgcctacaacatcctgcagtgccagaaggtcagcgacttcctcatcgccgcggcctacttctccatcccgctcgagctgctctacttcgccacctgctccgacctcttccccctcaaatggatcgtgctgcagttcggcgccttcatcgtgctctgcggcctcacgcacctcatcaccgtcttcacctacgagccgcactccttccacctcgtgctcgccctcaccgtcgccaagttcctcactgcactcgtctccttcgccacggccatcaccctgctcacgctcataccgcagctcctcagggtcaaggtcagggaaaacttcctgatgaacaaggcgcgcgagctggaccgggaggtggggatgatgaaaaggaaagaggaggccagctggcacgtgcgcatgctcacgcaggagatccgcaagtcgctcgacaggcacaccatcttgtacaccaccatggttgagctctcaaaggcgctggagctgcagaactgtgctgtctggatgcctaatgagaccaggagcgagatgatcttgacgcatcagctgagggaaagggatataatggacccacagaaccgctctattcctatcgatgatccggatgttctagaaataaaggcgaccaaggatgcaaaagttattgggccagattcggcgctaggggttgctagccgaagcaagcttgaagcagggcctgtggctgcaataaggatgccgatgttaagggtgtcgaacttcaaaggagggactccggaagtgatgcagacgagctatgccatcttggttctggttttgcctaatgatgcttcgttagggtggggtcggagagagctggagattgttgaagtagttgctgaccaagttgcagtcgctctgtcacatgctgcgctcctagaggagtctcagctgatgcgagagaagcttgccgagcagcatagggacttgctacgggcaaagcatgaagccatgagggcaggggaagctcggaattccttccagactgcaatgtacgatggaatgcgaaggccaatgcactcaatccttggtctcgtctcgatgatgcaacaggagagcatgaatccagagcaaaggcttgtgatggatgccattgccaagacaagcagtgttgcatccacgctgatgaacgatgtgatgcaaacatcaacaatgaattgtgagcacttgtctttggtaaggaggccggtcaaccttcattcctttatcaaagaagctgttggagtggtcagatgtctaactggttgcaagggtgtggagtttgagtttcaagtggataattctttgccagaaaggatcattggtgatgagaagagagtcttccatattgtcctgcacatggtaggcaccctaataaaccgatgtaatgccggctgtatctcgttatatgttagtggtcataatgaggttgaagagaggcataatcatgactggatgctgcgaagagcaaacttctctggaggctatgtatgtgtcaaatttgagattagggttagaaaatccaaggacaatcttttgagttcatcaagcagtgagataaggcatgggtccaaacccaacaattctgagatggggcttagcttcaatatgtgtaagaagattgtgcagatgatgaatggtaatatttggtcagtatcagattctaaatgcattggagaaaccatcatgcttgtcctccagttccagttgcaacctgtgactccagtctctggagcgtcctcagatttgtaccgatcgtccgccattcccaactttaatgggctcagagtcctccttgcggacagtgatgacaccaaccgagctgtaactcacaggcttctggagaagcttggttgccgagtcctttcagtcgcttctggtgtccaatgcatgagctcctttgctgccgagtcatccttccagctggtgattcttgatcttgccatgcagacgatggacggattcgaagtagcccgcgcgatcaggaagttcagtagcaatagttggctgccgttgattgttgccctagcagcaagaatcgacgacaacatccgggatcgatgccagaggtcaggaataaatggcctgatccagaaaccagtcacactagctgcactgggagatgaactgtatagagtccttcagaacaattaa

SEQ ID NO: 21145 - protein, 773 aa, Sorghum bicolor; identical to SEQ ID NO: 2136
  misc_feature: Ceres ANNOT ID no. 8693733
  misc_feature: Up-regulated in root tissues in response to aminocyclopropane carboxylic treatment
  misc_feature (60)..(772): SWISSPROT Homolog: EC 2.7.13.3 Histidine kinase
  misc_feature (651)..(767): Pfam ID: Response_reg Pfam Description: Response regulator receiver domain
  misc_feature (201)..(350): Pfam ID: GAF Pfam Description: GAF domain

SEQ ID NO: 21146 - DNA, 1500 bp, Sorghum bicolor
  misc_feature: Ceres ANNOT ID no. 8693868
  misc_feature: Down-regulated in shoot tissues in response to salicylic acid treatment
  misc_feature: Encodes the peptide sequence at SEQ ID NO 21147
atggagcctcaggaggtggagcggagcacgtatgtcctcctaaaggtactctacatgtgcctccccgacacgcccgtgtacgccggcgccgccctgtccgcccgcctccccgacgacgccgaggaccgcatcagcgccctccccttctccctcctccgcaacatcgtgtcccgcctccccgccaaggacgccgcccgcaccaccgcgctctcccgccgctggcgccccgtctggcgctgcacgccgctcgccttcgctgatgcgcacctcctcccgggagtcctcggtggccatcgcaggcccgcgcccgccgacacgccgaccctcgccgacaccttctcccgcgccatcgccgcgcacccgggccccttccgcgccgtccacctcgtctgcggctactacgcggacgccgcgcgccagcggcagctcgcgcgctgggtccagacgttcgtcgccaagggcgtccaggagctcatcctcgtcaaccgcccgatgccgctccacgtgcctctccccgccgcgctccttggcgtcgccaccctcacccgcctctacctcggcctctggaaattcccggacacctccgctctccgacagtgtcaaagtgacgctggcgtggtgttcccgcacctccgcgagctcgtcctctgctgggtgatggtggagagccgcgacatggacttcctcctagctgggagccccgtcctagagacctttggcataatgggaatcagggagaaggcgatgcgcctccgccacgctggccagcatctccggtgcacgcagatcctcatgtcaactgtggacagcgtcactgtggtggacgccctgagccttgagcggctcatcttgtgggaagccatgccgtgcaacagctcttgcatcagggtaaagattggcaaagtccccaagctgcaagtacttggatacttgagtcctggaagtcacatgctggagatccggaataccgtcatcaacgctgggataaaggcgacaccaagcaccatggttccaggcatcaggatcttggggttaaacatgcgcttcggagaccgcaatgattccaagatgctaccgactttcctcagatgctttccaaatgttgagagactgcatattgtgacctctctgcacatgagtccggtgagtgcccgtcgtgcgctggtgatccggtcgtacgaggtcggccccgacaagacggccaccctggagaccctgctcaaccttctccaggagaccgcgctgaaccatgtttggatgtcggggctgctcggcgacggcttcggcgccacgcacaggaacaacctcatctgggtcgtctccaggatgcacgtccaagtcgaccagtacccgatctggggagaggtgctggacatcgacacctgggtgggctcgtcggggaagaacggcatgcggcgggactggctcatccgcggccgcaactccggcgacgtcttcgtccgtgcaacaaggcaagtccgggccctcgcgatcgaatga

SEQ ID NO: 21147 - protein, 499 aa, Sorghum bicolor
  misc_feature: Ceres ANNOT ID no. 8693868
  misc_feature: Down-regulated in shoot tissues in response to salicylic acid treatment
  misc_feature (381)..(499): Pfam ID: Acyl-ACP_TE Pfam Description: Acyl-ACP thioesterase
  misc_feature (42)..(89): Pfam ID: F-box Pfam Description: F-box domain
MEPQEVERSTYVLLKVLYMCLPDTPVYAGAALSARLPDDAEDRISALPFSLLRNIVSRLPAKDAARTTALSRRWRPVWRCTPLAFADAHLLPGVLGGHRRPAPADTPTLADTFSRAIAAHPGPFRAVHLVCGYYADAARQRQLARWVQTFVAKGVQELILVNRPMPLHVPLPAALLGVATLTRLYLGLWKFPDTSALRQCQSDAGVVFPHLRELVLCWVMVESRDMDFLLAGSPVLETFGIMGIREKAMRLRHAGQHLRCTQILMSTVDSVTVVDALSLERLILWEAMPCNSSCIRVKIGKVPKLQVLGYLSPGSHMLEIRNTVINAGIKATPSTMVPGIRILGLNMRFGDRNDSKMLPTFLRCFPNVERLHIVTSLHMSPVSARRALVIRSYEVGPDKTATLETLLNLLQETALNHVWMSGLLGDGFGATHRNNLIWVVSRMHVQVDQYPIWGEVLDIDTWVGSSGKNGMRRDWLIRGRNSGDVFVRATRQVRALAIE

SEQ ID NO: 21148 - DNA, 2286 bp, Sorghum bicolor
  misc_feature: Ceres ANNOT ID no. 8693924
  misc_feature: Up-regulated in root tissues in response to salicylic acid treatment
  misc_feature: Encodes the peptide sequence at SEQ ID NO 21149
atggctccgttcggcgacggcggcgggggtggcgacggagcggaggcgctgcgggggtgggacccgctgcgcagtggcagcgcgccgccgacgatggagggcgccgcggcggcagcggtggcggcggagagggtgtttggcggcggcggcggcggcggcgcgtcgttcttctccgggatcgacgggctcgggttcggcgcgaggatggacgaggaacattttggcaattctgcatctttatctggtggaccacctggcctcctacttaatggtacgggagacttggatgaacggcagtttggaccgagcagagttcatagtggtggcactatgtcaaattactctgcatttgacatgggttcactttggacagacatggatcttgacaatgctgaatatcgcagaaatatccagaatcgctttgtgtcaaacatagaaaagatgaatgcttacggcaatagggattttaatgcttcctacatggctgattctgatctttcagatgctttatctgggttgaggctgtctaatagcccagtagtggaccaaaggaatcatggggaagagctactagatgaaatactcaagcgtcaaagagatttctctaaaattggtgatgaaaaccgatcacctttggttggtaatgttttccgcgcacctaggtcagatgtgcatccatcaccaatgtatggagatggtattttacggaggcagaccagtgcattcgatggttccaatgtttcaaggatgagtcgccatcacataaagggtgttgatcacttatctttggctgaacagctagctataatgcaatcaggcaacttgcctagaggaaataatctttcgcgcaatgcggctatgactaatatgatcaaccccatgagcaatagatacaacagcaatgcagactttgatttggttaggagtcgaagggcactccttgaggatctacttgcacaacagtatctgcaggaagataatctgtcatataatgatagtaggatctatcatgatgagcctcgttttccctattcaagaatgcaaagatctgtatctcatttttatccaaactcgaggcacgttgcacatggtgatcggcaatcacggctcttctccctcaacagaaaggcaatgggtagaaatgttggatcacaggtctatcacgacaatacattagcaaactaccaggatctgtcttctttggataatgcagatagaaatggacttgattcagtggagttgattgatgttgtgggtcgcgttaaggaagttagcatggatcaatatggaagccggtttattcaacaaaaactcgaaattgcatcactggatgttcgggaaaaaatatttccagagatattatccaatgccattgctctaacaactgatgtttttggcaattatgttatccagaagtttttcgagttcgctacagaaagtcagttaatccaattggcagataaactcaaaggtcacattttggaactcagcctccagatgtatggttgcagggtagttcagaaggttttggaggtagttgatatggatcgaaagatcgacattgttcatgagctcaagaattatgttctgaaatgtattggtgatcaaaacggtaaccatgtgatccagaaatgcattgagtgtgttcctgaagaccgcattccgtttgttattgatcctatactttcacaaattcttgttctatgcacccatcaatatggctgcagagtcattcagagagttctggagcattgccatgatcctgtgactcaaagtgctatcatgaatgaaattgtgcagcagaccttccatttgacagatgataaatttggtaactatgttgttcaacatgtgttggaacacgggaagccagaagagcgttcatccatcattcaaaagctctcagggcaagtggtcatcttgagcaagcaaaagtttgcttctaatgtcattgagaaatgtttggcttttggaacacctgaagaacgtgatagccttattggggaaatcatttcatctggtcaaacatttcaggaattaatgaaggatcagtttggtaactatgttgtacagagagtccttcagacatgtgatgacaaatacctagagatgatcctgtcaagcatcaaattacatttgaatgaactgaagaattacacgtacgggaagcacattgtggcacgtgtcgagaagctaatcgttacaggagagaaacgagcaaggatggcgtccctgagtggccaacatcagcagccaccgaactgtacagctgtagacgcacactaa

SEQ ID NO: 21149 - protein, 761 aa, Sorghum bicolor
  misc_feature: Ceres ANNOT ID no. 8693924
  misc_feature: Up-regulated in root tissues in response to salicylic acid treatment
  misc_feature (524)..(557): Pfam ID: PUF Pfam Description: Pumilio-family RNA binding repeat
  misc_feature (560)..(595): Pfam ID: PUF Pfam Description: Pumilio-family RNA binding repeat
  misc_feature (597)..(631): Pfam ID: PUF Pfam Description: Pumilio-family RNA binding repeat
  misc_feature (672)..(706): Pfam ID: PUF Pfam Description: Pumilio-family RNA binding repeat
  misc_feature (488)..(522): Pfam ID: PUF Pfam Description: Pumilio-family RNA binding repeat
  misc_feature (452)..(486): Pfam ID: PUF Pfam Description: Pumilio-family RNA binding repeat
  misc_feature (633)..(667): Pfam ID: PUF Pfam Description: Pumilio-family RNA binding repeat
  misc_feature (416)..(450): Pfam ID: PUF Pfam Description: Pumilio-family RNA binding repeat
MAPFGDGGGGGDGAEALRGWDPLRSGSAPPTMEGAAAAAVAAERVFGGGGGGGASFFSGIDGLGFGARMDEEHFGNSASLSGGPPGLLLNGTGDLDERQFGPSRVHSGGTMSNYSAFDMGSLWTDMDLDNAEYRRNIQNRFVSNIEKMNAYGNRDFNASYMADSDLSDALSGLRLSNSPVVDQRNHGEELLDEILKRQRDFSKIGDENRSPLVGNVFRAPRSDVHPSPMYGDGILRRQTSAFDGSNVSRMSRHHIKGVDHLSLAEQLAIMQSGNLPRGNNLSRNAAMTNMINPMSNRYNSNADFDLVRSRRALLEDLLAQQYLQEDNLSYNDSRIYHDEPRFPYSRMQRSVSHFYPNSRHVAHGDRQSRLFSLNRKAMGRNVGSQVYHDNTLANYQDLSSLDNADRNGLDSVELIDVVGRVKEVSMDQYGSRFIQQKLEIASLDVREKIFPEILSNAIALTTDVFGNYVIQKFFEFATESQLIQLADKLKGHILELSLQMYGCRVVQKVLEVVDMDRKIDIVHELKNYVLKCIGDQNGNHVIQKCIECVPEDRIPFVIDPILSQILVLCTHQYGCRVIQRVLEHCHDPVTQSAIMNEIVQQTFHLTDDKFGNYVVQHVLEHGKPEERSSIIQKLSGQVVILSKQKFASNVIEKCLAFGTPEERDSLIGEIISSGQTFQELMKDQFGNYVVQRVLQTCDDKYLEMILSSIKLHLNELKNYTYGKHIVARVEKLIVTGEKRARMASLSGQHQQPPNCTAVDAH

SEQ ID NO: 21150 - DNA, 2043 bp, Sorghum bicolor
  misc_feature: Ceres ANNOT ID no. 8694925
  misc_feature: Up-regulated in shoot tissues in response to salicylic acid treatment
  misc_feature: Encodes the peptide sequence at SEQ ID NO 21151
atggatcactccacctccctgctccggctcatcttccttgctcttggcgcagccctggttctccttatcgtccgctccgccttccgcctcccacgtggaatcgacacacccaccacctcactcttcgatgacgccaccgccggcagcagctgcacacggttcgcgccatgggggtgccgccaggccgaccggattaagcaggagcagaagccgaagccggagccgccgtcgcacgagaacgacgtgccgctgcacccgctcgacccactgacggtcaccgagataaaccgtgcgcgcgagctcctccgcgcgcacccgccgttcgcgtcgtcgccgtcgtccatgttcgtgcactcgctggcgctcgacgagccggacaagcccgtcgtcctgagctggcggaagggcgccgacccgctgcccccgcgacgcgccgtggcggtggtccggttccgcggcgaggccttcgtcctcgccatcgacctcgccagcggcgccgtgactcctctgcctgccccagcttccgggtacccgaccatgaccatggacgagcaggtgtccctctgctatgcccctttcagtgacccggcgttcaacgccaccgtccagcggcacggcgtccgtatgtccgacgtcgcctgcctgccgatctccctcgggtggtacggccccaccgaggagaaccgccggctgatcaagatccagtgcttctccgcggagggcacggccaacttctacatgcgccccatcgagggcctcaccgtgctgctggacatggacacgagggaggtcatccgcatctccgaccgcggcggcggcatccccatcccgcccgccgccaacaccgactacaggtatgaccccggcacgggcgcgcaccgggaggtgctgtacaagggcatggcgtcggagctcttcgtgccgtacatggacccgaccgaggcgtggtacttcaagacgtacatggatgccggcgagtacggcttcggcctgcaggccatgccgctggtgccgctcaacgactgcccacgccacgcacggtacctcgacggcgtgttcgtggccgccgacggccggccctacgtgcgggagaagatgatctgcgtcttcgagcggtacgccggcgaggtcgcgtggagacactcggagagccccatcaccggcatggacataagggagtcgcggccgaaggtgacgctggtggcgcggatggttgcgtccgtggccaactacgactacatcatggactgggagttccagatggacggcctcgtccgcatcaaggtgggcctgagcgggatcctgatggtgaagggcacggcctactcccacctacgggaggcccgcgagaacgaggacacgcacggcacgctgctctccgagaacgtcatcggcgtcatccacgaccactacgtgacgttccgcctggacatggacgtcgacggcgccgacaacaactccttcgtgcgcgtggagatggcgcggcaggagacggcccccggcgagtccccccggaggagctacctcaaggccacccggcacgtggcgcggaccgagaaggacgcccaggtgcgcctcaagctctacgatccggccgagttccatgtcgtcaacccgaccaagaagacgcgggtcggcaaccccgttggctacaagctcgtccctgccggcaccgccgccagcttgctggacccggaggatccgccgcagaagaggggtgctttcacaaacaatcagatctgggtgacaccctacaacaagagcgaggaatgggccggtggtctgttcgtgtaccagagcaaaggggaggacacattggctacttggtccgagagagaccgtccgatcgagaacaaggacctggtgctgtggtacacgctggggttccaccacatcccgtgccaggaggacttccccatcatgcccaccgtgtcctcaagcttcgacctcaagcctgtcaacttcttcgagagcaaccccatcctcaagcagaggcccaccaaggaggatgatctgcccatctgttccgccaccgccgtgtaa

SEQ ID NO: 21151 - protein, 680 aa, Sorghum bicolor
  misc_feature: Ceres ANNOT ID no. 8694925
  misc_feature: Up-regulated in shoot tissues in response to salicylic acid treatment
  misc_feature (286)..(676): SWISSPROT Homolog: EC 1.4.3.6 Amine oxidase (copper-containing)
  misc_feature (249)..(669): Pfam ID: Cu_amine_oxid Pfam Description: Copper amine oxidase, enzyme domain
  misc_feature (178)..(277): Pfam ID: Cu_amine_oxidN3 Pfam Description: Copper amine oxidase, N3 domain
  misc_feature (85)..(173): Pfam ID: Cu_amine_oxidN2 Pfam Description: Copper amine oxidase, N2 domain
MDHSTSLLRLIFLALGAALVLLIVRSAFRLPRGIDTPTTSLFDDATAGSSCTRFAPWGCRQADRIKQEQKPKPEPPSHENDVPLHPLDPLTVTEINRARELLRAHPPFASSPSSMFVHSLALDEPDKPVVLSWRKGADPLPPRRAVAVVRFRGEAFVLAIDLASGAVTPLPAPASGYPTMTMDEQVSLCYAPFSDPAFNATVQRHGVRMSDVACLPISLGWYGPTEENRRLIKIQCFSAEGTANFYMRPIEGLTVLLDMDTREVIRISDRGGGIPIPPAANTDYRYDPGTGAHREVLYKGMASELFVPYMDPTEAWYFKTYMDAGEYGFGLQAMPLVPLNDCPRHARYLDGVFVAADGRPYVREKMICVFERYAGEVAWRHSESPITGMDIRESRPKVTLVARMVASVANYDYIMDWEFQMDGLVRIKVGLSGILMVKGTAYSHLREARENEDTHGTLLSENVIGVIHDHYVTFRLDMDVDGADNNSFVRVEMARQETAPGESPRRSYLKATRHVARTEKDAQVRLKLYDPAEFHVVNPTKKTRVGNPVGYKLVPAGTAASLLDPEDPPQKRGAFTNNQIWVTPYNKSEEWAGGLFVYQSKGEDTLATWSERDRPIENKDLVLWYTLGFHHIPCQEDFPIMPTVSSSFDLKPVNFFESNPILKQRPTKEDDLPICSATAV

SEQ ID NO: 21152 - DNA, 1152 bp, Sorghum bicolor
  misc_feature: Ceres ANNOT ID no. 8696578
  misc_feature: Up-regulated in root tissues in response to salicylic acid treatment
  misc_feature: Encodes the peptide sequence at SEQ ID NO 21153
atgacgaagggccacaaggttattaaggcatcacctaagcgatgccttgttgtccaggcatttttcgaactgtggcatcaggcttgccgtgattttcttgcatatggcgtcgcctcgcacgccaagtcgttgccaaggtgtcgacttgctccaggcgatagggaaaggcacggattgcgtccgcaggagggaaaggcagggattgcatgcgtgggagggaaagtgcacacatgggcagaagattgccgcacgcgtgggggaaagagccatctggcgcctacaacacaaggaggagagagggaaagagaagagggtggagttccacctggaatcttgccgcggcggtgcctacctccatcccactgcaactcccgccgcatccgtgacttctgctacatcctcgacggcacttctccacagcctccagtcctccaccgattcatgcagtcgtgcctccatcatcctgcaaactgctatgtggttgactgcttctgcttgcctgcttggctcttctctgctctgcagccaactattaagcctttctggagagtgtggactgctgctggaagtggtggtcgtggtgtcataggtgtacttgaggcaaatttcattgaaccagctcatgataagcaagacttcgagcggacaacacttctagcaagacttgaagcacgattagttcaaatgcagaaggattactggtctgggaatgctcatcgaataggatacgttgcaccacgatctggtaggaactctgatgcaggagatggagaagactctcgtgaaaacacagcaagtgcacaaccatcaccttatcattctgggaaagggtacacacaggcaaaagacatgaataataatattaaaaagggtggtaaggcaagcacatcatttggtattcagcagagagctgagaagtccgcaaggactaaacgatctatgaagtcaatactacacgggctgtctgatagtgataatagtgattctgagtttatgggcactctgccgaggtcaagatctcacactgtgaacagaaaccaaaaattgtttcaaaatggcagtactgatttgacaacacctcaatccagtggactaatagaaagagacaggggcagaactaaatcccagccattggtaatttccttcctctaa

SEQ ID NO: 21153 - protein, 383 aa, Sorghum bicolor
  misc_feature: Ceres ANNOT ID no. 8696578
  misc_feature: Up-regulated in root tissues in response to salicylic acid treatment
MTKGHKVIKASPKRCLVVQAFFELWHQACRDFLAYGVASHAKSLPRCRLAPGDRERHGLRPQEGKAGIACVGGKVHTWAEDCRTRGGKSHLAPTTQGGEREREEGGVPPGILPRRCLPPSHCNSRRIRDFCYILDGTSPQPPVLHRFMQSCLHHPANCYVVDCFCLPAWLFSALQPTIKPFWRVWTAAGSGGRGVIGVLEANFIEPAHDKQDFERTTLLARLEARLVQMQKDYWSGNAHRIGYVAPRSGRNSDAGDGEDSRENTASAQPSPYHSGKGYTQAKDMNNNIKKGGKASTSFGIQQRAEKSARTKRSMKSILHGLSDSDNSDSEFMGTLPRSRSHTVNRNQKLFQNGSTDLTTPQSSGLIERDRGRTKSQPLVISFL

SEQ ID NO: 21154 - DNA, 1035 bp, Sorghum bicolor
  misc_feature: Ceres ANNOT ID no. 8697261
  misc_feature: Up-regulated in root tissues in response to salicylic acid treatment
  misc_feature: Up-regulated in shoot tissues in response to salicylic acid treatment
  misc_feature: Encodes the peptide sequence at SEQ ID NO 21155
atggctgatgctgccgccgccgccgcccccacgaagacagcgaacatcccgacgacgatgcgggccgtgcagtacgacgcctatggcgggggcgccacgggtctcaagcatgtggaagttcctgtccctatggccaaaaagaatgagcttctattgaaactggaagcagcaagcatcaatccagtggactggaagatacagaaagggttgttgcagccttttctgcctcgtaaatttccttttatcccagtgactgatgtggcaggagttgtggctgatgttggtccaggaatcaatggattccaagccggagatcaagttgttgctatgctcaactcacttaatggaggtggacttgctgagtatgctgtggcatcagaaaatctgaccgtcaagaggcctcccgaggtatctgctgctgaaggcgctgggctgcccattgccgctggtactgcgctccaggtgcttaggaccatcggcgccaagttcgatggtactggccagcccttaaacgttctgatcaccgcagcatcaggtggtgtgggtctctatgccgtgcagctcgcaaaactggctggtctccacatcactgccacctgtggcgcacgtaacgtagagctggtgaagagcttgggcgcggatgaggtgcttgactacaggacgccagagggtgccatcctgcagagcccctcaggtaagaagtacgatggcgtcgtccactgcactgtcgggatcagctggtcaacgttcgagcctgtgctggccaccaacgggagggtgatcgacatcactccaaacttcactgtgttcctcaaatcggcgctgcacaaggtgaccttcgccaagaagcggctggtgccgctgctcctgtcgcccaacaaggcagacctagagttcctggtcgggctgctgaaggacggcaacctcaagacgctgattgactcgaggttcccgctgagcgaggtgagcaaggcgtgggagaagagcatcgagggccatgctactggaaagatcattgtcgagatggtaggctaa

SEQ ID NO: 21155 - protein, 344 aa, Sorghum bicolor
  misc_feature: Ceres ANNOT ID no. 8697261
  misc_feature: Up-regulated in root tissues in response to salicylic acid treatment
  misc_feature: Up-regulated in shoot tissues in response to salicylic acid treatment
  misc_feature (20)..(340): SWISSPROT Homolog: EC 1.6.5.5 NADPH:quinone reductase
  misc_feature (47)..(133): Pfam ID: ADH_N Pfam Description: Alcohol dehydrogenase GroES-like domain
  misc_feature (168)..(305): Pfam ID: ADH_zinc_N Pfam Description: Zinc-binding dehydrogenase
MADAAAAAAPTKTANIPTTMRAVQYDAYGGGATGLKHVEVPVPMAKKNELLLKLEAASINPVDWKIQKGLLQPFLPRKFPFIPVTDVAGVVADVGPGINGFQAGDQVVAMLNSLNGGGLAEYAVASENLTVKRPPEVSAAEGAGLPIAAGTALQVLRTIGAKFDGTGQPLNVLITAASGGVGLYAVQLAKLAGLHITATCGARNVELVKSLGADEVLDYRTPEGAILQSPSGKKYDGVVHCTVGISWSTFEPVLATNGRVIDITPNFTVFLKSALHKVTFAKKRLVPLLLSPNKADLEFLVGLLKDGNLKTLIDSRFPLSEVSKAWEKSIEGHATGKIIVEMVG

SEQ ID NO: 21156 - DNA, 885 bp, Sorghum bicolor
  misc_feature: Ceres ANNOT ID no. 8699802
  misc_feature: Down-regulated in shoot tissues in response to salicylic acid treatment
  misc_feature: Encodes the peptide sequence at SEQ ID NO 21157
atgcgggccctcgcgcgcgccgcgtcgtcgctgctccgccgcgccgcgggatccgcgcccaccacggggtcgccgcaccacccttcgccgggcgtaggcccgtgcctcgccaagaatctgccaggtttctttttcaatgggtattctactcttttggctccaccaagtgaagtgctgattccaccagaacttctttctagcaggactgtgtggacaccagatcgggagcttgggcagtatgaagacctggtagctagggttacaaacttccataatgaggacaagggcttcatggttttggatggtgatgtttttgatgttccaattaggaaggatattgttcaccgggtagtaaggtggcagcttgctaaaagacagcaggggacacactcaaccaaaacaatcagtgaagtgagtggcaccggaagaaagccttacaagcaaaaaggaactggaagagcacggcatggaacactgcgcggtccccagttccgtggtggtgcaaccatgcatgggcctaaaccacgaagccatgcaatcaagctgcagaagaaagtgcggcgtctggggcttaagattgccttgtctgctcgaactgcagaggggaagctcttggtctttgaggacttggaagtccctagccacaagacaaaaaacattgtgcaatacattaggcagatggatgatacaaagaaggttctgttggtggatggaggtgacattgataagaagctaaagctggctactcaaaaccttcactatgttaatgtacttccttccattggcctgaacgtttacagcatccttcagcatgacacccttgtaatgtctcgggctgctatcaacagaatcgtcgagcggatgcatacccccatcaaccgctag

SEQ ID NO: 21157 - protein, 294 aa, Sorghum bicolor
  misc_feature: Ceres ANNOT ID no. 8699802
  misc_feature: Down-regulated in shoot tissues in response to salicylic acid treatment
  misc_feature (97)..(287): Pfam ID: Ribosomal_L4 Pfam Description: Ribosomal protein L4/L1 family
MRALARAASSLLRRAAGSAPTTGSPHHPSPGVGPCLAKNLPGFFFNGYSTLLAPPSEVLIPPELLSSRTVWTPDRELGQYEDLVARVTNFHNEDKGFMVLDGDVFDVPIRKDIVHRVVRWQLAKRQQGTHSTKTISEVSGTGRKPYKQKGTGRARHGTLRGPQFRGGATMHGPKPRSHAIKLQKKVRRLGLKIALSARTAEGKLLVFEDLEVPSHKTKNIVQYIRQMDDTKKVLLVDGGDIDKKLKLATQNLHYVNVLPSIGLNVYSILQHDTLVMSRAAINRIVERMHTPINR

SEQ ID NO: 21158 - DNA, 1425 bp, Sorghum bicolor
  misc_feature: Ceres ANNOT ID no. 8699868
  misc_feature: Up-regulated in shoot tissues in response to methyl jasmonate treatment
  misc_feature: Encodes the peptide sequence at SEQ ID NO 21159
atgcaggggcgcagtagggacgccgccaccgttgcggcagcggtggtgtgcgcagctgtgctgctgctcggcgacgcctgctgggccgtctcggcgcaggcggcggcggcggaggacaagataagcgccctgccggggcagccgccggtgggcttcgcacagtactccggttacatcccggtggacgccgcggggaagcgctcgctcttctactacttcgccgaggcggaggcggatccggcggccaagccgctcgtgctctggctcaatggagggcctggctgttcatctgtgggagtgggggccttctcagagaatgggccgttcaggcctagtggcaatgcgctaacaaggaatgagtatagctggaacaaagaggccaatatgctgtatttggagagccctgcaggggttggcttctcctactccactgatcctgccttctatgagggtgttggtgacagcatgacagccagagacaatttgaagttcttgcaaggctggtttgccaagttcccgcagtacaagggcagagacctgtatattacaggggagagctacgctggccactatgttccacaattagcccagcgcatggttgagttcaacaagaaggagaagctattcaatctgaaaggcattgctcttggcaatccggtgctggaattctccacggatttcaactcgcgcgccgagttcttctggtcgcacggcctgatatcggattccacctacaacatcttcacgacggtgtgcaactactcgcggtacgtgagcgagtactaccatggttccctgagcacggcctgtgacagggtgatgagccaggtgacgagggagaccagcaggttcgtcgacaagtacgacgtcaccctggacgtctgcatctcgtcggtgctcatgcagtcccagatcctcgccccgcagcaagggagccgggagctggacgtgtgcgtggaggacgagacgatgaactacctgaaccggaaggacgtgcagcaggccatgcacgcgcgcctcaccgacggcgtgcagaggtggacggtctgcagcagcgttctggagtacaagcagctggacctgcagatcccgaccgtgaacatcgtgggcgcgctggtgaagtcgggcatcccggtgctggtgtacagcggcgaccaggactcggtgatcccgctgacgggcagcaggacgctggtgagccggctggcgggcaggctccgcctcaacaccacggcggcgccgtaccgggcctggttccaggggaagcaggtgggcgggtggacgcaggtgttcggcggcggcgcgctgtccttcgccacggtgcgcggcgcctcccacgaggcgcccttctcgcagcccgagcgctcgctcggcctcttcagggccttcctcgccggacagcagctgccggaatcgttccagtga

SEQ ID NO: 21159 - protein, 474 aa, Sorghum bicolor
  misc_feature: Ceres ANNOT ID no. 8699868
  misc_feature: Up-regulated in shoot tissues in response to methyl jasmonate treatment
  misc_feature (38)..(473): SWISSPROT Homolog: EC 3.4.16.6 Carboxypeptidase D
  misc_feature (45)..(466): Pfam ID: Peptidase_S10 Pfam Description: Serine carboxypeptidase
MQGRSRDAATVAAAVVCAAVLLLGDACWAVSAQAAAAEDKISALPGQPPVGFAQYSGYIPVDAAGKRSLFYYFAEAEADPAAKPLVLWLNGGPGCSSVGVGAFSENGPFRPSGNALTRNEYSWNKEANMLYLESPAGVGFSYSTDPAFYEGVGDSMTARDNLKFLQGWFAKFPQYKGRDLYITGESYAGHYVPQLAQRMVEFNKKEKLFNLKGIALGNPVLEFSTDFNSRAEFFWSHGLISDSTYNIFTTVCNYSRYVSEYYHGSLSTACDRVMSQVTRETSRFVDKYDVTLDVCISSVLMQSQILAPQQGSRELDVCVEDETMNYLNRKDVQQAMHARLTDGVQRWTVCSSVLEYKQLDLQIPTVNIVGALVKSGIPVLVYSGDQDSVIPLTGSRTLVSRLAGRLRLNTTAAPYRAWFQGKQVGGWTQVFGGGALSFATVRGASHEAPFSQPERSLGLFRAFLAGQQLPESFQ

SEQ ID NO: 21160 - DNA, 1335 bp, Sorghum bicolor
  misc_feature: Ceres ANNOT ID no. 8699873
  misc_feature: Up-regulated in root tissues in response to salicylic acid treatment
  misc_feature: Encodes the peptide sequence at SEQ ID NO 21161
atggcggccgagggcggcggcgggcaagagacgttcgaggcgcgggtgaagcgcctgttcgggtcccgcctctacgacgccgtcccggactcctccttcccgacggcctcctggtccgtggccgcgggcgacgtcgagcgccaccgctgggcgaagccgtcggaggcgcgcgacgcggaggaggaggcagcgggggaggccgcccgcggggacacgccctgcgcctccgcgttctacgacgccaacgggtgcctccgcggccggaggcgcaggtccaggcaggaggagttcgagggggtcctcgacgacctagatgaggaggaggaggaggaggaggacggggagagtggggggaggaaggcgacggagcaggacgaggaggagggggttagggttaacatcggcctcgaccccaccctggatcgggaggaagaggaggacaagtatgatagagaggcctttggtagagaggaggctgctgaccgcgtgtacatgcacgatataatggatgacggcataaacatgagcatcaacagtatagtccctgacctccttgatgattccattgaagaggtgtaccgttttaagaaggatcctcgggcagatatgagggcagcatcggcaagactcagagaagatgatggttctgctaaagatggtgattctcactatgcctctcaagccaaggagttccccagtgtaggggttcagacaaagaaagctgtggaggaagtcaatgtaaaacctatactgaagaggaaggaggagcaagcagatttaaaaccaaggaaacgtgtccggtttgatgctaatgttaaggatcatgagtcagatatgtttgaacatgacgaagattctccaatggttcctcaatccatggatgtagtcactgagaaggaggagagcacatctactttttctgcatctcctgggattcctgactatgtaaggaacccttcaaagtacacgcgttacaccctggatgtaccagagtctaatgataactcgaacaggacggctcttgctgacctgcatgatctgttagggaggtcagacccaaacaggatacagtctgagacgcctgttgagattcctagctcagtcacattcatccctcgcaagaagtcagtggatgccatggcagtggatgagggtcccagagctattgattccaactcatctgtaattggaatggtagcaggtgcctctgacgaacctgatcaatgtgagatggatgaagatgacagtaaatcatcgtcgacgccacagatgcatacaaactcaaaggcgagctcccggcgatacaggtcaagtagatcagatgatgatgagtga

SEQ ID NO: 21161 - protein, 444 aa, Sorghum bicolor
  misc_feature: Ceres ANNOT ID no. 8699873
  misc_feature: Up-regulated in root tissues in response to salicylic acid treatment
MAAEGGGGQETFEARVKRLFGSRLYDAVPDSSFPTASWSVAAGDVERHRWAKPSEARDAEEEAAGEAARGDTPCASAFYDANGCLRGRRRRSRQEEFEGVLDDLDEEEEEEEDGESGGRKATEQDEEEGVRVNIGLDPTLDREEEEDKYDREAFGREEAADRVYMHDIMDDGINMSINSIVPDLLDDSIEEVYRFKKDPRADMRAASARLREDDGSAKDGDSHYASQAKEFPSVGVQTKKAVEEVNVKPILKRKEEQADLKPRKRVRFDANVKDHESDMFEHDEDSPMVPQSMDVVTEKEESTSTFSASPGIPDYVRNPSKYTRYTLDVPESNDNSNRTALADLHDLLGRSDPNRIQSETPVEIPSSVTFIPRKKSVDAMAVDEGPRAIDSNSSVIGMVAGASDEPDQCEMDEDDSKSSSTPQMHTNSKASSRRYRSSRSDDDE

SEQ ID NO: 21162 - DNA, 2766 bp, Sorghum bicolor
  misc_feature: Ceres ANNOT ID no. 8699869
  misc_feature: Down-regulated in shoot tissues in response to aminocyclopropane carboxylic treatment
  misc_feature: Encodes the peptide sequence at SEQ ID NO 21163
atggagggcgctctagttcagtctgcgattgttccaaccgtttacagaagcagctcaggtcgtttccgcgcgcgtgcaagggccagaacaaatgctacaatggtgcgcaatatgccagcaaggactcttactcttggtggcttccaagggctgcgtcagacaaactttttggacacgaggtctgtgatcaagcgtgactttgtgtcgatcgtggcaagtcagattgcaaggccgcgcgggtcggcctcacgaggggttgttcgtgccatgtttgaacgcttcactgagaaagcaatcaaggtgattatgctcgcgcaagaggaggcaaggcgccttggacacaactttgttgggacagagcagattttgctggggcttattggtgagggcacgggaattgcggcgaaggttctgaagtctatgggaatcaatcttaaggatgcccgagtggaagttgaaaagataattggacgtggcagtgggtttgtggctgttgaaatcccattcacgcctcgtgcaaaacgtgtattggaattgtcccttgaagaagctcgtcagcttgggcataactatataggatctgaacacttgctccttgggttacttcgtgagggtgaaggtgttgctgctcgtgtgcttgaaagccttggtgctgatccaaacaacatccgtacccaggtcataagaatggttggggaaagcacagaagccgttggggctggagttggtggaggaagcagtggccagaagatgcccacacttgaagaatatggtactaatttgacgaaattagcagaggagggtaaattggacccagttgttggtagacgggatcagattgagcgtgttactcagattttgggaaggcggacaaagaacaacccctgcctaattggagagcctggtgttggcaaaactgctattgctgaggggcttgctcaacgtattgccaatggggatgttcctgaaacaattgaaggaaagaaggttattactcttgacatggggctccttgttgctggaaccaaataccgtggagagtttgaagagagactaaagaaacttatggaggaaattaagcaaaatgaagacattattctcttcattgatgaagtgcacacactgattggagcaggtgcagcagaaggtgcaattgatgctgctaatattttgaagccagctcttgcaagaggtgaactgcagtgcattggtgctacaacgctggatgagtataggaagcatatagagaaagatcctgccttggaaagaaggtttcaaccagttaaggttcctgagcctactgtcgatgaaacaatacagatcttaagaggacttcgtgagagatatgaactccatcacaaactgcgatacacagatgatgctttaattgctgctgcacagctttcttatcagtatatcagtgatcgattcctgcctgacaaggccattgacttgattgatgaagctggatcccgtgttaggctgaggcatgcccagctccctgatgaagccaaagagctggacaaagagctgcggcagattaccaagcagaaaaacgaggctgtacgcagccaggactttgagaaggctggcgaattaagggaccgagaaatggagcttaaggctcaaattacagccattattgacaagagcaaggaaatgattaaagcagagactgaatctggtgaagtcggtcctcttgttactgaggcggacattcaacatattgtctcctcttggactggaattcctgtggagaaggtgtcatctgatgagtctgatcgtctcctaaagatggaagagacactgcatacacgtatcattggacaggatgaggctgtcaaagctattagtcgtgctatccgccgtgctcgtgttggcctcaagaatccaaataggccaattgccagcttcatattctctggaccgactggagttggcaaatcagagctagcaaaggctctggcggcctactactttggctcggaggaggctatgatcaggcttgacatgagtgagttcatggagagacatactgtctccaaactcattggatcacctccaggttatgttgggtacactgagggaggccaactaactgaagcagtccgtcgccgcccgtacacagttgttctctttgatgagattgagaaagcacatccagatgttttcaacatgatgcttcagatcttagaagatgggcggttaactgatagcaaggggcgcacagtggacttcaagaacacactattgatcatgacatctaatgtcgggagcagtgtcattgagaagggaggccgcaagattgggttcgaccttgactatgatgagaaagacacaagctataacaggatcaagagccttgtgactgaggagttgaagcagtacttccggccagagttcttgaacagattggatgagatgattgtattccggcagctgactaaattggaggtgaaggagattgcagacattatgctgaaagaagtgtttgacaggttgaaggccaaggacattaatctccaggttacagagaagttccgagatagagttgttgacgaaggttataacccgagctatggtgccagacctttgcggcgtgctatcatgaggcttctggaggatagtctggcagagaagatgctggctggtgaggtgaaagaaggtgactctgccatcgttgatgtggattcagatggcaaggtaatagtcctgaacggtggcagcggtgttgctgagccactggaacctgctctcagtacctaa

SEQ ID NO: 21163 - protein, 921 aa, Sorghum bicolor
  misc_feature: Ceres ANNOT ID no. 8699869
  misc_feature: Down-regulated in shoot tissues in response to aminocyclopropane carboxylic treatment
  misc_feature (441)..(809): SWISSPROT Homolog: EC 3.4.21.53 Endopeptidase La
  misc_feature (633)..(808): Pfam ID: AAA_2 Pfam Description: ATPase family associated with various cellular activities (AAA)
  misc_feature (180)..(232): Pfam ID: Clp_N Pfam Description: Clp amino terminal domain
  misc_feature (105)..(157): Pfam ID: Clp_N Pfam Description: Clp amino terminal domain
  misc_feature (294)..(487): Pfam ID: AAA Pfam Description: ATPase family associated with various cellular activities (AAA)
  misc_feature (508)..(543): Pfam ID: UVR Pfam Description: UvrB/uvrC motif
MEGALVQSAIVPTVYRSSSGRFRARARARTNATMVRNMPARTLTLGGFQGLRQTNFLDTRSVIKRDFVSIVASQIARPRGSASRGVVRAMFERFTEKAIKVIMLAQEEARRLGHNFVGTEQILLGLIGEGTGIAAKVLKSMGINLKDARVEVEKIIGRGSGFVAVEIPFTPRAKRVLELSLEEARQLGHNYIGSEHLLLGLLREGEGVAARVLESLGADPNNIRTQVIRMVGESTEAVGAGVGGGSSGQKMPTLEEYGTNLTKLAEEGKLDPVVGRRDQIERVTQILGRRTKNNPCLIGEPGVGKTAIAEGLAQRIANGDVPETIEGKKVITLDMGLLVAGTKYRGEFEERLKKLMEEIKQNEDIILFIDEVHTLIGAGAAEGAIDAANILKPALARGELQCIGATTLDEYRKHIEKDPALERRFQPVKVPEPTVDETIQILRGLRERYELHHKLRYTDDALIAAAQLSYQYISDRFLPDKAIDLIDEAGSRVRLRHAQLPDEAKELDKELRQITKQKNEAVRSQDFEKAGELRDREMELKAQITAIIDKSKEMIKAETESGEVGPLVTEADIQHIVSSWTGIPVEKVSSDESDRLLKMEETLHTRIIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRKIGFDLDYDEKDTSYNRIKSLVTEELKQYFRPEFLNRLDEMIVFRQLTKLEVKEIADIMLKEVFDRLKAKDINLQVTEKFRDRVVDEGYNPSYGARPLRRAIMRLLEDSLAEKMLAGEVKEGDSAIVDVDSDGKVIVLNGGSGVAEPLEPALST

SEQ ID NO: 21164 - DNA, 1368 bp, Sorghum bicolor
  misc_feature: Ceres ANNOT ID no. 8699953
  misc_feature: Down-regulated in shoot tissues in response to aminocyclopropane carboxylic treatment
  misc_feature: Down-regulated in shoot tissues in response to salicylic acid treatment
  misc_feature: Encodes the peptide sequence at SEQ ID NO 21165
atggaggcagccagatctggtgtcgttgttgtcgggcggatctgtccatctctacctcgtcgatccgtgttagcgccttcgaccccgaacaatcaaaccgagttgaaatgtgaggcaaaggtggtagactctaatgctcaaagtgacacaacaaaggtagtgtttggtctggggacaaggtgggacaggacggaacagaatgtgcatgaagattcaccaatagtcgctgattttccatcatcaagcaatcaagatggcttgcctgtcccatcaagcaatcaaaatggatcacatgttcatttttcaagcctcaaagcagatgaggaagaatctgatacgtcggaagagattgtcccagtcgtggttcgtcctggtcacattcgctttgaaccagcaggtggagaacccaacaaatcgccagcaaaggaattacagggcacattccaatggagtgcaacaatgagcaaaaagaagggccagaagtggggaatgaatagctcaaacaagaaaagtgctgatattggctatcatgcaggaatagctggaagcgacacagaagttaacaatcatgtcatggacattaaggttactaaaaatgacttttgtgctgtcagtaatcgaaggaacaatgaaggcagtaatattgagatgtccagtgtgaaaagtgttgctaatgaagaaaagtctagtggtgaacctttcgattttgagagcttgtaccccctaacgcgtcttccaaaggagggagatctgattgcctacagattggttgagctgtcttccatgttgtgtccggagctgtcttcgtaccgtgtcggaaaagttcttatatatgatcccgtatcatcccgtatcattctcttacccgttcaaaagtatccaatcaccatcgaggaaaaagaaaacaaggacgagtcagatatgcttgcggacttgtcaccatacaaggaagatggctccttggagatcgagtactcttcacttcttgatgtaaggctgctgaagggtgctgaaccagtgctaggggctgccagtactccctcagcactggctggaaggccagttaccttacacaaaaataaaggcaatattgtgagccagaaatcactcttggtggcaaacagcactaaagatgaagaacgcaaacttgaaggaaagtcagagagcacggtttgggaaaagaatgatgagcccagtgataaggtcgacgttcaggaaaatggctggggaacatggaaacaaaatgctagtacgtcagcttggtcttacagagccctcaggagcagcgcccttggcccgacaatggcaatgctacgagggaagaacagccagaggggtaaaccaccctatcgaaagaatggcaagtga

SEQ ID NO: 21165 - protein, 455 aa, Sorghum bicolor
  misc_feature: Ceres ANNOT ID no. 8699953
  misc_feature: Down-regulated in shoot tissues in response to aminocyclopropane carboxylic treatment
  misc_feature: Down-regulated in shoot tissues in response to salicylic acid treatment
MEAARSGVVVVGRICPSLPRRSVLAPSTPNNQTELKCEAKVVDSNAQSDTTKVVFGLGTRWDRTEQNVHEDSPIVADFPSSSNQDGLPVPSSNQNGSHVHFSSLKADEEESDTSEEIVPVVVRPGHIRFEPAGGEPNKSPAKELQGTFQWSATMSKKKGQKWGMNSSNKKSADIGYHAGIAGSDTEVNNHVMDIKVTKNDFCAVSNRRNNEGSNIEMSSVKSVANEEKSSGEPFDFESLYPLTRLPKEGDLIAYRLVELSSMLCPELSSYRVGKVLIYDPVSSRIILLPVQKYPITIEEKENKDESDMLADLSPYKEDGSLEIEYSSLLDVRLLKGAEPVLGAASTPSALAGRPVTLHKNKGNIVSQKSLLVANSTKDEERKLEGKSESTVWEKNDEPSDKVDVQENGWGTWKQNASTSAWSYRALRSSALGPTMAMLRGKNSQRGKPPYRKNGK

SEQ ID NO: 21166 - DNA, 1353 bp, Sorghum bicolor
  misc_feature: Ceres ANNOT ID no. 8700040
  misc_feature: Up-regulated in shoot tissues in response to salicylic acid treatment
  misc_feature: Encodes the peptide sequence at SEQ ID NO 21167
atggtgctgcagcgcttctcgtggccgtacggcggccggagagcctccttctgcggcagcttcaccgggtggagggagtgtcccatggggctggtcggggccgagttccaggtcgtcttcgatctgcctcccggggtttaccagtaccggtttttggttgatggtgtctggaggtgtgatgaggcgaaaccctttgtacgtgatgaatatggattgatcagcaatgaagtgcttgtggaaaacaatgtacaacctgttgtgcagccagagccttctatcagaggaaccaatgtggatgagggtatcattttgacaacaatgcccccggagccatcatctcagaacccaggcgtgcaaatagcagttttccgccatgtggtctctgaaatattattacacaataccatatatgacgttgttcctatttctagcaagttagcagttttggacactcagcttcctgttaaacaagcatttaaaataatgcatgatgagggtcttgctctggttcctctttgggatgaccatcagggaactataacaggcatgctcactgcatcagattttgtattaatgttgagaaagagaaacattcgagttattggcaatgaagagcttgaaatgcatcccatttctgcttggaaagaagcaaagctacagttttatggtgggcctgatggtgctgccatgcagagaaggccattaatccatgttaaggattcagataatttagtggatgtggcattgactataatcagaaatgaaatatcttcagttcctatctttaagtgcgtgccagattcaacagggatgcctttccttagtcttgcaaccctccaggggattttgaaatttctttgctcgaagctacaagaacaggctgagggctgttcccttctgcacaatcagcttctcagtattcctattggcacatggtctccacatacgggaaggtcaagtagcaggcaactcagaactttgctactgagttctcctctaaatacctgcctggattttctgcttcaagatagagtaagctcaattcctatagttgatgacaatggatccctccgtgacgtctactcactcagtgatatcatggctctggcgaagaatgatgtttatgctcgcatcgaacttgaacaagtgactgtgcaaaatgctttggatgtgcaataccaggtgcatggccgaagacagtgtcatacttgtttacagacgagtaccttgctggaagtcttggagggattgtctgttccaggagtgcgacggcttgttgttattgaacaaagtaccagatttgtggaaggaatcatctcattgagagacatttttacatttctccttggatag

SEQ ID NO: 21167 - protein, 450 aa, Sorghum bicolor
  misc_feature: Ceres ANNOT ID no. 8700040
  misc_feature: Up-regulated in shoot tissues in response to salicylic acid treatment
  misc_feature (318)..(449): Pfam ID: CBS Pfam Description: CBS domain pair
  misc_feature (140)..(287): Pfam ID: CBS Pfam Description: CBS domain pair
MVLQRFSWPYGGRRASFCGSFTGWRECPMGLVGAEFQVVFDLPPGVYQYRFLVDGVWRCDEAKPFVRDEYGLISNEVLVENNVQPVVQPEPSIRGTNVDEGIILTTMPPEPSSQNPGVQIAVFRHVVSEILLHNTIYDVVPISSKLAVLDTQLPVKQAFKIMHDEGLALVPLWDDHQGTITGMLTASDFVLMLRKRNIRVIGNEELEMHPISAWKEAKLQFYGGPDGAAMQRRPLIHVKDSDNLVDVALTIIRNEISSVPIFKCVPDSTGMPFLSLATLQGILKFLCSKLQEQAEGCSLLHNQLLSIPIGTWSPHTGRSSSRQLRTLLLSSPLNTCLDFLLQDRVSSIPIVDDNGSLRDVYSLSDIMALAKNDVYARIELEQVTVQNALDVQYQVHGRRQCHTCLQTSTLLEVLEGLSVPGVRRLVVIEQSTRFVEGIISLRDIFTFLLG

SEQ ID NO: 21168 - DNA, 1599 bp, Sorghum bicolor
  misc_feature: Ceres ANNOT ID no. 8700120
  misc_feature: Up-regulated in shoot tissues in response to methyl jasmonate treatment
  misc_feature: Down-regulated in root tissues in response to methyl jasmonate treatment
  misc_feature: Down-regulated in root tissues in response to salicylic acid treatment
  misc_feature: Encodes the peptide sequence at SEQ ID NO 21169
atgggagggcgcgcgctgctgctgctcctcgtctcggcgctgctcgttcagatccgcgcctccgatccgctgctgtacgagccgttcgacgaggacttcgaggggagatgggtcgtctccaagaaggacgagtaccaaggtgtgtggaagcatgccaagagtgatggccatgaagactatggcctccttgtcagtgagaaggcaaggaaatacgccataatcaaggagcttgatgagccagttactttgaaggatgggacagtggtcctgcagtttgaagtgaggcttcagaatggccttgaatgtggaggtgcctacattaagtacatccgccctcaggatgctggatgggatgccaaggagtttgataatgagactccatacacaattatgtttggtccagataagtgtgggtcaaccaacaaggttcatttcatccttaagcacaagaatcccaagactggaaagtatgttgagcatcacctcaaattcccaccttctgtcccatatgacaagctctctcatgtctacacggctatcttgaagccagacaatgaggtcagaattttggtcgacggggaagaaaagaagaaggcaaacttcctttctgctgatgattttgagccagcacttatcccatccaagaccattcctgaccctgatgacaagaagccagaggactgggatgagagagctaaaatccctgatccagatgcagtgaaacctgatgactgggatgaggatgcccccatggaaattgtggatgaggaagccaccaagcctgagggatggttggatgacgagcctgaggagattgatgatcctgaggcagccaagcccgaggactgggatgatgaggaggatggtgaatgggaggcgccaaagattgacaacccaaagtgtgaagaggcacctggatgcggtgagtggaagaggccaatgaagcagaatcctgcttacaagggcaagtggcatgcacctatgattgacaaccccaactacaaggggatctggaagcctcaggagatccccaaccctgagtactttgagcttgacaagcctgattttgatccaattgctgctattggtattgagatctggacaatgcaggatggcatcctgtttgacaatatcttgattgctgatgatgagaaggttgccacctccattctggagaagacctggaagcccaagtatgatgttgagaaggaaaaggagaaggctgaggaggctgctgctggtgcggatggtctttctgagttccagaagaagatttttgacgtcctgtacaagattgctgatgttccgttcttggcaccctacaagaccaagatcattgatgttatcgagaagggagagaagcagcccaacatcactattggcattttggtctccgttgtcatcgtgttcgttactgttctcttcaggatcctttttggtggcaagaagccagcggtacctgtgaaacccgcagctgaggcgaagaagcccaaagccacagagaccgacggtgctggaagcagtggtgacaaggatgagaaagaggacgaaaaggaggagacagcagccccacgtcggaggacccgcagggagacgtag

SEQ ID NO: 21169 - protein, 532 aa, Sorghum bicolor
  misc_feature: Ceres ANNOT ID no. 8700120
  misc_feature: Up-regulated in shoot tissues in response to methyl jasmonate treatment
  misc_feature: Down-regulated in root tissues in response to methyl jasmonate treatment
  misc_feature: Down-regulated in root tissues in response to salicylic acid treatment
  misc_feature (23)..(380): Pfam ID: Calreticulin Pfam Description: Calreticulin family
MGGRALLLLLVSALLVQIRASDPLLYEPFDEDFEGRWVVSKKDEYQGVWKHAKSDGHEDYGLLVSEKARKYAIIKELDEPVTLKDGTVVLQFEVRLQNGLECGGAYIKYIRPQDAGWDAKEFDNETPYTIMFGPDKCGSTNKVHFILKHKNPKTGKYVEHHLKFPPSVPYDKLSHVYTAILKPDNEVRILVDGEEKKKANFLSADDFEPALIPSKTIPDPDDKKPEDWDERAKIPDPDAVKPDDWDEDAPMEIVDEEATKPEGWLDDEPEEIDDPEAAKPEDWDDEEDGEWEAPKIDNPKCEEAPGCGEWKRPMKQNPAYKGKWHAPMIDNPNYKGIWKPQEIPNPEYFELDKPDFDPIAAIGIEIWTMQDGILFDNILIADDEKVATSILEKTWKPKYDVEKEKEKAEEAAAGADGLSEFQKKIFDVLYKIADVPFLAPYKTKIIDVIEKGEKQPNITIGILVSVVIVFVTVLFRILFGGKKPAVPVKPAAEAKKPKATETDGAGSSGDKDEKEDEKEETAAPRRRTRRET

SEQ ID NO: 21170 - DNA, 1347 bp, Sorghum bicolor
  misc_feature: Ceres ANNOT ID no. 8700223
  misc_feature: Up-regulated in shoot tissues in response to methyl jasmonate treatment
  misc_feature: Up-regulated in root tissues in response to methyl jasmonate treatment
  misc_feature: Up-regulated in shoot tissues in response to salicylic acid treatment
  misc_feature: Encodes the peptide sequence at SEQ ID NO 21171
atggcggcggcggcgtctcagccaccatcgtcagccgtgcgggtgcgcgggtgcggcggcgcggcgtctgtgtcgtcggcgcgccccttcacggggtcgccgcggggtagagtcgcggcgtcgattgggaaggggaggaagcggaggcgcgccatctcgtgctgctcgtctccggacgcagatggaccacgccccgccgcgccaccgacctccgcggcgccttcggacgggtcgatacagctctattcccagattgagagggtgatcacggaggcggcaaagcagtcccgggagggctggggttcgactggagattggaccgaagtcgagggagcgtgggtattgcgaccgaagtcctcggagccatcatttgttgtccactttgttggaggaatttttgtcggagccgctccccagatcacataccgcttcttccttgaatgtctcgcgaacaggggagctttggtgattgctacgccttatgcgagcggctttgaccatttcttcattgcagatgaagttcaatttaagtttgataggtgtttgagaaacttggatgagcctgtaaatgatatcccaacatttggtgttggacattccttgggatctgttatccacatgttgattggatcaagatatgctgtgcagcgaagtggaaatgtactgatgtcctttaacaacaaggaggcaagctccgcggttccactattttcacctgtaattgttcccatggcacaaagttttggcccgatactgtcccaattgacatcatatccaacaatccgatttggggcagaagcagccattaagcagcttgagaatctaagcccacctgtggttaagcaacttctacctttacttcaacaacttcctccgttgtatatggacttagtaaatgggagggaggacttcattccaaaaccagaagagacacgccgcctgataaaatcctactatgggatttctcggaatctcttaataaagttcaaagatgatcaaattgatgaaacctctacccttgcacaagtactaagctccgaagcagctattagctcgttgcttgatatgtcaattcgatcacttcctggggatcatgggctaccattgcaacaggttcttcctgatgttccaccagcaatggctgatgcagtgaaccgtggaggtgaacttctggcaaatctgacaatgggcacaccatgggaggctgttgctaaggaggttggtaccagtttgggtactgactcaggcattctacgagcacagatctcaaaagacattgaaactcttgttgatgtaattgcttcatggatatcttcaaattctggtccaagactacttcgcccatga

SEQ ID NO: 21171 - protein, 448 aa, Sorghum bicolor
  misc_feature: Ceres ANNOT ID no. 8700223
  misc_feature: Up-regulated in shoot tissues in response to methyl jasmonate treatment
  misc_feature: Up-regulated in root tissues in response to methyl jasmonate treatment
  misc_feature: Up-regulated in shoot tissues in response to salicylic acid treatment
MAAAASQPPSSAVRVRGCGGAASVSSARPFTGSPRGRVAASIGKGRKRRRAISCCSSPDADGPRPAAPPTSAAPSDGSIQLYSQIERVITEAAKQSREGWGSTGDWTEVEGAWVLRPKSSEPSFVVHFVGGIFVGAAPQITYRFFLECLANRGALVIATPYASGFDHFFIADEVQFKFDRCLRNLDEPVNDIPTFGVGHSLGSVIHMLIGSRYAVQRSGNVLMSFNNKEASSAVPLFSPVIVPMAQSFGPILSQLTSYPTIRFGAEAAIKQLENLSPPVVKQLLPLLQQLPPLYMDLVNGREDFIPKPEETRRLIKSYYGISRNLLIKFKDDQIDETSTLAQVLSSEAAISSLLDMSIRSLPGDHGLPLQQVLPDVPPAMADAVNRGGELLANLTMGTPWEAVAKEVGTSLGTDSGILRAQISKDIETLVDVIASWISSNSGPRLLRP

SEQ ID NO: 21172 - DNA, 1140 bp, Sorghum bicolor
  misc_feature: Ceres ANNOT ID no. 8700335
  misc_feature: Up-regulated in shoot tissues in response to salicylic acid treatment
  misc_feature: Up-regulated in root tissues in response to salicylic acid treatment
  misc_feature: Encodes the peptide sequence at SEQ ID NO 21173
atggccgtgtccggcgagaagcggccaccgccaccggccccggcctccggcggaacggcaaggaagaagcttatcctagcactgtttatctgtttctcggcgctgctgtacaagcagattcttcagccaccactgcccaagatcgccggctcgccgggcggccctccggtcacggcaaccaggacacggctcagcgacggcaggtacctggcctatctggaacacggcgtccccaaggagaaggccaagtacaagatcatctttgtccatggattcgactcgtgcagatacgacgcgcttccaatctccacggagcttgcacaagagctgggcgtttacctgttgtcctttgatcgccccggctacgccgagagcgacccgcacccgggcaggaccgagaagagcatcgccctcgacatcgccgagctcgccgacaacctgcagctcggcctcaagttctacctcgttggcttctccatgggcggcgagatcatgtggagctgcctcaagcacatcccacacaggctctccggcgtggccattctcgggccggtgggcaactactggtggtccggcttgccggcgaacgtgtcgcgggacgcctggtaccagcagctccctcaggaccagtgggcggtctgggtggcgcatcacctgccgtggctgacctactggtggaacagccagaggctcttcccggcctccagcgtcatcgcctacaaccctgccctcctgtcccaagaagacaagctgctcatggcaaagtttggctatagaacctacatgccgcagatcaggcagcagggggagcacgagtgcctgcaccgggacatgatggtcggcttcgggaaatggagctggagcccgctgcagctggagaacccgttcgccggcgctgatgatgatggccaggagggggcggggaaggtgcacctgtggcacggcgccgaggacctcgtggtgccggtcagcctgtccaggtacatcagcgagaagctgccgtgggtcgtctaccatgagctccccaagtcgggacatctcttcctgatcggtgacgggatggctgacaccattgtcaagtccctgctgctcggagacgatcatccgtcgtcggcctcagccctcacagcctcctcctga

SEQ ID NO: 21173 - protein, 379 aa, Sorghum bicolor
  misc_feature: Ceres ANNOT ID no. 8700335
  misc_feature: Up-regulated in shoot tissues in response to salicylic acid treatment
  misc_feature: Up-regulated in root tissues in response to salicylic acid treatment
  misc_feature (86)..(185): SWISSPROT Homolog: EC 3.1.1.2 Arylesterase
  misc_feature (312)..(346): SWISSPROT Homolog: EC 3.1.1.1 Carboxylesterase
  misc_feature (112)..(361): Pfam ID: Abhydrolase_1 Pfam Description: alpha/beta hydrolase fold
MAVSGEKRPPPPAPASGGTARKKLILALFICFSALLYKQILQPPLPKIAGSPGGPPVTATRTRLSDGRYLAYLEHGVPKEKAKYKIIFVHGFDSCRYDALPISTELAQELGVYLLSFDRPGYAESDPHPGRTEKSIALDIAELADNLQLGLKFYLVGFSMGGEIMWSCLKHIPHRLSGVAILGPVGNYWWSGLPANVSRDAWYQQLPQDQWAVWVAHHLPWLTYWWNSQRLFPASSVIAYNPALLSQEDKLLMAKFGYRTYMPQIRQQGEHECLHRDMMVGFGKWSWSPLQLENPFAGADDDGQEGAGKVHLWHGAEDLVVPVSLSRYISEKLPWVVYHELPKSGHLFLIGDGMADTIVKSLLLGDDHPSSASALTASS

SEQ ID NO: 21174 - DNA, 3291 bp, Sorghum bicolor
  misc_feature: Ceres ANNOT ID no. 8700697
  misc_feature: Down-regulated in root tissues in response to methyl jasmonate treatment
  misc_feature: Down-regulated in shoot tissues in response to methyl jasmonate treatment
  misc_feature: Down-regulated in shoot tissues in response to salicylic acid treatment
  misc_feature: Down-regulated in root tissues in response to salicylic acid treatment
  misc_feature: Encodes the peptide sequence at SEQ ID NO 21175
atggcgagcgacagcgacgtcgacgaggacgagctcctccagatggcgctgcaggagcaggcggcgcgggacctgagccaccagcgcccgcccgccgccaacaagcccgtcgtcaacctcgtccgcccacccgcccccaacgcccgcggcggcaagggcgccgcggcgaaggcgcgccagcccagccgcggcggcgacgaggacgacgactcggaggtcgagctgctctccatctcctccggcgacgaggacgacaacccccgcgcccgtggcccgccgccgccccgcgggggcgggggcgggcgcgccggggcgcggagggccgcgtcacgggacgacggggacttcgacgacgaggagcccaggagctggaagcgcgtcgacgaggctgagttgtgggttcgagaaatgcgagaagcaaaggtggctcccaacattcaagaacttgatcagaaagcagcagcagcagctgctgctgctcgaaaggccctcacgactgtacagactttaccaaaaggagttgaggttttggatccattggggcttggtgtcatggataataaatccctgcgattgatcactgatgcttcagtaagttctccagtttcaagggagaagtctcaaggtttagaccccagtatgcgagacaaagttatctattcgtctccaaattttgaccccaaagttttcctttcgtgggtccacaaagacacaagtgctgctgacttagaggctggtgctctcaccttgaaaactgatctcaaagggagaacacagcagaaaaaacagttagtcaaggagaactttgattgttttgtctcgtgcaaaactacaatagatgacattgagtcgaaattgagacagatagaggaagatcctgaaggtgcaggtactgctcacttgtattcagtgacacaaaaaattagtggtgtggcaaatcgtgcatttgagcctctatttgagaggcaggcccaagctgaaaagatcagatctgttcagggaatgcttcaaagattccggacactctttaacctaccaagtgcaatccgtgggaacattaggaaaggagaatatgatcttgctgtcagagagtaccaaaaagcaaagtcaattgttcttccttcccatgtggggatactaaaacgtgtacttgaagaggtcgaaaaggtgatgcaagaattcaggggcatgctttataagtcgatggaggatcctcatcttgaccttgctgagcttgagaacattgttcgtctactgttggagttggaacctgaaacagatccagtgtggcattatctaaatattcagaatagcaggattcatggattgtttgaaaagtgtactcaagatcatgaatcgagaatggaagttttgcaaaataaaattcatgaaaaagtgctctctgattcaaagtggaggcagctgcaacaagattcaaataaatctctggaagttgattctgccattggtgattctcctcgagctgatcagttgtcaacaaactttatggctgaggaagctgacagtttaagggccacctacattcgtaggctaacttctgtacttatccagcatgttccagctttctggagattagctttatctgttttcagtggaaaatttgccaaggcagcttctggtaatgtagtttctgattctgacatgaatgcaaagccggctgcaaataagaacgatgacaaaagtggagaagtaaagtacacaaaccacactctcgatgaagttgctagtatggttcgggctactatatcggcttttgacactaaggttcagagcaccttccgtgattttgaggaatgcaacattctttgtccatacatgagtgacactataaaagaaatcgctaaggcctgtcagactcttgaagggaaggattcgtctccaactgccgtaaaaatgttgcgcacccttcattttgaaatgacaaagctttacattctacggctttgttcatggatgcgggcaacaactaagaagatatcaaaagatgagacttgggttactttatccacccttgagagaaacaagtctccgtatgcaatttcatgcatgcctctggagttccgtgacataacaatttcagcaatggaccggattgatactatgattcttaatctgatgagcgagactgcgaagtcatatgacatttctcaaccacttcaggaaattaatgagtctgtcagacttgcatttttgaattcctttctggattttgctggttatctggagaggtttgtaggcgaactaactgagaacagaccaaataaagaaaacaattatgtccaaaatggatacataaatggtactagagaaacacctgctaacacagatggagatttgcacaagaagctgctggttgtcttgagtaacattggatattgtaaagctgagctttcagaagaactgtacaccaaatatagacacatttggtctccagtcaggaataatgatgagcgaagttctgacatgcgagatctgatgacttctttctctgcacttgaagagaaagtccttgaccaatatacttttgcaaagtcaaacttgatcagaagtgctgcacaaagttatcttttggattctgggatttattggggagcagcaccaatggtaaagggcattcgagatgcaactcttgacttactgcacatccttgtagccgtacatgcagaggtatactctggtgctcggcctttgttggagaagacaatgaaaattttggttgagggtttggtcgacatatttcttagtgtttttcatgagaataagaccaaagatattagattgttggatgcgaatggtttttgtcaactcatgcttgagcttgagtattttgagactgtactacaaacatacttctcacccgaggcacaacaggcaatgaaatccttacaagagaatttgttggagaaggcctgtgaaagtgttgcagaagccatggaaaatcctggacaccaacgtcgaccaacccgtggcagtgaagatacagcatcagatggacaaccatcggtatcacctgatgatttgcttgtgcttgctcaacagtacagtagtgatctactacaaggggagttggagaggactcgattgaacatagcctgcttcatggagtcaacccttcaatcaacaggcgcgccagcaggctcaaagcccggtgcatattcttcttaccaagcacaagtaccacagcacgcccctgttcaaacgtcctcgcctagttttagaaggcagcagactggtacaagttctcctgtagtctccaggcggcgccggtga

SEQ ID NO: 21175 - protein, 1096 aa, Sorghum bicolor
  misc_feature: Ceres ANNOT ID no. 8700697
  misc_feature: Down-regulated in root tissues in response to methyl jasmonate treatment
  misc_feature: Down-regulated in shoot tissues in response to methyl jasmonate treatment
  misc_feature: Down-regulated in shoot tissues in response to salicylic acid treatment
  misc_feature: Down-regulated in root tissues in response to salicylic acid treatment
MASDSDVDEDELLQMALQEQAARDLSHQRPPAANKPVVNLVRPPAPNARGGKGAAAKARQPSRGGDEDDDSEVELLSISSGDEDDNPRARGPPPPRGGGGGRAGARRAASRDDGDFDDEEPRSWKRVDEAELWVREMREAKVAPNIQELDQKAAAAAAAARKALTTVQTLPKGVEVLDPLGLGVMDNKSLRLITDASVSSPVSREKSQGLDPSMRDKVIYSSPNFDPKVFLSWVHKDTSAADLEAGALTLKTDLKGRTQQKKQLVKENFDCFVSCKTTIDDIESKLRQIEEDPEGAGTAHLYSVTQKISGVANRAFEPLFERQAQAEKIRSVQGMLQRFRTLFNLPSAIRGNIRKGEYDLAVREYQKAKSIVLPSHVGILKRVLEEVEKVMQEFRGMLYKSMEDPHLDLAELENIVRLLLELEPETDPVWHYLNIQNSRIHGLFEKCTQDHESRMEVLQNKIHEKVLSDSKWRQLQQDSNKSLEVDSAIGDSPRADQLSTNFMAEEADSLRATYIRRLTSVLIQHVPAFWRLALSVFSGKFAKAASGNVVSDSDMNAKPAANKNDDKSGEVKYTNHTLDEVASMVRATISAFDTKVQSTFRDFEECNILCPYMSDTIKEIAKACQTLEGKDSSPTAVKMLRTLHFEMTKLYILRLCSWMRATTKKISKDETWVTLSTLERNKSPYAISCMPLEFRDITISAMDRIDTMILNLMSETAKSYDISQPLQEINESVRLAFLNSFLDFAGYLERFVGELTENRPNKENNYVQNGYINGTRETPANTDGDLHKKLLVVLSNIGYCKAELSEELYTKYRHIWSPVRNNDERSSDMRDLMTSFSALEEKVLDQYTFAKSNLIRSAAQSYLLDSGIYWGAAPMVKGIRDATLDLLHILVAVHAEVYSGARPLLEKTMKILVEGLVDIFLSVFHENKTKDIRLLDANGFCQLMLELEYFETVLQTYFSPEAQQAMKSLQENLLEKACESVAEAMENPGHQRRPTRGSEDTASDGQPSVSPDDLLVLAQQYSSDLLQGELERTRLNIACFMESTLQSTGAPAGSKPGAYSSYQAQVPQHAPVQTSSPSFRRQQTGTSSPVVSRRRR

SEQ ID NO: 21176 - DNA, 2328 bp, Sorghum bicolor
  misc_feature: Ceres ANNOT ID no. 8700810
  misc_feature: Up-regulated in shoot tissues in response to salicylic acid treatment
  misc_feature: Encodes the peptide sequence at SEQ ID NO 21177
atggcgagcgccaagacgaagctgcagctgcagctgcaggagagggtcccgctcccccgcacggcgtggaagctggccgacctcgccgttctcttcctgctcctggccctcctcgctcaccgtgtgtcctcgctgatggtggccgtcggcggcggcggcggcgcggcgtggtgctgtgtcgccgcgctcatctgcgaggcgtggttcacggtggtgtggctcctcaacatgaacgccaaatggaacccggtccgcttcgacacgcaccctgaacgcctcgccgaacggatgagcgacggcgagcttccggcggtggacatgttcgtgacgacggcggacccgaagctggagccgccgctggtgacggtgaacacggtgctgtcgctgctagcgctggactaccccgcaggcaagctgtcctgctacgtctccgacgacgggtgctcggcggcgacctgctacgcgctgcgcgaggccgccgagttcgccaagctctgggtgcccttctgcatgaagcacggcgtcaaggtcagggcccccttcgtctacttctccgagcgtggcggggccgcagccgacgacgacgacgctgagttcttgcgcgcttggacgtccatgaagaacgagtacgaggagttggtccgccggatcgagaacgccgaggagtctctagtccggcgcggcgacggcgagttcgctgagttcgtgggtgctgaccgcaggaatcacccgaccataatcaaggtcctgatgtgggacaacagcagcaacgacgacagcaagaatgctgcaggcgatggaataatcccaagcctcatatacgtctcgcgggagaagagacccacacagcaccactacttcaaggccggtgccatgaacgtcctgacgagggtgtccggcgtggtgaccaacgcgcccatcatgctgaacgtggactgcgacatgttcgccaacaacccgcaggtggcactccacgccatgtgcctcctcctgggcttcgacgacgagctccacagcggcttcgttcaggcgccgcagaagttctacggcggcctcaaggacgatcctttcggcaaccagatgcaggtcatatacgagaaagttggatttggagttgccggacttcaaggcatattttacggcgggacaggttgctttcaccgtaggaaagtcatctacggcgtgccaccagactccaccaccaccatcggcatcaaagattcaccatcttacaaggagctgcataagaagtttggcagctcgaaagaactgatcgagtcggcgaggagcatcatttcaggggacatgttcagaacaccaactgaggttgtggcagacctaacgagtctcatcgaagcagccaaacaagtctccgcctgcagctacgagaccggcacgagctggggtcaggaggtcggctgggtctacgggtccatgaccgaggacgtcctgacggggcaacgcatccacgccgccggctggaggacggcgttgttgaaccccgacccgccggcgttcctcggcggcgcgcccaccggcggacccggcagcctcacccagtacaagaggtgggcgacgggcctgctggagatactcctcagccgccataacccgttccttctcgccgcgttcaagcgcctcgatctccggcagtgcgtcgcctacctagtcatcgacgtgtgggccattagggcaccctttgagctgtgctacgcgttgctcggaccttactgcgtcatcgcaaaccactccttcctgccaaaggcgtcagaaccgggtttcgtcatcctgctggccctgttcctaggttacaacgtgtacaacctgggcgagtacaaggactgccggctctcggtgcgcgcctggtggaacaaccaccggatgcagcggatcgtgtcgtcctccgcctggctgctcgcgttcctcaccgtcgtcctcaagacgctcggcctctcggagacggtgttcgaggtgacgcgcaaggagcagcagagcacgtctgatggtggtgcggacgccgtcgccgacccggggcggttcacctttgactcgtcgccggtgttcatcccgccgacagcgctcacgatgctgagcatcgtcgccgtcgtctttggggcgtggaggctggtcgccggtgagggggaaggcgtgcccagtcccagtggcccgggcgtcggggagttcgtgtgctgcggttggctggtgctctgcttctggccgttcgtgagggggctcgtcagcaagggaagctacggcatcccctggaacgtcaggctcaaggctgccctgcttgtagccgcgttcgtgcacttgtccacatggaagtaa

SEQ ID NO: 21177 - protein, 775 aa, Sorghum bicolor
  misc_feature: Ceres ANNOT ID no. 8700810
  misc_feature: Up-regulated in shoot tissues in response to salicylic acid treatment
  misc_feature (63)..(394): SWISSPROT Homolog: EC 2.4.1.12 Cellulose synthase (UDP-forming)
  misc_feature (11)..(775): Pfam ID: Cellulose_synt Pfam Description: Cellulose synthase
MASAKTKLQLQLQERVPLPRTAWKLADLAVLFLLLALLAHRVSSLMVAVGGGGGAAWCCVAALICEAWFTVVWLLNMNAKWNPVRFDTHPERLAERMSDGELPAVDMFVTTADPKLEPPLVTVNTVLSLLALDYPAGKLSCYVSDDGCSAATCYALREAAEFAKLWVPFCMKHGVKVRAPFVYFSERGGAAADDDDAEFLRAWTSMKNEYEELVRRIENAEESLVRRGDGEFAEFVGADRRNHPTIIKVLMWDNSSNDDSKNAAGDGIIPSLIYVSREKRPTQHHYFKAGAMNVLTRVSGVVTNAPIMLNVDCDMFANNPQVALHAMCLLLGFDDELHSGFVQAPQKFYGGLKDDPFGNQMQVIYEKVGFGVAGLQGIFYGGTGCFHRRKVIYGVPPDSTTTIGIKDSPSYKELHKKFGSSKELIESARSIISGDMFRTPTEVVADLTSLIEAAKQVSACSYETGTSWGQEVGWVYGSMTEDVLTGQRIHAAGWRTALLNPDPPAFLGGAPTGGPGSLTQYKRWATGLLEILLSRHNPFLLAAFKRLDLRQCVAYLVIDVWAIRAPFELCYALLGPYCVIANHSFLPKASEPGFVILLALFLGYNVYNLGEYKDCRLSVRAWWNNHRMQRIVSSSAWLLAFLTVVLKTLGLSETVFEVTRKEQQSTSDGGADAVADPGRFTFDSSPVFIPPTALTMLSIVAVVFGAWRLVAGEGEGVPSPSGPGVGEFVCCGWLVLCFWPFVRGLVSKGSYGIPWNVRLKAALLVAAFVHLSTWK

SEQ ID NO: 21178 - DNA, 1833 bp, Sorghum bicolor
  misc_feature: Ceres ANNOT ID no. 8700864
  misc_feature: Down-regulated in root tissues in response to salicylic acid treatment
  misc_feature: Encodes the peptide sequence at SEQ ID NO 21179
atggaggacatcgaggacgtgctgggtccggccgacctctctggcggcggagcgcctccggggctccggctcccgctagccgccgtcgcggtgaagcccaagcgacggtcgtccagggtcgcgcaggcgccgcctcagcccgaggcccggatccccggcacgcagagtgacagtgaatacatgtcaggtcagctctctgcatttggatatgcgatcactgaagagcccgaaggagcagatttgtggctaattaacacatgcacagtgaaaaatccaagtcaatctgcaatgacaaccctcatatctaaatgcaagaatgcaaacaagccactagtagtggctggatgtgtaccccaaggaagccagggcctcaaggagcttgaaggtattagtataattggagtgcaacagatagaccgggttgttgaagtggttgaggaaactttaaagggccatgaggttcggctgttgagtcggaaaacactgccctcgcttgatttacctaaggtaagaaagaacaagtttatcgagattcttcctattaatgtgggatgtttaggtgcctgcacatactgtaagacaaagcatgctcgtggtcatttgggaagctatactattgacagcttggtggatcgtgtgaaaactgttgtctccgaaggtgtcagggagatctggttgagcagcgaagatactggtgcttatggacgggatatcagtacgaaccttcccaatttgttaaatgcgattgttgcagagcttcctgttgaccaaagcacaatgctccgcataggcatgacaaatcctcctttcatactagagcatttgaaggagatagctgccgttttgtgtcatccctgcgtttactctttcctccatgttcctgtgcaatctggaagcgatgctgttttaacggcaatgaatcgtgaatacactgttgctgagttcagaaaggtagttgacactctgtatgagcttgtccctggaatgcaaattgctacagacattatctgtggctttcctggcgagactgatgaagatttctctgagactgttaacctcgtaaaggaatatcaattccctcaagttcacatttcacagttttacccgaggccagggacacctgctgctaggatgaagaaagtaccaagcaatgaagtgaaaaagcggagtcgtgaactgacttcagttttcgaattattttcaccataccaaggaatggaaggcaaagtagagaggatctggatcaccgagattgcgactgatggtgttcacttagttggacataccaagggatatatccaggttctggtaattgctcctgatagcttgttaggaacgtcagcaaatgtgaagatcacatctgttggacgatggtctgtctttggtgaagtgatagaaggatctgttgtagtaggagaagcaccaaagcaaactagtgccaaactgcagaaagaacacatacagaatcaggtggaggaagctggttgttgtgccactgactcttgtggcacctgtgcatgctccaatgaggcacagcagtgcagtccagaacgatgtgaagacacatctcatgctccggagacctgtggtgatgttactcgtcaggaggcactccagcctacgcttgtgaggagaagcgtagagggaactacgaaaggaagtaaaagcagtgcagcacattcactagggaaggaacagcaggtgaaagtagtaactaggagaggggtaaatatcgacacgattttgtggtgcggtttggccgtcagcttcgccgtaacgatagccctgcttgtaatccttaccagcaagatttcatcgacatcgtccccctag

SEQ ID NO: 21179 - protein, 610 aa, Sorghum bicolor
  misc_feature: Ceres ANNOT ID no. 8700864
  misc_feature: Down-regulated in root tissues in response to salicylic acid treatment
  misc_feature (179)..(354): Pfam ID: Radical_SAM Pfam Description: Radical SAM superfamily
MEDIEDVLGPADLSGGGAPPGLRLPLAAVAVKPKRRSSRVAQAPPQPEARIPGTQSDSEYMSGQLSAFGYAITEEPEGADLWLINTCTVKNPSQSAMTTLISKCKNANKPLVVAGCVPQGSQGLKELEGISIIGVQQIDRVVEVVEETLKGHEVRLLSRKTLPSLDLPKVRKNKFIEILPINVGCLGACTYCKTKHARGHLGSYTIDSLVDRVKTVVSEGVREIWLSSEDTGAYGRDISTNLPNLLNAIVAELPVDQSTMLRIGMTNPPFILEHLKEIAAVLCHPCVYSFLHVPVQSGSDAVLTAMNREYTVAEFRKVVDTLYELVPGMQIATDIICGFPGETDEDFSETVNLVKEYQFPQVHISQFYPRPGTPAARMKKVPSNEVKKRSRELTSVFELFSPYQGMEGKVERIWITEIATDGVHLVGHTKGYIQVLVIAPDSLLGTSANVKITSVGRWSVFGEVIEGSVVVGEAPKQTSAKLQKEHIQNQVEEAGCCATDSCGTCACSNEAQQCSPERCEDTSHAPETCGDVTRQEALQPTLVRRSVEGTTKGSKSSAAHSLGKEQQVKVVTRRGVNIDTILWCGLAVSFAVTIALLVILTSKISSTSSP

SEQ ID NO: 21180 - DNA, 810 bp, Sorghum bicolor
  misc_feature: Ceres ANNOT ID no. 8700915
  misc_feature: Down-regulated in shoot tissues in response to salicylic acid treatment
  misc_feature: Encodes the peptide sequence at SEQ ID NO 21181
atgcccgccaatcgttcgtcggaatgtcccagcggtgatgaggaggtgggagatgatttcactgacgagttggaggagaacgaggaggtggaagatggggatgacttcgacgccgacgaagaagaagaaggcgatataatggacgatgatgaagagtttgaagacgactataactttgaagatgattttgagagtgatgatgaacaggatctttatgctggagatggaggtgctggtggcggaatatcccttgctggcacatggtgggacaaggaagcattagctttggcagaacaggtctcagcatcattcgatgatgacttgaaaatctatgctttcaagacagctgcaaatttgaccattagagtacgcattgagaagatgtccaccaggtacggttctccaactatagatgacattgaagcttacacaattgcataccgtgcaaagttggacgatgcagagtcaacaggaaagataccaaagaacatatcgttggaggtgtcatcccctggcgtggagagagttatccgtatccctgaagagcttgagcgcttcaaagaacgggcaatgtatgtcagatacactacaacaagcgatgaggcagctacgcctcaggaaggcgatggcgtgctgaggctaatctcctatgacatggacctgcgagagtgcatctggggcatagctgacgtgaagataaaccggcagcagtctggcaagggcaggcccctgagcaagaagcagagggaatggaggctgcagacaccgtttgagtcgctgaagttggtcaggctgtactctgaatgttga

SEQ ID NO: 21181 - protein, 269 aa, Sorghum bicolor
  misc_feature: Ceres ANNOT ID no. 8700915
  misc_feature: Down-regulated in shoot tissues in response to salicylic acid treatment
MPANRSSECPSGDEEVGDDFTDELEENEEVEDGDDFDADEEEEGDIMDDDEEFEDDYNFEDDFESDDEQDLYAGDGGAGGGISLAGTWWDKEALALAEQVSASFDDDLKIYAFKTAANLTIRVRIEKMSTRYGSPTIDDIEAYTIAYRAKLDDAESTGKIPKNISLEVSSPGVERVIRIPEELERFKERAMYVRYTTTSDEAATPQEGDGVLRLISYDMDLRECIWGIADVKINRQQSGKGRPLSKKQREWRLQTPFESLKLVRLYSEC

SEQ ID NO: 21182 - DNA, 2016 bp, Sorghum bicolor
  misc_feature: Ceres ANNOT ID no. 8700912
  misc_feature: Up-regulated in root tissues in response to salicylic acid treatment
  misc_feature: Up-regulated in shoot tissues in response to salicylic acid treatment
  misc_feature: Encodes the peptide sequence at SEQ ID NO 21183
atgcccgcgtggtggccccgcagcaagctgaggtcgaggtcgaaggccaagccgggggccgccgggtccgtctccgcagcgtcgtccccgcgcaagtccgtggacctcgagtcgccctccccgtccccgtcgccgacgcagcgggacaggaaggcgcacagcctcgacttccccggcgcgggcgcgggcgcggcgggccccgcgcgcggccggtgcgccgcggcggggcatcatgggtcggtagggtacaagctcccgatgcccgtggaggcgacggagcctgtcgggactctgtacgaggaggtgctggcggcggcggcggcggccggtgacggctgctcgtccgcggaggagtccagcgtgtgctcggccgggtcgttggacgagccgcactaccagcatgggtttaggcccatggatccagttgcttttgcgagggaaagaaatatgccttctgattcggataggaccgtaaatgaagacaagcgtttcatgtcttgtagtatgccacgggagcatcagaagttctttgaggttcctgtgtctagtgttagagaacttcatttgcaaagtgatgaaccttcaactagtgaagccaatcattcacgtggaagaatgacatctgatgatctctttgctccaagaacaaggagtctctctcctgtcccaaaaggccatgtcttcgctgtgagcaatggaaattctagagaatttggttttagcccgaggtcaccagtaagaaagatggatgggttgaggagcccaccacatcccttacctcttcctccatcccagtcgcaatggaagaaaggaaaattgctagggagtggtacatttggccaggtttaccttggatttaacagtgaaaatggacagttttgtgcaattaaggaggttgaagttattatggacgatccacattcaaaggaacgactcaaacaattaaatcaggaaatagatatgcttagacaactctcccacccgaacatagtgcagtatcatggaagtgagctgagtgatgaagcactttccatttatcttgagtatgtttcagggggttcaatccacaagttactaagagaatatggcccttttaaggaacctgtgattcgtaattacactgggcaaattcttgcaggtcttgcctacttgcatgggcgaaacactgtccacagagatatcaaaggagcaaacatacttgtgggtcctaatggtgaagtcaagcttgctgactttggcatggctaagcatatatcatcttttgctgaaatacgctctttcaaaggaagtccttactggatggctcctgaggttataatgaacagtaaaggctacagtttatcagtggacatttggagtctgggctgtaccattattgaaatggcaacggcaagacctccttggcaccaatatgagggggtagcagcaatatttaagattgcaaacagtaaagatatacctgaaatcccagacagtttctcagaggaagggaaaagtttcttgcagctttgcttgaaacgcaaccctgcatctcgtccctctgcagcccagctgatggatcatccttttgttcaggatcatcctgcagtgagagctgcaaaatccagtgtattgagaaacgcaatgtcttctccagcagatggcagacacacaatgtccaacagggagttgccatctcggaagattattactcctctgaaagatattgcactgagcatgcgagattttactggattttctactgctgttacttctccacacagccctattcctggaagagcaaacatgtctacgccagtttcaccatgctcaagcccgctgcggcagtttaagcaaaccaacgcgaggtgcatgcgttctccacctcatccaatgctctcccctggtcttggcaacacattaagttacacgcaaaatcagacaagacgcattccagctcctgccatttcagatccttggctggatgttggccagatgaaactccaaacccccaatatttcccccaaaaggttctga

SEQ ID NO: 21183 - protein, 671 aa, Sorghum bicolor
  misc_feature: Ceres ANNOT ID no. 8700912
  misc_feature: Up-regulated in root tissues in response to salicylic acid treatment
  misc_feature: Up-regulated in shoot tissues in response to salicylic acid treatment
  misc_feature (268)..(545): SWISSPROT Homolog: EC 2.7.11.25 Mitogen-activated protein kinase kinase kinase
  misc_feature (268)..(524): Pfam ID: Pkinase Pfam Description: Protein kinase domain
MPAWWPRSKLRSRSKAKPGAAGSVSAASSPRKSVDLESPSPSPSPTQRDRKAHSLDFPGAGAGAAGPARGRCAAAGHHGSVGYKLPMPVEATEPVGTLYEEVLAAAAAAGDGCSSAEESSVCSAGSLDEPHYQHGFRPMDPVAFARERNMPSDSDRTVNEDKRFMSCSMPREHQKFFEVPVSSVRELHLQSDEPSTSEANHSRGRMTSDDLFAPRTRSLSPVPKGHVFAVSNGNSREFGFSPRSPVRKMDGLRSPPHPLPLPPSQSQWKKGKLLGSGTFGQVYLGFNSENGQFCAIKEVEVIMDDPHSKERLKQLNQEIDMLRQLSHPNIVQYHGSELSDEALSIYLEYVSGGSIHKLLREYGPFKEPVIRNYTGQILAGLAYLHGRNTVHRDIKGANILVGPNGEVKLADFGMAKHISSFAEIRSFKGSPYWMAPEVIMNSKGYSLSVDIWSLGCTIIEMATARPPWHQYEGVAAIFKIANSKDIPEIPDSFSEEGKSFLQLCLKRNPASRPSAAQLMDHPFVQDHPAVRAAKSSVLRNAMSSPADGRHTMSNRELPSRKIITPLKDIALSMRDFTGFSTAVTSPHSPIPGRANMSTPVSPCSSPLRQFKQTNARCMRSPPHPMLSPGLGNTLSYTQNQTRRIPAPAISDPWLDVGQMKLQTPNISPKRF

SEQ ID NO: 21184 - DNA, 3372 bp, Sorghum bicolor
  misc_feature: Ceres ANNOT ID no. 8700926
  misc_feature: Up-regulated in root tissues in response to salicylic acid treatment
  misc_feature: Encodes the peptide sequence at SEQ ID NO 21185
atggagataccagcggaggaaggactggcggcggcggcgagggcgccgccgcggcggattaggaggaggctggtggagggggcgcgcggcgccggggccccggcgagcgtggaggagatcgaggccaggctcagggaggccgagctccggaggcagcaattccatgaatggttggcctgcaaagcaaggaagaagccacggagtccatcgtggtcctctcaagaggaagaccacgggcagcgccttgaagcaaaacttctggctgctgagcagaaaaggttaagcctcttggcgaaggcacagaaccgtctggccaagctggatgaactccgacaagctgctaagaatgatgtggaaatgcggtttgagaaggaaagggaagaacttgagaccagagttgagtctcgtgtccgacaggcagaggagaaccgcatgcgccttctgcatgccgatatgcagaagcgggctgcactgaaggagaggacagcgaggtccctggtgcagaaggcaacatcagagagcaaatacatggagcaggtgcggtctgcaatttcacaaaagagagctgctgctgagaagaagcgactgaggttgctggaagctgaaaagacaaaggctcaggctaggcttttgcgcatccaaaaggctgccatgactgtatgcagccagagagaatcggagaggagaaaactgaaagaacagctggataacaaacttcaaagggcgaagaggcagagggctgagtatttgaagcagagaggaagtcctcgtggttcaacccacgctgattacataaagcatgcagatgccctctcaagaaaactagcaagaaactggagaatatttgtgaagtccaggaagacaacatttgctttggttcaagcttatgatgccttggggattaatgagaagtctgtgaaaagtatgccttttgaaaaattagccatgtcaatggaatctcctatggttcttcagagcacaaaggcattacttgaccgattggagaaacgccttgtcatttctcagtcagtagcatcttcatcagtagaaaatgttgatcatctactgaaacgccttggttctcccccaaggaggaaggctcctcttagcagagaaggaaaaactcgggcagtggtaaaaagatcagctaaaagttctgaagcaaacagcagattgcccaggtactcactgagggtcgtgctctgcgcttacatgatactggctcatcccagtgctgttttaagtgggcaaggcgagcgggagagacaacttatcgagtcagcagcaaactttatcaaggagttcgaactgttgattaagacaatacttgatggaccagggcagtcatctgatgttactggccagaggaagttcagaattcagttggctaattttgacaaggcgtggtgcacgtatctttaccgctttgtggtgtggaaggtaaaagatgcaagattattggaggaagatcttgtcagggctgcatgcaagcttgagctgtcaatgatgcaaacatgcaagctaactgcagatgggcactcgccaaacaatcttactcatgacatgaaggcaattcagaaacaggttactgatgatcagaagcttttacgtgagaaggttcagcacctgagtggtgatgctggccttgagaggatggactctgctcttttggatacgagatcaaagttctttgaagcaaaagagaatgggagtccattggcagcacctgttgcaaatgtatctacccctttgagcattaattcatctgtgaaggtcccactttctgaggttaatgaaagttccaggacaaatgctgttggaacaagctctgttgtacgttctctatttggtgcttcatcatcagtcggttcatcaccagcaaagcagccgacagagaatgaacaaatggtcaatgagatgcttcatgaggatgccagtgcttttgctggcaggtctgatagtgctagtactgtggaggaggagttccagaagaaagtgagagaaaccatggagaaagctttctgggatatggtcaccaactccatgagaggagaaagacctgattatagtcaattgatcaacctagtaaaggaagtgagagattcgttgcatgacctggctccaaaagaatggaaggagaaaattcttgagaacattgaccttgaaattctgtctcaggtacttgggtcaggttcccaggatgcacaatacctggggcagattttgcagtattctctggatatggttcgccagctctctgctgctgcaaaggaggatgagatgaagaaaaatcatgataaattattgagtgagttgtctacaaattctgaagttaatgacaatggcatcaactcatttgccattgctgttatcaagggcctgcgtttcatcctggaagaaataaaggaactgcaagcagaagtgagtaaagcacgtgtccagatgatgcaacagatcataaaagaatcggctggggtggagtacctgcagaaggctttcgctgatcgctatggaccccctgagaatgcatcagcttctcttcccctaactctgcaatggattatgacatcaaataacattgtggaagtagaatggagtgaacattcagactgtctttcaataatgcaatcagcaggacaggctcctgctcttgttccggtacttcgagctggtcatggaactctagtagggcaaccatcttcttctgcagcagacacctctgttcaaccagagtgcaagggtgagaagcttgacaagctgataaggattggcctgctgcaacttattagtagtatggagggcttgcaattgcagtcaattcctgaaagttttcagattaatctcctgaggctgagggctgtgcagagccaattccaacaggtgatcgtgattgccacaagcatgctcgtcctgcgccaagttctgatgagtgagaactcgaaggccactcctctggaactggaaaacgctatctcagaactcttcaaggctctcgtgaacatactggacaactcacctgatgccggcacggaagagattgtgcaggcgatggtcaatgcatcagcctcagttggctcaccatcagaggagaaggttcaggccaggatgcagatgatcaccagggtgttcctcaagagtctccagcctggtgacgtggtcttcaagaaggtctcccgcgctgtctactgtgccttccgtggcatcatcttaggtggcagtggtcccaagggccagaagctggcggacgcggctttgcgccgcattggcgcggccaaggttatggacagggtgttgaaggctgctgaggtgctgatcaagatggcaacggtatcagagaaggtccacggcccgtggtacaaagctctggtgtga

SEQ ID NO: 21185 - protein, 1123 aa, Sorghum bicolor
  misc_feature: Ceres ANNOT ID no. 8700926
  misc_feature: Up-regulated in root tissues in response to salicylic acid treatment
  misc_feature (639)..(1122): Pfam ID: Tcp11 Pfam Description: T-complex protein 11
MEIPAEEGLAAAARAPPRRIRRRLVEGARGAGAPASVEEIEARLREAELRRQQFHEWLACKARKKPRSPSWSSQEEDHGQRLEAKLLAAEQKRLSLLAKAQNRLAKLDELRQAAKNDVEMRFEKEREELETRVESRVRQAEENRMRLLHADMQKRAALKERTARSLVQKATSESKYMEQVRSAISQKRAAAEKKRLRLLEAEKTKAQARLLRIQKAAMTVCSQRESERRKLKEQLDNKLQRAKRQRAEYLKQRGSPRGSTHADYIKHADALSRKLARNWRIFVKSRKTTFALVQAYDALGINEKSVKSMPFEKLAMSMESPMVLQSTKALLDRLEKRLVISQSVASSSVENVDHLLKRLGSPPRRKAPLSREGKTRAVVKRSAKSSEANSRLPRYSLRVVLCAYMILAHPSAVLSGQGERERQLIESAANFIKEFELLIKTILDGPGQSSDVTGQRKFRIQLANFDKAWCTYLYRFVVWKVKDARLLEEDLVRAACKLELSMMQTCKLTADGHSPNNLTHDMKAIQKQVTDDQKLLREKVQHLSGDAGLERMDSALLDTRSKFFEAKENGSPLAAPVANVSTPLSINSSVKVPLSEVNESSRTNAVGTSSVVRSLFGASSSVGSSPAKQPTENEQMVNEMLHEDASAFAGRSDSASTVEEEFQKKVRETMEKAFWDMVTNSMRGERPDYSQLINLVKEVRDSLHDLAPKEWKEKILENIDLEILSQVLGSGSQDAQYLGQILQYSLDMVRQLSAAAKEDEMKKNHDKLLSELSTNSEVNDNGINSFAIAVIKGLRFILEEIKELQAEVSKARVQMMQQIIKESAGVEYLQKAFADRYGPPENASASLPLTLQWIMTSNNIVEVEWSEHSDCLSIMQSAGQAPALVPVLRAGHGTLVGQPSSSAADTSVQPECKGEKLDKLIRIGLLQLISSMEGLQLQSIPESFQINLLRLRAVQSQFQQVIVIATSMLVLRQVLMSENSKATPLELENAISELFKALVNILDNSPDAGTEEIVQAMVNASASVGSPSEEKVQARMQMITRVFLKSLQPGDVVFKKVSRAVYCAFRGIILGGSGPKGQKLADAALRRIGAAKVMDRVLKAAEVLIKMATVSEKVHGPWYKALV

SEQ ID NO: 21186 - DNA, 1287 bp, Sorghum bicolor
  misc_feature: Ceres ANNOT ID no. 8700930
  misc_feature: Down-regulated in shoot tissues in response to salicylic acid treatment
  misc_feature: Encodes the peptide sequence at SEQ ID NO 21187
atggagagcctcgtcctcgcctcctcctgctccgcgtccccacggctcccgctaatctcctccgccgcccgcttccggaggctgcccggctccgtgccgccgccgacggtggcggcggcgtccaccggcggtgccgcgcggaaagggcccaggaggcccaggctcttcgtcgtcgccgccgcggctcctcgcggatccgggaacgttttcgagggattgagagcaaaaggctttgcaagcgtgtcatcttcgactggcaatgagaatatgtctactggaaccggtaccctgcctcccgtgcctcccccatcatcatactttggttcacctgttttctggattggagttggtgtagcattgtctgtggcgtttaccacggtctcttccatggtaaagagatatgccatggaacaagcatttaagtcaatgatgacccaggcaccaccaaactcatttggctccaactcgcctttcccatttggcatgccaccacaggcatctcctactgcaccaagcagttttccgtacttggaaccaaagaaagatacctccccacaggtgtcaactgttgatgtctcagctaccgaagtggaagctgctggaacatcgaaagaggtggatgtgactgaaactccagagccttcaaagaaatttgcatttgttgatgtttctcccgaagagttgcagcaaaagaacctccaatcttcactggagacagtagatgtaaaacatgatagtacagacagtgaaagtaaggaggatattgaggaaaaagttcttcccacaaatggagcgacttttaagccgaatgaagatgctgctcgtgggccaactgaacctattgagacaattgagaaaatgatggaagatccaactgtgcagaagatggtgtatccctacttgcctgaagagatgaggaacccagattcgttcaagtggatgctgcagaatccaatgtaccgtcaacaactacaggatatgctaaataacatgggtgcatctcctgatcaatgggataaccgcatggttgatcacctgaagaactttgacctcagcagtccagaagtgcggcagcagtttgcgcaagttggcatgactcccgaggaagtggtatcgaaaataatggcaaacccagatgtagctgttgcattccagaatccaaaaatacagacagccatcatggactgttcgcagaaccctctaaacattgtaaaataccaaaacgacaaggaggtcatggacgttttcatgaagatatcacaaatcttcccacaaattaacggctag

SEQ ID NO: 21187 - protein, 428 aa, Sorghum bicolor
  misc_feature: Ceres ANNOT ID no. 8700930
  misc_feature: Down-regulated in shoot tissues in response to salicylic acid treatment
MESLVLASSCSASPRLPLISSAARFRRLPGSVPPPTVAAASTGGAARKGPRRPRLFVVAAAAPRGSGNVFEGLRAKGFASVSSSTGNENMSTGTGTLPPVPPPSSYFGSPVFWIGVGVALSVAFTTVSSMVKRYAMEQAFKSMMTQAPPNSFGSNSPFPFGMPPQASPTAPSSFPYLEPKKDTSPQVSTVDVSATEVEAAGTSKEVDVTETPEPSKKFAFVDVSPEELQQKNLQSSLETVDVKHDSTDSESKEDIEEKVLPTNGATFKPNEDAARGPTEPIETIEKMMEDPTVQKMVYPYLPEEMRNPDSFKWMLQNPMYRQQLQDMLNNMGASPDQWDNRMVDHLKNFDLSSPEVRQQFAQVGMTPEEVVSKIMANPDVAVAFQNPKIQTAIMDCSQNPLNIVKYQNDKEVMDVFMKISQIFPQING

SEQ ID NO: 21188 - DNA, 1959 bp, Sorghum bicolor
  misc_feature: Ceres ANNOT ID no. 8701023
  misc_feature: Down-regulated in shoot tissues in response to salicylic acid treatment
  misc_feature: Encodes the peptide sequence at SEQ ID NO 21189
atgcagaggcaggggcggcacctggagcggtccaactcgaagcgagcgctcgaccatggcgccggcggtgacgacgacgaccgcccgtctaagcgcccgcgtgtccccgcgctcgccagtgtcattgtagaagcactcaaggtagacagtttacagaagctttgctcatcactggagccaattctgcgcagagttgtcagtgaagaagtagagcgtgctttagccaaattgggtcctgcaggtcctgctaggatccaaggaaggagctctcccaaacgaattgaaggccctgatggtagaaacctccagcttcagtttaggactaggttatcccttccactctttactggaggcaaagtagaaggcgagcagggagcagcaattcatgttgtgctgcttgatgcgaacactggacatgttgtcacttcaggacccgagtcatctgtgaaactggacattctggtacttgagggtgattttaataaagaggaagacgagggttggaccgaagaagactttgaaagtcacattgttaaagaacgagaaggcaagagacctcttttaactggagacctgcagataacccttaaagaaggtgttgggactataggagagcttattttcactgacaattccagctggataagaagccgaaaatttagacttgggttgagagtctcctcagggttctgtgaaggaattcgtgttatggaagcaaaaacagaggcttttactgttaaagatcacagaggcgaattgtataagaagcactatcctcctgcactaaaggatgaggtatggagattagaaaagattggaaaggatggttcattccacaagagattaaactcaagtggaatctatacagttgaacactttcttcaattccttgttagagaccaacagaaattaagaagtattcttggcagtaacatgtcaaataggatgtgggaaagtcttattgagcacgcaaagacatgtgttttgagtggcaaccattatatatattactcaagtgatgcaagaagtgtgggtgcaatattcaacaacatatatgagttcactggtttgattgctgatgatcaattcatttcagctgaaaatctcactgaaaaccagagggtgtttgctgacacattggttaagcaagcatatgatgattggatcaatgctgtagaatatgatggcaaggcgctgttgagtttcaagcagacaaagaaaactgttacaactagaagtgaaacagcgaaagcttcagcaagctaccctgcatcaaacgatttaatgaactcacagaaacaactggctggaggtcctgtaaatactgagcaatcttccctgaagaataccagagaagcaggtggaactggaatcccatccatggggaaccaggtagcaagagagtatgcaggcaatcctcagcacgtggcaccaagtatcaccatgcaatacgacatgagttcattggtccccggaggccagttcagtggttcctccgtgcagactcaaacttcacgaagctccaacatgcttgcactgcggccaatgcagcagcctcaaaacttcgagttctctgggcttggtcagtccacacaaccttcagggctcaaccctttcgatgactggtctcgattgcaggagaaccgcggaggcggcgccgatgactacttgatggatgagataagggcaaggagccacgagatattggagaacgatgagatgcagcagatgctgcgcctcctgagcatgggcggggcaccgaccggcctgaataatgttgacggtttcccttcatacccgtctcctgccccagccttcagctttgaggacaaccgtgctcgctcgtccggcaaagctgttgtcgggtggctgaagatcaaggctgcgatgcggtggggcatctttgtcaggaggaaagcggccgagagacgagctcaacttgttgagctggaagactag

SEQ ID NO: 21189 - protein, 652 aa, Sorghum bicolor
  misc_feature: Ceres ANNOT ID no. 8701023
  misc_feature: Down-regulated in shoot tissues in response to salicylic acid treatment
  misc_feature (100)..(403): Pfam ID: Calmodulin_bind Pfam Description: Calmodulin binding protein-like
MQRQGRHLERSNSKRALDHGAGGDDDDRPSKRPRVPALASVIVEALKVDSLQKLCSSLEPILRRVVSEEVERALAKLGPAGPARIQGRSSPKRIEGPDGRNLQLQFRTRLSLPLFTGGKVEGEQGAAIHVVLLDANTGHVVTSGPESSVKLDILVLEGDFNKEEDEGWTEEDFESHIVKEREGKRPLLTGDLQITLKEGVGTIGELIFTDNSSWIRSRKFRLGLRVSSGFCEGIRVMEAKTEAFTVKDHRGELYKKHYPPALKDEVWRLEKIGKDGSFHKRLNSSGIYTVEHFLQFLVRDQQKLRSILGSNMSNRMWESLIEHAKTCVLSGNHYIYYSSDARSVGAIFNNIYEFTGLIADDQFISAENLTENQRVFADTLVKQAYDDWINAVEYDGKALLSFKQTKKTVTTRSETAKASASYPASNDLMNSQKQLAGGPVNTEQSSLKNTREAGGTGIPSMGNQVAREYAGNPQHVAPSITMQYDMSSLVPGGQFSGSSVQTQTSRSSNMLALRPMQQPQNFEFSGLGQSTQPSGLNPFDDWSRLQENRGGGADDYLMDEIRARSHEILENDEMQQMLRLLSMGGAPTGLNNVDGFPSYPSPAPAFSFEDNRARSSGKAVVGWLKIKAAMRWGIFVRRKAAERRAQLVELED

SEQ ID NO: 21190 - DNA, 1098 bp, Sorghum bicolor
  misc_feature: Ceres ANNOT ID no. 8701266
  misc_feature: Down-regulated in root tissues in response to methyl jasmonate treatment
  misc_feature: Encodes the peptide sequence at SEQ ID NO 21191
atggcgaggcgtgagctgttcctcgcgctgctgtggctcgcggccttggcgctggccaccggccccgctgacgcgacgaggaagatggtcggggtgtacgtgctcaggaagggggatttctccgtcaggctcaccaactggggcgccagagtcatgtccgtcgtcctcccagactgcaaagggaatttggctgatgtcgtccttggcagagacaccatcgctgaatacgtcaacgatgacgtgtacttcgggccgataacgggccgcatagcgcagagagtagcccgcggccggttcgtcctcgatggcaaggtctaccacatgcacaggaacgatggcaggaacacgattcacggtggtgacagaggattcagcagaagcatttggacggtgaaggagtacgtagccggcggcgagtcaccctacatcaccttctactaccgtagcttcgacggagagcaaggtttgccggggaacgtggacgcgtacgtgacgtaccgtatgtcggggccctacacgctgggcgtgcacatgaacgcgacggcgctggacaaggcgacgccggtaaacttcctgctgcacgtgtactggaacctgcgcggcgaggggaacggcgacgtgctgggccacacgctccggctgcacgcgtcgcggtacgccgtgctggatgatgagctcctcccgtcgtcggggcgcatcgagcccgtggccggcacgccgctggacttccggacgccgacgccgatcggctcgcgcatccgccaggtcgtcgtcatgggcggccgcgccgtcgggtacgacaccaactacatcgtcgacggcggggaagggatgatgcggcccgtggcgcaggtccgggaccccgcgtccggcagggcgttggagctgtgggcaaaccagccgaccatgcagctctacacggggaactttctcaaccacaccaagggaaagcgcggcaaggtgtacgacaggtacgctgggttctgcctggagacgatggggtacgtggacgccgtgaaccaccctgagtttccgtctcagacactcaggcccggccaggtgtacaagcacgatatggtctacaagttctcgttctag

SEQ ID NO: 21191 - protein, 365 aa, Sorghum bicolor
  misc_feature: Ceres ANNOT ID no. 8701266
  misc_feature: Down-regulated in root tissues in response to methyl jasmonate treatment
  misc_feature (33)..(364): SWISSPROT Homolog: EC 5.1.3.3 Aldose 1-epimerase
  misc_feature (31)..(362): Pfam ID: Aldose_epim Pfam Description: Aldose 1-epimerase
MARRELFLALLWLAALALATGPADATRKMVGVYVLRKGDFSVRLTNWGARVMSVVLPDCKGNLADVVLGRDTIAEYVNDDVYFGPITGRIAQRVARGRFVLDGKVYHMHRNDGRNTIHGGDRGFSRSIWTVKEYVAGGESPYITFYYRSFDGEQGLPGNVDAYVTYRMSGPYTLGVHMNATALDKATPVNFLLHVYWNLRGEGNGDVLGHTLRLHASRYAVLDDELLPSSGRIEPVAGTPLDFRTPTPIGSRIRQVVVMGGRAVGYDTNYIVDGGEGMMRPVAQVRDPASGRALELWANQPTMQLYTGNFLNHTKGKRGKVYDRYAGFCLETMGYVDAVNHPEFPSQTLRPGQVYKHDMVYKFSF

SEQ ID NO: 21192 - DNA, 1302 bp, Sorghum bicolor
  misc_feature: Ceres ANNOT ID no. 8701499
  misc_feature: Down-regulated in shoot tissues in response to salicylic acid treatment
  misc_feature: Encodes the peptide sequence at SEQ ID NO 21193
atggctcatcgtggtcacctagatggactgactgcccaagctccagctctgatgcaccatggttccttcgctgctggcaaactctctagccactcacctttgcagtcttcatccacactggagatgctggagaacaagcttgccatgcaaactgcagaagtagaaaagcttatcatggagaatcagcggttagcatcaagccatgtggtcttgaggcaggacattgttgatacggagaaagagatgcaaatgatccgcacccacctaggtgaagttcagacagagactgatttgcagattagagatttgttggagagaatcagattaatggaggcagacatacatagtggtgatgcagtgaagaaggagcttcaccaagtgcatatggaggcaaagagacttattactgaaaggcagatgctaacccttgacatagagaatgtgattaaagaattacagaaactctctgcctctggtgacggtaaaagccttcctgaattgcttgctgagctagatgggctacggaaagagcatcataatttacgatctcaatttgaatttgagaaaaatacaaacatcaagcaagttgagcagatgcggacaatggaaatgaacctgataaccatgactaaacaagccgagaagttacgtggtgatgtagcaaatgctgaaagacgggcacaggctggtgcgcaggtgacagcttcacagcctgggacagctcaagctacagcggtttcagcagcagctacagacccatatgcaggtgcatatgccagttacccctcggcatatcagcagggagcccaggctgcagcatatcagcagggagcccaggctgcggcatatcagcagggagcccaggctggggcatatcagcagggagcccaggctggggcatatcagcagggagcccaggctggggcatatcagcagggagcccaggttggggcatatcagcacggaacccaagctggggcatatcagcaaggaaaccaggctggagcatacacctatgcttatgatgctgccacggcttacgcatatgcaggttactctggctatccaggctatgcgcaaagtgcagtgcccaattattcctatgccgtacctccgcagccaagcagcggtgcaactacagaggccgcaagcatgtatggcgcagctggtagtgctggatatcctactgcgcaagttcagccgagcagtgccactgcaaatgcagcgcaaccacctcctccaccaccgcctgcagcaccatatcctagcacatatgaccaaaccagaggagcccagaggtga

SEQ ID NO: 21193 - protein, 433 aa, Sorghum bicolor
  misc_feature: Ceres ANNOT ID no. 8701499
  misc_feature: Down-regulated in shoot tissues in response to salicylic acid treatment
MAHRGHLDGLTAQAPALMHHGSFAAGKLSSHSPLQSSSTLEMLENKLAMQTAEVEKLIMENQRLASSHVVLRQDIVDTEKEMQMIRTHLGEVQTETDLQIRDLLERIRLMEADIHSGDAVKKELHQVHMEAKRLITERQMLTLDIENVIKELQKLSASGDGKSLPELLAELDGLRKEHHNLRSQFEFEKNTNIKQVEQMRTMEMNLITMTKQAEKLRGDVANAERRAQAGAQVTASQPGTAQATAVSAAATDPYAGAYASYPSAYQQGAQAAAYQQGAQAAAYQQGAQAGAYQQGAQAGAYQQGAQAGAYQQGAQVGAYQHGTQAGAYQQGNQAGAYTYAYDAATAYAYAGYSGYPGYAQSAVPNYSYAVPPQPSSGATTEAASMYGAAGSAGYPTAQVQPSSATANAAQPPPPPPPAAPYPSTYDQTRGAQR

SEQ ID NO: 21194 - DNA, 2100 bp, Sorghum bicolor
  misc_feature: Ceres ANNOT ID no. 8701480
  misc_feature: Up-regulated in root tissues in response to methyl jasmonate treatment
  misc_feature: Up-regulated in shoot tissues in response to methyl jasmonate treatment
  misc_feature: Encodes the peptide sequence at SEQ ID NO 21195
atgacaagagcccagaggtgccaccctttagacccattatctgcagctgaaattgcagttgctgtagcaactgtaagagctgctggaagatctcctgaggaaagggacagcatgcgctttgttgaagttgtgctgttggagccagaaaagaatgtcgtggcattagccgatgcctacttctttccacctttccagccatcgctgctccctagaagcaaaggttctgctgttattccaagcaggttacctcctaggagggccagacttgttgtctacaataaacaatcaaatgagactagcatttggatagtggaactatctgaagtgcatgcagctactaggggtggacatcacagagggaaggtgatatcatctgaagttgttccagatgttcaacctgcaatggatgctatggagtatgctgaatgtgaggctacagtcaaaagttaccctccatttattgaagctatgaagagaagaggtgtggatgacatggatcttgttatggtggatgcttggtgtgctggctactacagcgaagctgatgctccaagtcgcagacttggcaagcctctcatattttgcagaactgagagtgatagccccatggagaatggttatgctcgtcctgtggaaggaatccatgttgttgttgatatgcagaataatgctgtgatagagtttgaagataggaagttggttcctcttccccctccagatcatttgagaaactatactcctggggaaacaagaggtggtgttgatcgaagtgatgtaaaaccacttatcatcaatcagcctgagggtccaagtttccgcattaatggctattttgtggaatggcagaagtggaacttccgtattggcttcacccccaaagagggtttggttatctattctgttgcttatgttgatggtagccgtggacgtagacctatagcacataggctgagctttgttgagatggtcgttccttatggagatccaagcgaaccacattatcgtaagaatgcatttgatgctggagaagacggacttggaaaaaatgctcattctcttaagaagggatgtgattgcttggggtacataaaatattttgatgcacatttcacaaacttcactggtggtgtggagacaattgagaactgtgtttgtttgcatgaggaggatcatgggatcctttggaaacaccaagactggagaactggtttagcagaagtaaggcggtcaaggaggcttaccgtttcatttatctgtacagttgcaaactacgagtatggtttttactggcacttctatcaggatggaaaaatagaagcagaagtaaagcttactggaattctcagcttaggggccctgatgcctggggaatcaaggaaatatggcacaactattgcccctggtctgtatgcaccagttcaccagcatttctttgttgcccgtatggacatggctgttgattgcaaacctaacgaggctcataaccaggtggttgaggttaatgttaaagtggaaagtgcaggcacacataatgtgcataataatgctttctatgctgaagagaaattgttgaagtctgagttgcaagcaatgcgtgattgcgacccttcatctgcacgccactggattgtacgtaacacacggactgtaaatcggactgggcagccaactggttacaggctcgtgcctggttcgaactgcctgccattggctctgcctgaggcgaaatttctgaggagggctgggttcttgaagcacaatctctgggtgactcaatacaagcgcgacgagatgttccctggaggggagtttcccaaccagaatcctcgcatccacgagggtctgccaacatgggtcaagaaggataggcctctggaggaaactgatattgttctctggtacgtgttcggtctcacccatatccccaggctggaagattggccagtcatgccggtggagcatataggcttcatgctcatgccacatggattcttcaactgctcacctgcggtcgacgtgcctcccagctcgtccgatgcggatgtcaaggaagccgagtcgcccaaggccatccaaaatggcctcgtttcgaagctgtga

SEQ ID NO: 21195 - protein, 699 aa, Sorghum bicolor
  misc_feature: Ceres ANNOT ID no. 8701480
  misc_feature: Up-regulated in root tissues in response to methyl jasmonate treatment
  misc_feature: Up-regulated in shoot tissues in response to methyl jasmonate treatment
  misc_feature (120)..(666): SWISSPROT Homolog: EC 1.4.3.6 Amine oxidase (copper-containing)
  misc_feature (257)..(678): Pfam ID: Cu_amine_oxid Pfam Description: Copper amine oxidase, enzyme domain
  misc_feature (133)..(237): Pfam ID: Cu_amine_oxidN3 Pfam Description: Copper amine oxidase, N3 domain
  misc_feature (8)..(128): Pfam ID: Cu_amine_oxidN2 Pfam Description: Copper amine oxidase, N2 domain
MTRAQRCHPLDPLSAAEIAVAVATVRAAGRSPEERDSMRFVEVVLLEPEKNVVALADAYFFPPFQPSLLPRSKGSAVIPSRLPPRRARLVVYNKQSNETSIWIVELSEVHAATRGGHHRGKVISSEVVPDVQPAMDAMEYAECEATVKSYPPFIEAMKRRGVDDMDLVMVDAWCAGYYSEADAPSRRLGKPLIFCRTESDSPMENGYARPVEGIHVVVDMQNNAVIEFEDRKLVPLPPPDHLRNYTPGETRGGVDRSDVKPLIINQPEGPSFRINGYFVEWQKWNFRIGFTPKEGLVIYSVAYVDGSRGRRPIAHRLSFVEMVVPYGDPSEPHYRKNAFDAGEDGLGKNAHSLKKGCDCLGYIKYFDAHFTNFTGGVETIENCVCLHEEDHGILWKHQDWRTGLAEVRRSRRLTVSFICTVANYEYGFYWHFYQDGKIEAEVKLTGILSLGALMPGESRKYGTTIAPGLYAPVHQHFFVARMDMAVDCKPNEAHNQVVEVNVKVESAGTHNVHNNAFYAEEKLLKSELQAMRDCDPSSARHWIVRNTRTVNRTGQPTGYRLVPGSNCLPLALPEAKFLRRAGFLKHNLWVTQYKRDEMFPGGEFPNQNPRIHEGLPTWVKKDRPLEETDIVLWYVFGLTHIPRLEDWPVMPVEHIGFMLMPHGFFNCSPAVDVPPSSSDADVKEAESPKAIQNGLVSKL

SEQ ID NO: 21196 - DNA, 2934 bp, Sorghum bicolor
  misc_feature: Ceres ANNOT ID no. 8701559
  misc_feature: Up-regulated in root tissues in response to salicylic acid treatment
  misc_feature: Encodes the peptide sequence at SEQ ID NO 21197
atggacacgaggcgtcactctgtgtctgtggatgtcccactgtcaagaaccttggtgcagctcaagcgagtgagatcgctgcgggatccagcgacgaactcgatgagcaagtacgcatctccttctgatcacatgatctgggagactgcttctagcaatggggtgactctggaccttggcaggtcagcacatcatcacctggttgaagaagacgaagacgtgggagctgagcctacaatggggtcagagcggagttttcggggaccaaatgcaaggactgcatcatataggaaatcttcagctgtcaggattagaggcttgaacccaccaagaaacaagcaggttcatcgtgtccgccaagatggtcaccgcaagtcgttggattctaaccactcaaatcacagttctatccgtcaattggcaaacaatgtggtcaacaatgtggatgcagataaggaagaggaggaagtgaattcttatgaaagaccaaaatttgcaatgccagataaggctgatgaagaagtgaaaatgccagactactccaaattcaggagcaagtcttctgctgcaatgagccgtgttgggagcccctgtatgtcagccagtgaggcacgctccgttgggtcaagaagaagcactttagggcatggaactgaggatacacgactgaggtcgaatgatgtcgtgggatcgaattttagtggctgtggtataagctactgctggtcaggagcatcgaagtaccgagaactttattcagatagtgatggtccagatcaacctctcttgtctacagatgggaccgaggctgcattccaaggcaatgtaccatacactgagacaccgaggtgtttaagccagaaattccgccctcgttctttcagtgaattgatcggcctaaatgttgttgcccagtccctcttatattcctcttgcaaaggaaaagttgctccaatgtacttgtttcatggcccccggggtacaggcaagacatccacagcaaggatttttgccgcagcactaaattgtgtatctcttgaagagcaaaggccatgtgggttctgtaaagagtgtgtcattcttttctctgggaagagtagagatgtgaaagaacttgatgcagcgaaaatggatcgtttaggtcgagtaaaggcacttctcaagagtgcatctctcgttccatactcttcgcgcttcaaggttttcataatagatgaatgccatctcttgcaagaagatgcatggtcagcaatactgaagagtcttgatgagccataccggcatacagtatacattatgattacttctgacatagaaagcctgcctcgcacttccatcacacattgccagaagttccattttccgaagataaaggtggcagatattgtctacaggttggagagaatctgtatagaagaaggattggaatttgaccatgatgggttgtatttcattgctgcaaagtctaatggttctcttagagattcagaaataatgcttgatcaactcagtttgctagggaagaagatcacaatttctcttgtgcatgaacttgtaggatctgtgtctgatgacgagttgattgaattgcttgatctagcattgtcgtccgacacaaccaatactgtaagacgagctcgagaacttatggggtcagcaattgatcctctgcagctggtgtctcagttggccaaccttattatggacattctctcagggcgatgtcaatctgcagtcactgaagtcagcaaaagtttcttgggtagatatgcattatcggagattggaataaagaaattaaggcatgcactgaagatactatcagaaactgaaaaacaattaaggacatcaaggaatcaggctacttgggttacagttgcgcttttgcagtttagcaccaatgaacctaaccttgctgctgaaccgaatgatatgcatgcacattcagtaactggatatacagatgactgggtttccaaggtgcactcaagtgccaatttttgtcaggcatgtaacagcagcaagtccaactgctctgagagacactgtaggcggcttaagcttgagaacatatggaggagagccattggaaagtgtcgatcaaggtcagccaaaagtttcctcaggaaagaaggcttcttatcatcggttcatgttactgaagagctggccatagcagaagttggttttggacacccggatcacctatcaagagcagagaaaatgcaaagcctcatagaatgctctttacagcatgttcttgggtgcaatgtggagatcagattcaaacttgtaccctgtccagtcagaaaagatgctaggttgaagagacagtcgttcagttttctcaactgctctggccggaagcaagagctgtcagattcagttgtgactgatgaagatgaagttgtgaggcctggagcaagagagacaccgcttaaaggctacacctctagtcagcaggaatcaccatataccatgcaacgtgttgattcaaaaccaacagtccatggttgtgaggatgatgctcggagtaccttgacgtcaaacagatccatgacagatgatctgacaaggacgtgcaggtcagagactaactactcaaagggtgtaagtgagcacggccactttgatagcatccaggaaccggacctacagccgaattgcttctcgcgaacactcaagcttcaaaagaagctattgtcttctggcgcagcacacacaatctgtttgaggatccagccacataacaagatggacttcctgcctaagaaagaattcgatacatacttctgcgcatacgaaccttacgagcagtgttcaagatcaaattcaagagctacttacagttcaagagatgatgacttgtggagcaagaattcacgctttggttcgaatctactctgctggagggccccaaaacaatccatgtaa

SEQ ID NO: 21197 - protein, 977 aa, Sorghum bicolor
  misc_feature: Ceres ANNOT ID no. 8701559
  misc_feature: Up-regulated in root tissues in response to salicylic acid treatment
  misc_feature (283)..(641): SWISSPROT Homolog: EC 2.7.7.7 DNA-directed DNA polymerase
  misc_feature (319)..(509): Pfam ID: AAA Pfam Description: ATPase family associated with various cellular activities (AAA)
MDTRRHSVSVDVPLSRTLVQLKRVRSLRDPATNSMSKYASPSDHMIWETASSNGVTLDLGRSAHHHLVEEDEDVGAEPTMGSERSFRGPNARTASYRKSSAVRIRGLNPPRNKQVHRVRQDGHRKSLDSNHSNHSSIRQLANNVVNNVDADKEEEEVNSYERPKFAMPDKADEEVKMPDYSKFRSKSSAAMSRVGSPCMSASEARSVGSRRSTLGHGTEDTRLRSNDVVGSNFSGCGISYCWSGASKYRELYSDSDGPDQPLLSTDGTEAAFQGNVPYTETPRCLSQKFRPRSFSELIGLNVVAQSLLYSSCKGKVAPMYLFHGPRGTGKTSTARIFAAALNCVSLEEQRPCGFCKECVILFSGKSRDVKELDAAKMDRLGRVKALLKSASLVPYSSRFKVFIIDECHLLQEDAWSAILKSLDEPYRHTVYIMITSDIESLPRTSITHCQKFHFPKIKVADIVYRLERICIEEGLEFDHDGLYFIAAKSNGSLRDSEIMLDQLSLLGKKITISLVHELVGSVSDDELIELLDLALSSDTTNTVRRARELMGSAIDPLQLVSQLANLIMDILSGRCQSAVTEVSKSFLGRYALSEIGIKKLRHALKILSETEKQLRTSRNQATWVTVALLQFSTNEPNLAAEPNDMHAHSVTGYTDDWVSKVHSSANFCQACNSSKSNCSERHCRRLKLENIWRRAIGKCRSRSAKSFLRKEGFLSSVHVTEELAIAEVGFGHPDHLSRAEKMQSLIECSLQHVLGCNVEIRFKLVPCPVRKDARLKRQSFSFLNCSGRKQELSDSVVTDEDEVVRPGARETPLKGYTSSQQESPYTMQRVDSKPTVHGCEDDARSTLTSNRSMTDDLTRTCRSETNYSKGVSEHGHFDSIQEPDLQPNCFSRTLKLQKKLLSSGAAHTICLRIQPHNKMDFLPKKEFDTYFCAYEPYEQCSRSNSRATYSSRDDDLWSKNSRFGSNLLCWRAPKQSM

SEQ ID NO: 21198 - DNA, 1569 bp, Sorghum bicolor
  misc_feature: Ceres ANNOT ID no. 8701582
  misc_feature: Up-regulated in root tissues in response to salicylic acid treatment
  misc_feature: Encodes the peptide sequence at SEQ ID NO 21199
atgggggagctctcgcggcgcggggaggatgtggacctcaacgcgctcaagtccgccgcgtgccggagatacggtctggcgcgggcgcccaagctggtggagatgatcgccgccgtgcccgaggccgaccgcgccgcgctgctgccgcggctgcgcgccaagcccgtgcgcacggcgtcgggtatcgccgtcgtcgccgtcatgtcgaagccgcaccgttgcccccacatcgccaccaccgggaacatctgcgtctactgcccgggcggtcccgactccgacttcgagtacagcacgcaatcctacactggatacgagcccaccagcatgcgtgccattcgggcaaggtataatccatatgtgcaagccaggagcaggatagatcagctcaagaggctagggcatagtgtggataaggtcgagttcatcttgatgggtgggactttcatgtccttaccagctgattatcgtgattatttcatcagaaatcttcatgatgctttatcgggtcacacttcggcaaatgttgaggaggctatttgttattcagaacatagtgctgtcaaatgtattggtatgacgattgagacgagacctgattattgcttggggcctcatctgcgccagatgctatcttatggttgtacccgcttggaaattggtgtccagagtacatacgaggatgttgcccgtgacacaaacagaggacacacagtggctgctgttgctgactgcttctgtttggcaaaagatgctgggtttaaggtggttgcccacatgatgccagatttacctaatgttggagttgaacgagacttggaaagtttcagagaattttttgaaagtccagcattccgggctgatggtctcaagatttatccaacgcttgttattcgtggaactggtctttatgagctctggaaaactggcagatatagaaattatccacctgagctgctggtggatatcgtggcaagaattctatctatggtcccaccatggacacgagtgtatcgggtccagagagatattcctatgcctcttgtcacttctggtgttgagaaaggtaaccttcgtgagcttgctttggctcgaatggaagatctgggcttaaaatgccgagatgtcagaacacgtgaggcagggattcaggatatccatcacaagatcaggccagatgaagtagagcttgttagacgtgactatgctgcaaatgagggttgggagacgttcctttcttatgaggatacacggcaggatatcctgatcggcctgttgcgcttgcgtaaatgtggccgtaatgttacatgccctgaacttgtagggaggtgttcaattgttcgtgagcttcatgtctatggaactgcagtccctgtgcatggccgtgacgtagacaagctacagcaccaggggtacggaactctattaatggaagaagcagaaaggattgctcaaaaggagcaccgttcaaagaaattggctgtcatttcgggggttggtactcgccactactaccgcaagttgggttatgaactagaagggccttatatggtcaaaactttggcataa

SEQ ID NO: 21199 - protein, 522 aa, Sorghum bicolor
  misc_feature: Ceres ANNOT ID no. 8701582
  misc_feature: Up-regulated in root tissues in response to salicylic acid treatment
  misc_feature (1)..(521): SWISSPROT Homolog: EC 2.3.1.48 Histone acetyltransferase
  misc_feature (68)..(280): Pfam ID: Radical_SAM Pfam Description: Radical SAM superfamily
  misc_feature (414)..(511): Pfam ID: Acetyltransf_1 Pfam Description: Acetyltransferase (GNAT) family
MGELSRRGEDVDLNALKSAACRRYGLARAPKLVEMIAAVPEADRAALLPRLRAKPVRTASGIAVVAVMSKPHRCPHIATTGNICVYCPGGPDSDFEYSTQSYTGYEPTSMRAIRARYNPYVQARSRIDQLKRLGHSVDKVEFILMGGTFMSLPADYRDYFIRNLHDALSGHTSANVEEAICYSEHSAVKCIGMTIETRPDYCLGPHLRQMLSYGCTRLEIGVQSTYEDVARDTNRGHTVAAVADCFCLAKDAGFKVVAHMMPDLPNVGVERDLESFREFFESPAFRADGLKIYPTLVIRGTGLYELWKTGRYRNYPPELLVDIVARILSMVPPWTRVYRVQRDIPMPLVTSGVEKGNLRELALARMEDLGLKCRDVRTREAGIQDIHHKIRPDEVELVRRDYAANEGWETFLSYEDTRQDILIGLLRLRKCGRNVTCPELVGRCSIVRELHVYGTAVPVHGRDVDKLQHQGYGTLLMEEAERIAQKEHRSKKLAVISGVGTRHYYRKLGYELEGPYMVKTLA

SEQ ID NO: 21200 - DNA, 1992 bp, Sorghum bicolor
  misc_feature: Ceres ANNOT ID no. 8701641
  misc_feature: Up-regulated in shoot tissues in response to methyl jasmonate treatment
  misc_feature: Down-regulated in root tissues in response to methyl jasmonate treatment
  misc_feature: Encodes the peptide sequence at SEQ ID NO 21201
atggcgtcggcgctgctctcatacctgcaggccctgtggccgttctctgccctcctgagggaggaggacgacctacgcgcgtcagcgcggctgatcgggccgctctctgtgccggaggagacgaagcagttcgtgctcgcgctccgggagcctggcgggtcgacgcaggacccgcaccgggacggcgccggcgtgatctacatcctcgccgcgcagaacctgtcggagcagtccgcctcggacgccgagcgcctgatcagggaggtgcggccgagggccgtggtcacccaggtcgcgcgcacggccctcgaagacgtccggatcgaggaggattgcctggccggcagtggaagcgggggcgtgccggtaccggcgtcgccgtttcaggtgatcaagcggtgcgtcacggagaagaggagcaaggaccagtacgtgaaggctgccgcgtgccaggtcctgcaggagatttttggggtcgggttctatggccatctgcttgctgccaagagagctgcagaggagacgggttcgtgttttctattgcttgagtctccgtatgagaggaattgtggtgggggtggatcggtcagccggaacagcactacagataataactcagctcagccattacaggctagttgctcgctagctcacagcaccatggatgatgactcaggtttgcaattgcaggctaactgcttgatccccaggagtgccatgacctcccatggtagcaagatatgccttatggatgataatggaggacagctcttgaagtcactggcaccaactcttaatttcttgatgtcccaagcagtcccttccaatgctgctactgagtacaggccatctgaatgcaagccggctgacagatatgaggctccacagtttgctcagtctgtctaccctttacttgctgatctttatcatatatttgtcgatattccgtctattggtaaggctatggcttctgctcagaagttgcttactcaagttcacgagggggagccaatcagcagtgatatgctatctgatgtgtacgtatttagaattgcaatagaggccctcaggatgggtttaaacaatgcagcaaggtcccatattgataccagagataaacatggttcaaaagatctggatttttcagatctccaatctgatgagaagtgccacattcttcttgcgcaagctctcaggagtcaactaagagagtttggttctgtggtggctatagttgacgcgagctgcttagctggaataaggagacattggaacacccctgttccttcagagattactcaattagctagcagatgcttcaatcactatggtgctgaaaatgatgacaaaattgaggtaccttcagcagacagcactgataaaaaaagttggatatctgagaaacctgtggttgctgttggtgcaggaggtacagcactcttgggcttttcatcattgtcaaaatctcttcaggcttctgccttccttaagctcgccccttacaaaagtccagtggttctaaagtatgcattgatgcagctacaaagacatgctgctattgtattaagcaagatgctccctcacgggtttgttactgctggctcaaaggcttctgctttgcagttcacggcttcagcagagaagatccgagcggtggcacacactgtaatatcatcagctgagagaacaagcttactggctatgcgaacttcattctacgaaataatgcagaagaggcacaggcagcctttcagaataactccttgggcaacatttggctgcagcatggttgcatgtgctggccttgtgatgcatggagatgggatcgagtgtgcagccgaggcagcaccttctgttcccatgattgcttctctgggccgtggccttgagagcttacgtctcacatcccaggaggtgagacaaacaaagggccaaaatgtgaaagaagctttgcgagcattaatgaacagcttgaagaaatcagcaaaataa

SEQ ID NO: 21201 - protein, 663 aa, Sorghum bicolor
  misc_feature: Ceres ANNOT ID no. 8701641
  misc_feature: Up-regulated in shoot tissues in response to methyl jasmonate treatment
  misc_feature: Down-regulated in root tissues in response to methyl jasmonate treatment
MASALLSYLQALWPFSALLREEDDLRASARLIGPLSVPEETKQFVLALREPGGSTQDPHRDGAGVIYILAAQNLSEQSASDAERLIREVRPRAVVTQVARTALEDVRIEEDCLAGSGSGGVPVPASPFQVIKRCVTEKRSKDQYVKAAACQVLQEIFGVGFYGHLLAAKRAAEETGSCFLLLESPYERNCGGGGSVSRNSTTDNNSAQPLQASCSLAHSTMDDDSGLQLQANCLIPRSAMTSHGSKICLMDDNGGQLLKSLAPTLNFLMSQAVPSNAATEYRPSECKPADRYEAPQFAQSVYPLLADLYHIFVDIPSIGKAMASAQKLLTQVHEGEPISSDMLSDVYVFRIAIEALRMGLNNAARSHIDTRDKHGSKDLDFSDLQSDEKCHILLAQALRSQLREFGSVVAIVDASCLAGIRRHWNTPVPSEITQLASRCFNHYGAENDDKIEVPSADSTDKKSWISEKPVVAVGAGGTALLGFSSLSKSLQASAFLKLAPYKSPVVLKYALMQLQRHAAIVLSKMLPHGFVTAGSKASALQFTASAEKIRAVAHTVISSAERTSLLAMRTSFYEIMQKRHRQPFRITPWATFGCSMVACAGLVMHGDGIECAAEAAPSVPMIASLGRGLESLRLTSQEVRQTKGQNVKEALRALMNSLKKSAK

SEQ ID NO: 21202 - DNA, 4176 bp, Sorghum bicolor
  misc_feature: Ceres ANNOT ID no. 8701665
  misc_feature: Down-regulated in shoot tissues in response to salicylic acid treatment
  misc_feature: Encodes the peptide sequence at SEQ ID NO 21203
atggcgaagccggaggagaagctgcgctgcacgaaggagcccttcatcgaggacgtcggcacccggaggataaagagcatccggttcagcgtgctctcgggcagcgagattcgcaagtctgcggaggtgcaggtctggaacaacaggatctatgggcacgacatgaagccggtgcccaatgggttgctcgacccgcgaatgggagtccctaataagagagagaaatgcagtacctgccatggtgaatttagtgactgtcctggccatttcggctacttgaagcttgcgcttccagtttttaatgtaggcttctttaactgtattctggacgtgttgaagtgcatctgcaagagctgtagcagagttcttctttttgagaaagaccgcagggagtttctgaagaagatgagaaatcccagggcagatgcactacagaaaagtgctacaatgaaaaaagtgagggacaaatgcaaactatcctgctgcccccgctgtgattacagaaatggtgtagttaaaaaaggcagagcaggcttgatagtggttcatgactgtagcaaggttttggatggacatacagaagaactaaagaatgcattgcaaaacaagaaagaaaaggtctccgctaattcagttcgtgtgttagaccctgcaactgttctctctctattcagaagaatgacagacgaggattgtgaattactaaaccttggtgataggccagagaaacttattgtgtcggagattgcagtgccacctgttcctatacggccttctgtcgttgttggtagtagtagaacaagcaatgaagacagcatcacggttattttgaagagcattgttaatacaaactccatccttaaggagaccctccatactgggggtccattcaccaagtgctttgattgctggcaataccttcaacttcaagttgttgaatatgtgaatagtgatgccccctgtcttccagactcacaacatcgtggccttgttcaacgactcaaagggaagactggccgatttcgtggtaatttgtctggaaaacgtactgagtatacaggaagaactgtcatatctcctgatccaaatttgaaaataacagaggtggctattcctgtgttgatggctcgagtcttgacttatcctgaaagggtttcaaactataacattgagaagctgagacaatgtatacgaaatggaccattcaaatatccaggggctaattttgttacacaacctgatggcatgaagcagagcttaaagtatggcgatagaaggattactgctcgggatttaaagtgtggatgtatagttgaaaggcatttagaagatggagacgtggtcctctttaatagacagccgagtctgcatagaatgtcaattatgtctcacagggcaaggataatgccatggagaacactcagatttaatgagtctgtttgcaacccttataatgctgattttgatggagatgaaatgaatttgcatgtccctcagacagaggaagctcgcactgaagcgcttatgctcatgggggttcagaataatttatgtactcctaagaatggtgagatactagttgcttccacgcaagacttcttgacctcatctttcctagttacaagaaaagatactttctatgatagatcttcatttactcttttgtgctcataccttggtgatgcaatggagaacattgatttgccaacaccagccttgattaaacctattgagctttggactggtaaacagctatttagcgtgttagtccgacctaatgcacatacaagggtttttctgaatcttgctgttcaagaaaaaatttattcaaagaaaaaggggaaaaaagaggcgggagaggaaacaatgtgtggaagggaaacaatgtgtcccaatgatggttatgtctacttccgaaacagtgaactgttatctggacaagtagggaaggccactttaggtaatgggaataaggatggcctttactctgttcttttaagagattataattctcatgctgcagcaagctgtatgaatcgcttggcaaaatttagtgcaagatttatagggaaccatggtttttccattggtgtggatgatgtccaaccaggagaacatctaaaccggcaaaagaaaaaggaaatagacggagggtacaaaaaatgccatgatcttatttctttgttcgcgaaaggtgcgctcgcattacatcctggatgcaacgcagctcaaacattggagcataacatcactggcgtgttaaatgaaatcagatcaattgctggaaatgtgtgcatggatacgcttcactggaggaacagcccattgatcatgtctcagtgtggttctaaaggttctccaatcaatatcagtcagatggttgcgtgtgttggacagcaatcagttggagggcgtcgcgccccagatggttttttaaatagaactcttcctcactttcctataaattctaagacccccgcggctaaaggttttgttgctaattcattctatactggtttgactgctactgagtttttcttccacacaatgggtggacgagaaggtcttgttgacacggcggtcaaaacagcagaaactggatatatgtcccgcagattgatgaagggcttggaagatctctcggttttctatgatcagacagttcgaaatgctagcggtggtatagttcaatttttgtatggagatgatggcatggatcctgcaaagatggaaggaaaagatggcatgcccttaaatttggatcaattgtttatgaaagtcatggccacatgtcctcaaaggggatcagatacattatctccagaggctatcaaacagatgttagaggataagctcttgcagcatgacacctcatctgatggtggctgtagcgaagagttcaagaaaaacttaactgaatttcttgataaacgtatagaattaatgaaatgcacaagaagggcactccatctacatgaggatcatgtagaaaagaaagattcttgcgtagaagaatctgttgctgctattatatctggtatatctgcaaaacaacttcaggttttcttggacacttgcttatctcgttatcagtcaaagaagattgaagcaggagcatctattggagcaattggagctcaaagtattggagagccagggactcagatgacactgaaaacatttcattttgccggagtagctagcatgaatgttactcttggtgttcctcgaatcaaggaaattatcaatgctgctagaaagataagcacgcctattatcaccgctcagcttttgtcaaagaaagatgtgctttctgcgcgtattgtgaaaggatctatggagaaagcagtgctcggcgaggttgcagtcgctatacagattgtcctgaagtcaagtcagccaaacttgattgtcaaacttgatatgcaacttatagaaagtctccacatgggaatatctgctgattctgtgcagctgtcaattttgaatcatccaaagattaagctaaaatctgagcatgtccgtgtcattgatagagccaagttgagaatatatccagctggaactgataagcgcaaacttcagcttgaactgcacaacctcaaatccatccttccaaaagtgattgtgaagggcattccaactgttgaaagggttgttattgacgaagttaaagtaaaaaacgagacagaaagataccaattgttggttgaaggaacaaacctcctggcagtcatgggtaccccaggagttgatgctacgaagacaaaaagtaatcatatcatggaaacgaaccaaacgcttggaattgaagcagctaggagatctattattgatgaaattcagtacacaatgaaaagtcatggcatgaacattgatcggagacatatgatgctcttagcagatttaatgacatacaagggtgaaattctcggcattactagatatggcattgcaaagatgaaaagcagcgtgctgatgcttgcttcatttgagaaaacctcagaacatctattcaatgcctcatacagtggtcgtgaggatcagatagagggagttagtgaatgcattatcatgggcattcccatgcagctcggtaccggtattctcaaagttaggcaaaggctcgaccatgtgcctgaattcaagtaccagccagacccgatactgtcgtga

SEQ ID NO: 21203 - protein, 1391 aa, Sorghum bicolor
  misc_feature: Ceres ANNOT ID no. 8701665
  misc_feature: Down-regulated in shoot tissues in response to salicylic acid treatment
  misc_feature (12)..(1386): SWISSPROT Homolog: EC 2.7.7.6 DNA-directed RNA polymerase
  misc_feature (839)..(1328): Pfam ID: RNA_pol_Rpb1_5 Pfam Description: RNA polymerase Rpb1, domain 5
  misc_feature (347)..(513): Pfam ID: RNA_pol_Rpb1_2 Pfam Description: RNA polymerase Rpb1, domain 2
  misc_feature (21)..(345): Pfam ID: RNA_pol_Rpb1_1 Pfam Description: RNA polymerase Rpb1, domain 1
  misc_feature (516)..(701): Pfam ID: RNA_pol_Rpb1_3 Pfam Description: RNA polymerase Rpb1, domain 3
  misc_feature (726)..(832): Pfam ID: RNA_pol_Rpb1_4 Pfam Description: RNA polymerase Rpb1, domain 4
MAKPEEKLRCTKEPFIEDVGTRRIKSIRFSVLSGSEIRKSAEVQVWNNRIYGHDMKPVPNGLLDPRMGVPNKREKCSTCHGEFSDCPGHFGYLKLALPVFNVGFFNCILDVLKCICKSCSRVLLFEKDRREFLKKMRNPRADALQKSATMKKVRDKCKLSCCPRCDYRNGVVKKGRAGLIVVHDCSKVLDGHTEELKNALQNKKEKVSANSVRVLDPATVLSLFRRMTDEDCELLNLGDRPEKLIVSEIAVPPVPIRPSVVVGSSRTSNEDSITVILKSIVNTNSILKETLHTGGPFTKCFDCWQYLQLQVVEYVNSDAPCLPDSQHRGLVQRLKGKTGRFRGNLSGKRTEYTGRTVISPDPNLKITEVAIPVLMARVLTYPERVSNYNIEKLRQCIRNGPFKYPGANFVTQPDGMKQSLKYGDRRITARDLKCGCIVERHLEDGDVVLFNRQPSLHRMSIMSHRARIMPWRTLRFNESVCNPYNADFDGDEMNLHVPQTEEARTEALMLMGVQNNLCTPKNGEILVASTQDFLTSSFLVTRKDTFYDRSSFTLLCSYLGDAMENIDLPTPALIKPIELWTGKQLFSVLVRPNAHTRVFLNLAVQEKIYSKKKGKKEAGEETMCGRETMCPNDGYVYFRNSELLSGQVGKATLGNGNKDGLYSVLLRDYNSHAAASCMNRLAKFSARFIGNHGFSIGVDDVQPGEHLNRQKKKEIDGGYKKCHDLISLFAKGALALHPGCNAAQTLEHNITGVLNEIRSIAGNVCMDTLHWRNSPLIMSQCGSKGSPINISQMVACVGQQSVGGRRAPDGFLNRTLPHFPINSKTPAAKGFVANSFYTGLTATEFFFHTMGGREGLVDTAVKTAETGYMSRRLMKGLEDLSVFYDQTVRNASGGIVQFLYGDDGMDPAKMEGKDGMPLNLDQLFMKVMATCPQRGSDTLSPEAIKQMLEDKLLQHDTSSDGGCSEEFKKNLTEFLDKRIELMKCTRRALHLHEDHVEKKDSCVEESVAAIISGISAKQLQVFLDTCLSRYQSKKIEAGASIGAIGAQSIGEPGTQMTLKTFHFAGVASMNVTLGVPRIKEIINAARKISTPIITAQLLSKKDVLSARIVKGSMEKAVLGEVAVAIQIVLKSSQPNLIVKLDMQLIESLHMGISADSVQLSILNHPKIKLKSEHVRVIDRAKLRIYPAGTDKRKLQLELHNLKSILPKVIVKGIPTVERVVIDEVKVKNETERYQLLVEGTNLLAVMGTPGVDATKTKSNHIMETNQTLGIEAARRSIIDEIQYTMKSHGMNIDRRHMMLLADLMTYKGEILGITRYGIAKMKSSVLMLASFEKTSEHLFNASYSGREDQIEGVSECIIMGIPMQLGTGILKVRQRLDHVPEFKYQPDPILS

SEQ ID NO: 21204 - DNA, 2703 bp, Sorghum bicolor
  misc_feature: Ceres ANNOT ID no. 8701737
  misc_feature: Up-regulated in root tissues in response to salicylic acid treatment
  misc_feature: Encodes the peptide sequence at SEQ ID NO 21205
atgcagccggatcagcctgtgatcagcttgcgccccggcggcggcggcggcggcccgcgcgccggccgcctcttctcccccgccttcgccacctccggctccggagacttcctccgcccgcacggcgggggcgcctccggcatctccaagatcggcgagtcacattttgagccacgcgagcgtgttcgttacacaagagatcaacttcttgagctgcgtgagattgttgatgtgtctgaggacattctaaggatcaagcaagagattgatgtagagcttcatggtgaagatcagagctgggttcgcaatgattcagctattcaaggacaagcccaagcccaagcccaagctcaagcacaagcacagaatcggtatgctgagactgataaccgtgattggcgtgcacgatcagcacaaccgcctccggctaatgaagagaaatcttgggacaacatacgtgaggctaaagaggcctatgcctctagtggtaggcaacaagagcaagctaacaggcaagatcagttaagctcccagtttgcttcgaaagctcaggttggccccacccctgctcttattaaggctgaagtgccctggtcagcccgaagaggcaatctatcagagaaagaaagagtcttaaaaacggtgaaaggtatactgaacaaacttacaccagagaaattcgatcttctcaagggtcaactgatggaagctggaattactactgctgatattttgaaggatgttatatctctcatatttgagaaggcagtttttgagcccacgttctgtccgatgtatgctcaactttgttctgacctcaatgtaaagctcccgacattctctcctgaagagccagatggcaaagagatcacgttcaagcgcgtgctattgaacaattgtcaggaagcctttgaaggtgctagtagcttaagagctgaaattgctaaattaactggccctgaccaagagatggagagaagggacaaagaacggttggtcaaacttagaacacttggaaatattcgcctaattggtgagctactcaagcaaaaaatggttcctgagaagatagttcatcacattgttatggagctattggggtctgggcctgataagaagccatgccctgaagaggaagatgttgaggctatctgtcatttcttcaatacgattggtaaacagcttgatgagaacccaaagtctcggcggattaatgatacctacttcatccagatgaaggagctaacaatgaatcctcagctcgcaccacgattgaggtttatggttcgtgatgtgattgaactccgatcaaataactgggtgcctcgacgtgaggagattaaggccaagacaatcagtgaaattcactctgaggcagaaaagaaccttggattacgacctggagcagcatctgtcattaggaatggccgtagctcaccaggcggccccctttcgcctggaggtgggtttccaatgaatcgcccaggaactggaggcatgatgcctggaatgcctggttcaagaaagatgcctggaatgcctgggttggacaatgataactgggaagttcctcgttctagatcaatgccaagaggtgactcgattcgcaaccaggggccattgctcaataggccgtcaacagttcaaaaggcatcatctattaacacgaggcttcttcctcaaggcagtggcgcagcactaattggcaagagtgcacttttgggaactggtgttccaccatctcgtcctctcagctttacacctggaccagcaccagctcaaactacaccatcaccaaaaccattaattgcagcaccagctgttgcccctgctcctgataaaccagccagtgctcccaagggcaactctgctgagcttcagaagaaaacaatagctcttcttgaggagtatttcggcatacgtattttagatgaggcacaacaatgtatcgaggagttgcagagtcctggttactacccggaaattgttaaagaagctgtcaatcttgctctagataaaggcaccaattttgttgatcctctcatcaggctacttgagcatctgtacacaaagaaaattttcaagactcaagatctggaagccggttgcttgttatacggtgctctgctggatgacattggcattgacctccctaaagctccaacacaatttggtgaaattattgctcgcctgactttgttgggcgccttgagatttgaagctgtggaggaggttttaaagaaaatggaggatacattctaccgcaagcaagtttttaatgctgtcatgaaaaccttggaagcaaacccatcagggttcggtcgttggacggtggactctgcggggatcgcggcgggacgggatccccaatctcctgctgagcttccgcgcagagggcaggccgcaggcatggctggaaggcataccatcattctcatgcaaccatcgcagaacagatcgacgaggacatttatggactacgattcagttaaccatgcgctggatggtatgaaaatcaggaatatcaacccgatggtcgggaatttgacttatgatatcagtgacctgtacaacttcatcgatggcctgactgacataagtgcactggtgtacgaagattcacttcacgctttcctgccatatgaccgtcagtggataaaacagaagctctttcagcacctgaagcggctggcgcaacagtag

SEQ ID NO: 21205 - protein, 900 aa, Sorghum bicolor
  misc_feature: Ceres ANNOT ID no. 8701737
  misc_feature: Up-regulated in root tissues in response to salicylic acid treatment
  misc_feature (212)..(439): Pfam ID: MIF4G Pfam Description: MIF4G domain
  misc_feature (806)..(900): Pfam ID: ER Pfam Description: Enhancer of rudimentary
  misc_feature (626)..(738): Pfam ID: MA3 Pfam Description: MA3 domain
MQPDQPVISLRPGGGGGGPRAGRLFSPAFATSGSGDFLRPHGGGASGISKIGESHFEPRERVRYTRDQLLELREIVDVSEDILRIKQEIDVELHGEDQSWVRNDSAIQGQAQAQAQAQAQAQNRYAETDNRDWRARSAQPPPANEEKSWDNIREAKEAYASSGRQQEQANRQDQLSSQFASKAQVGPTPALIKAEVPWSARRGNLSEKERVLKTVKGILNKLTPEKFDLLKGQLMEAGITTADILKDVISLIFEKAVFEPTFCPMYAQLCSDLNVKLPTFSPEEPDGKEITFKRVLLNNCQEAFEGASSLRAEIAKLTGPDQEMERRDKERLVKLRTLGNIRLIGELLKQKMVPEKIVHHIVMELLGSGPDKKPCPEEEDVEAICHFFNTIGKQLDENPKSRRINDTYFIQMKELTMNPQLAPRLRFMVRDVIELRSNNWVPRREEIKAKTISEIHSEAEKNLGLRPGAASVIRNGRSSPGGPLSPGGGFPMNRPGTGGMMPGMPGSRKMPGMPGLDNDNWEVPRSRSMPRGDSIRNQGPLLNRPSTVQKASSINTRLLPQGSGAALIGKSALLGTGVPPSRPLSFTPGPAPAQTTPSPKPLIAAPAVAPAPDKPASAPKGNSAELQKKTIALLEEYFGIRILDEAQQCIEELQSPGYYPEIVKEAVNLALDKGTNFVDPLIRLLEHLYTKKIFKTQDLEAGCLLYGALLDDIGIDLPKAPTQFGEIIARLTLLGALRFEAVEEVLKKMEDTFYRKQVFNAVMKTLEANPSGFGRWTVDSAGIAAGRDPQSPAELPRRGQAAGMAGRHTIILMQPSQNRSTRTFMDYDSVNHALDGMKIRNINPMVGNLTYDISDLYNFIDGLTDISALVYEDSLHAFLPYDRQWIKQKLFQHLKRLAQQ

SEQ ID NO: 21206 - DNA, 1752 bp, Sorghum bicolor
  misc_feature: Ceres ANNOT ID no. 8701759
  misc_feature: Up-regulated in shoot tissues in response to salicylic acid treatment
  misc_feature: Encodes the peptide sequence at SEQ ID NO 21207
atggcgggcggtggaggaggagggccggggccggggcgggtgaaggcggggagccgcccgccgtgggtcgggctggcggcggcggtgtgggtgcaggtggcggcggggagcgcctacgtgttcccgctctactcgcacgccatcaaggaggcgctcgggtacaaccagcaggcgctcaccatgctcggcgtcggcaacgacgtcggcgagaacgtggggctcgtcccgggggtgctcgccaaccgcctcccgccctggctcatcctcgtcatcggctccgcctgcgccttcttcggcttcggcacgctctggctcgccgtcaccaagaccgtcgccatgccttactgggtgttatggatagctttatgtattggcacaaacagcagtgcatggttgggcactgctgctcttgtgaccaacatgaggaatttccctctcagccgaggcactgttgctggtctcatcaagggttatgttgctgttagtgctgctgtctacactgaaacgtttaatggaatgcttgggaattcgcctacaaatcttttgctgttgcttgcgttggggatcccaacagcatgtattgtggtgatgtattttgttaggccttgcactccatcactggatgaggacaactcaacagaacacagtcatttcatgtacacacaaatctcaagtgtggttctcggaatataccttatggttgctacaatacttggtgatactttaaaactaagtcaggctgtcacctatcttttatttggtataatgatacttttgctccttgctccacttgcaataccaataaagatgacactttatccaaacaaacaaacaaaggaaaaacccagcacccttgctccatcttattcaactgatagtctgtctggtgcggacccagagaactcacaaccacttctgggcagtgcctcaacaacatttgctacaggtaccaatgaatctgatgacagtactgatttggatcttctattggctgagggtgagggagcagtgaatttgaaaaagaaaagaggaccaagacggggggatgatttcacattccttgaagccctagtaaaggcagacttctggctactgtttgttgtttacttttgtggagttggcacaggtgtcactgttctcaacaacctggctcaaattggaatgtctgttggtgctaatgacacaactattttgttgtgcctctttggcttctgcaactttgttggccgtatccttggtggatctgtctctgaacatttcgtaaggtcaaggatgctccctcgtcctttctggatgatgtgcacacaaataatcatggtggtaacgttcctgctcttcgcaactggccttcatagcttgatttatgtttcaactacactccttgggatctgctacggagtccaatttgctgtcatgataccaacggtctcggagctttttgggctgaaggacttcgggctaatgtacaacttcatgctgttagtgaatccacttggtgcattctttttctcagctcttcttgctggctacatctatgacaaggaggcagcaaggcagcacccaggtgtgctggagccttccgactgttatgggcctgattgtttcagattgactttctatgtctgtgccatcgtgtgttgctgcggtaccttgttgagcgtgctattcatatcgaggataaagccggtctatcagatgctctacgcaagtggatcgttcagacatcctcggagccaacagcagctccactga

SEQ ID NO: 21207 - protein, 583 aa, Sorghum bicolor
  misc_feature: Ceres ANNOT ID no. 8701759
  misc_feature: Up-regulated in shoot tissues in response to salicylic acid treatment
  misc_feature (21)..(268): Pfam ID: Nodulin-like Pfam Description: Nodulin-like
MAGGGGGGPGPGRVKAGSRPPWVGLAAAVWVQVAAGSAYVFPLYSHAIKEALGYNQQALTMLGVGNDVGENVGLVPGVLANRLPPWLILVIGSACAFFGFGTLWLAVTKTVAMPYWVLWIALCIGTNSSAWLGTAALVTNMRNFPLSRGTVAGLIKGYVAVSAAVYTETFNGMLGNSPTNLLLLLALGIPTACIVVMYFVRPCTPSLDEDNSTEHSHFMYTQISSVVLGIYLMVATILGDTLKLSQAVTYLLFGIMILLLLAPLAIPIKMTLYPNKQTKEKPSTLAPSYSTDSLSGADPENSQPLLGSASTTFATGTNESDDSTDLDLLLAEGEGAVNLKKKRGPRRGDDFTFLEALVKADFWLLFVVYFCGVGTGVTVLNNLAQIGMSVGANDTTILLCLFGFCNFVGRILGGSVSEHFVRSRMLPRPFWMMCTQIIMVVTFLLFATGLHSLIYVSTTLLGICYGVQFAVMIPTVSELFGLKDFGLMYNFMLLVNPLGAFFFSALLAGYIYDKEAARQHPGVLEPSDCYGPDCFRLTFYVCAIVCCCGTLLSVLFISRIKPVYQMLYASGSFRHPRSQQQLH

SEQ ID NO: 21208 - DNA, 1146 bp, Sorghum bicolor
  misc_feature: Ceres ANNOT ID no. 8701806
  misc_feature: Up-regulated in root tissues in response to methyl jasmonate treatment
  misc_feature: Up-regulated in shoot tissues in response to methyl jasmonate treatment
  misc_feature: Down-regulated in root tissues in response to salicylic acid treatment
  misc_feature: Up-regulated in shoot tissues in response to salicylic acid treatment
  misc_feature: Encodes the peptide sequence at SEQ ID NO 21209
atggccttgcaggtcaccggcggagtgggctgctgctgccctcgtcctcaaccgggctgtggcggccggcggttggcgcaggcggcggcggcgctctgtcgcccgccccgcgctgtagcgtcgtccggcacgaccacgacggtggtggaggaggacgagggcaaggtgaggctgggcggctcaagcgtcgccgtcaccaagctcggcatcggcgcgtggtcctggggcgacaccacctactggaacgactccgagtgggacgataggagactgagggaggcacaggacgcgttcgatgcgagcatcgataacgggatgaccttcttcgataccgcagaagtatacggtacagcgctcatgggagcagtcaattctgaaagtttactgggaggattcatcaaggaaaggcaacagaaggaccagatcgaggtggccgtcgcaacaaagttcgctgcccttccttggagatttggaaggggtagtgttctttccgcgctgaagaaatcactagaccgtcttggcctatcgtcggttgagctctaccaactccactggccagggatttgggggaacgaaggataccttgatggtctcgcagatgcttatgagcaaggcctagtaaaggctgttggagtctcaaactacaatgagaagcgccttcgggatgcgcatgctcgtctcaagaagaggggtgttccacttgctgcaaatcaggtgaattacagcctcatatacagaaccccggagctgaatggtgtgaaggcagcttgtgatgagctcggtatcaccttgattgcttattcaccgatagcccaaggtgttctgacaggtaagtacactccagaaaagccccctactggtcctcgagcaaatacatacacccctgagttcctcaccaagctccaaccacttatgaacaggattaaagagattggagcaagctatggcaagagtccaacccaggtgtctctgaactggctgacctgccaggggaatgtggtgccaatccccggagccaagaatgccagccaggccaaggagttcgctggtgcactcggttggagcctgacaggagacgaggtcgaagagctacgaactctggcacgcgagatcaagggcatcaagatgcctatcgaggagtcgtag

SEQ ID NO: 21209 - protein, 381 aa, Sorghum bicolor
  misc_feature: Ceres ANNOT ID no. 8701806
  misc_feature: Up-regulated in root tissues in response to methyl jasmonate treatment
  misc_feature: Up-regulated in shoot tissues in response to methyl jasmonate treatment
  misc_feature: Down-regulated in root tissues in response to salicylic acid treatment
  misc_feature: Up-regulated in shoot tissues in response to salicylic acid treatment
  misc_feature (67)..(378): SWISSPROT Homolog: EC 1.1.1.65 Pyridoxine 4-dehydrogenase
  misc_feature (59)..(369): Pfam ID: Aldo_ket_red Pfam Description: Aldo/keto reductase family
MALQVTGGVGCCCPRPQPGCGGRRLAQAAAALCRPPRAVASSGTTTTVVEEDEGKVRLGGSSVAVTKLGIGAWSWGDTTYWNDSEWDDRRLREAQDAFDASIDNGMTFFDTAEVYGTALMGAVNSESLLGGFIKERQQKDQIEVAVATKFAALPWRFGRGSVLSALKKSLDRLGLSSVELYQLHWPGIWGNEGYLDGLADAYEQGLVKAVGVSNYNEKRLRDAHARLKKRGVPLAANQVNYSLIYRTPELNGVKAACDELGITLIAYSPIAQGVLTGKYTPEKPPTGPRANTYTPEFLTKLQPLMNRIKEIGASYGKSPTQVSLNWLTCQGNVVPIPGAKNASQAKEFAGALGWSLTGDEVEELRTLAREIKGIKMPIEES

SEQ ID NO: 21210 - DNA, 3090 bp, Sorghum bicolor
  misc_feature: Ceres ANNOT ID no. 8701909
  misc_feature: Up-regulated in shoot tissues in response to methyl jasmonate treatment
  misc_feature: Up-regulated in root tissues in response to methyl jasmonate treatment
  misc_feature: Encodes the peptide sequence at SEQ ID NO 21211
atgcattccgcttccgccgccgccctccgcgccgcgcccaagccgagacccaagcagcaccctatccgctccttaccggcatccgcgagcgcgggcgcggcgggtggtgagctccaccccacggcctactacgccgccctcctcggatcgctctcccgggagtgccgccacgcccaccacccgttcgacgcgactcctcaccgaacccatcaggcgcgggcatgcggggtccttcacgcgcgggtcctgcgcctcggcctgcccctccggggccgtctcggcgacgcgctcgtcgacctgtacggcaggtccggccgcgtgggctacgcctggcgcgcgctgggctgctgcaccggggctccagcgtcaggcgctgcggcgagctcggtgctgtcctgccacgcgcggtcggggtcccctcgggacgttctcgatgcgttccagcgtctcaggtgttccattggcggcacgccagaccagtttggccttgcggtggttctgtccgcatgttcgcggctgggtgctctcgagcagggcaggcaggtgcattgtgatgtgctgaagagcgggttctgctccagtgccttctgtcaggctgggctggtggacatgtatgccaagtgcgttgaggtcaaggatgcgaggagggtgtttgatgggattgcttgccctgacacaatatgctgggcaagcatgattgcgggctaccatcgggttggacgctaccagcaagcactggctttgttttctaggatggagaagatgggctctgctccagaccaggtaacatacgttaccatcatttccactcttgcaagcatgggcagactgtctgacgcaagaactctgctgaagaggatacaaatgccaagcacggttgcttggaacgctgtcatctcaagttattcacaaagtggtcttgagagtgaagtgtttggcctgtacaaggatatgaagagacagggattgatgccaactaggtccacttttgcgagcatgctaagtgcagcagccagcatgacagcatttgatgaaggtcaacagatacatgcagcggcagtaaagcatggcttagatgcaaatgtttttgtgggcagttcactgatcaacctgtatgtgaaacatggctgcatctctgatgcaaagaaggtgtttgacttctccactgaaaagaacattgtcatgtggaatgcaatgctttatgggtttgttcaaaatgatctccaagaagagaccattcagatgtttcagtatatgaggagggctgatcttgaggctgatgattttacatttgtgagtgtccttggcgcgtgcattaacttggattcacttgatataggtaggcaggtacactgtataacaatcaagaacagcatggatgcagacttgtttgttgctaatgcaatgctagatatgtactcaaaacttggagcaattgatgtcgcgaaagcattattcagtctcattccaggcaaggatagtgtatcctggaatgctcttatagttgggcttgcacataatgaagaggaggaagaagcggtctatatgcttaaaaggatgaagtgctatggtatagctccagatgaggtgtcttttgcaactgcaattaatgcctgttccaacatccgggctactgagactggaaagcaaattcattgcgcatctatcaagtataatgtctgctcaaatcatgctgttggcagctctctgattgacctgtattcaaagtttggagatgtagaatcttctaggaaggttttagcacatgtagatgcaagcagcatggttccaataaatgctctaattacaggtcttgtgcagaacaatagagaagatgaagccatagagttatttcagcaagtgctaaaagatgggttcaagccgtctaactttacatttgcaagcattctttctgggtgtactggacctgtcagttcagtaattggcaaacaagtccatagctacacgctgaaatctgctcttttgaatcaggatacttcacttggcatctctcttgttggaatatatttgaagtgcaagttgcttgaggatgcaaacaaactcttagcagaggtgccagatcacaaaaacctggttgagtggacagctactatttcagggtatgctcaaaatggttacagtgatcaatctttggtgatgttttggagaatgcgcagtcacgatgttcgttcagatgaggccacattcgctagtgttctgaaagcttgttctgagatagcagcacttacagatggaaaagagatacatgggctcattatcaaatctggttttgtttcttatgaaactgcagccagtgccctcatggacatgtactccaagtgtggcgatgttatttcttcctttgaaatcttcaaggaattgaaaaacaagcaaaatataatgccatggaactccatgattgttggttttgcgaaaaatggttatgcaaacgaggcacttcttctcttccagaagatgcaagaatcacaactaaagcctgatgaagtcacactccttggtgttctcattgcttgtagccatgctggtttaatttccgaaggccggaatttgtttgactctatgagccaagtttatgggatagtgcccagagtagatcactatgcatgtctcattgatctacttgggcgtggtggtcatcttcaagaagctcaagaagttattgaccagttacccttcagagctgatggtgtaatctgggctacattccttgcagcatgtcaaatgcacaaggatgaagaaagagggaaagttgcagcaaagaaacttgttgagatggaaccacaaaggtcgtccacgtatgtgttcctttcaagcttgcatgctgcggctggtaattgggttgaagctaaggtagccagagaagctatgcgagaaaaaggggtgatgaaatttccagggtgtagttggatcacagtgggtaacaaaacaaacttatttgttgtacaggacacacatcatccggacactctgggcatctacaaaatgcttgatgatctaactggaatgatgaataaagatgacagaattgaggaatatgatctgcgtagcttgtctgaaatgcttacttga

SEQ ID NO: 21211 - protein, 1029 aa, Sorghum bicolor
  misc_feature: Ceres ANNOT ID no. 8701909
  misc_feature: Up-regulated in shoot tissues in response to methyl jasmonate treatment
  misc_feature: Up-regulated in root tissues in response to methyl jasmonate treatment
  misc_feature (801)..(835): Pfam ID: PPR Pfam Description: PPR repeat
  misc_feature (293)..(327): Pfam ID: PPR Pfam Description: PPR repeat
  misc_feature (495)..(529): Pfam ID: PPR Pfam Description: PPR repeat
  misc_feature (227)..(261): Pfam ID: PPR Pfam Description: PPR repeat
  misc_feature (596)..(630): Pfam ID: PPR Pfam Description: PPR repeat
  misc_feature (394)..(428): Pfam ID: PPR Pfam Description: PPR repeat
MHSASAAALRAAPKPRPKQHPIRSLPASASAGAAGGELHPTAYYAALLGSLSRECRHAHHPFDATPHRTHQARACGVLHARVLRLGLPLRGRLGDALVDLYGRSGRVGYAWRALGCCTGAPASGAAASSVLSCHARSGSPRDVLDAFQRLRCSIGGTPDQFGLAVVLSACSRLGALEQGRQVHCDVLKSGFCSSAFCQAGLVDMYAKCVEVKDARRVFDGIACPDTICWASMIAGYHRVGRYQQALALFSRMEKMGSAPDQVTYVTIISTLASMGRLSDARTLLKRIQMPSTVAWNAVISSYSQSGLESEVFGLYKDMKRQGLMPTRSTFASMLSAAASMTAFDEGQQIHAAAVKHGLDANVFVGSSLINLYVKHGCISDAKKVFDFSTEKNIVMWNAMLYGFVQNDLQEETIQMFQYMRRADLEADDFTFVSVLGACINLDSLDIGRQVHCITIKNSMDADLFVANAMLDMYSKLGAIDVAKALFSLIPGKDSVSWNALIVGLAHNEEEEEAVYMLKRMKCYGIAPDEVSFATAINACSNIRATETGKQIHCASIKYNVCSNHAVGSSLIDLYSKFGDVESSRKVLAHVDASSMVPINALITGLVQNNREDEAIELFQQVLKDGFKPSNFTFASILSGCTGPVSSVIGKQVHSYTLKSALLNQDTSLGISLVGIYLKCKLLEDANKLLAEVPDHKNLVEWTATISGYAQNGYSDQSLVMFWRMRSHDVRSDEATFASVLKACSEIAALTDGKEIHGLIIKSGFVSYETAASALMDMYSKCGDVISSFEIFKELKNKQNIMPWNSMIVGFAKNGYANEALLLFQKMQESQLKPDEVTLLGVLIACSHAGLISEGRNLFDSMSQVYGIVPRVDHYACLIDLLGRGGHLQEAQEVIDQLPFRADGVIWATFLAACQMHKDEERGKVAAKKLVEMEPQRSSTYVFLSSLHAAAGNWVEAKVAREAMREKGVMKFPGCSWITVGNKTNLFVVQDTHHPDTLGIYKMLDDLTGMMNKDDRIEEYDLRSLSEMLT

SEQ ID NO: 21212 - DNA, 2175 bp, Sorghum bicolor
  misc_feature: Ceres ANNOT ID no. 8702009
  misc_feature: Up-regulated in shoot tissues in response to methyl jasmonate treatment
  misc_feature: Encodes the peptide sequence at SEQ ID NO 21213
atgagacgggccggaggaggagacctgcagggcgaccacggcacgacgcctcggtccgcggcggcagggcaggccatggtggagctgcaggccaacgggtcggcggccgccgccgggggcgccatggtggtgggtctcagcccgctcagcgagaccctgtggcgggacagcaaggcgctcccgccgggtgccggccccgccgcgctcatcggcgacgtgtccgccaggctcacgtggaaggacctctgcgtcaccgtggcgctcggccccggcaagacgcagaccgtgctggacgaactcaccgggtacgcggagcccggctcgctcaccgcgctcatgggcccctccgggtccggcaagtccaccctgctcgacgccctcgccggccgcctcgccgccaacgccttcctctccggcgacgtgctcctcaacggccgcaaggccaagctctccttcggcgccgcggcgtacgtgacgcaggacgacaacctgatcgggacgctgacggtgcgcgagacgatcggctactcggcgctgctgcggctgccggacaagatgccgcgggaggacaagcgcgcgctggtggagggcaccatcgtcgagatggggctccaggactgcgccgacaccgtcatcgggaactggcacctccgcggggtcagcggcggcgagaagcgccgcgtcagcatcgcgctcgagctcctcatgcgcccgcgcctcctcttcctcgacgagcccaccagcggcctcgacagctcctcggcgttcttcgtgacgcagacgctgcgaggcctggccagggacggcaggacagtgattgcttccatccaccagcccagcagcgaggtgttcgagctcttcgacatgctcttcctgctgtccgggggcaaaaccgtctacttcggccaagcatcgcaagcatgtgagttctttgctcaaggcggtttcccttgcccgcctctgaggaacccatcggaccatttcctgaggtgcgtcaactcggacttcgacaaggtgaaggccacactgaaaggatcaatgaaggcaagggctgagaggtccgacgatccactcgataggatgactacatcagaagccatcaggaaattggttggatcctacagcaggtcccaatactactacgctgcgagggagaaagttaatgatatctcgagaatgaaaggaactgtgctggattcaggtggcagccaggctagcttcctgatgcaggcttgcaccctgaccaagcgctcgttcatcaacatgtcacgggactttgggtattactggctcaggctcctgatctatctcctcgtgactgtttgcatcggcacaatctacctggatgttggcactaaatacacatccatcctggccagagcttcctgttctgcattcgtctttgggttcgttacgttcatgtccattggaggattcccttcgtttgttgaagaaatgaaggtcttccaacgggaacggctgaatgggcactatggtgtcgcggcatttgtcatcagtaacaccatctcagcaacgccattcctgattctaatatgcttcttgtcgggaactatatgctactttatggtgcgcctgcatcctggtttcgaacactatatcttcttcgtcttgaacctgtatgccagcgtcacagtggtcgaaagcttaatgatggcaattgccagtgtcattcccaatttcctcatgggtatcatcataggggctggaattcagggaatatttatgctggtgtctggctacttcagacttccatacgacattccaaagcctttttggagataccccatgcagtacatcagcttccattactgggcactgcagggccagtgccagaacgacatgaaaggcctcgtattcgacaaccagtacccagatcaacccaagatccccggggacttcatcctgaagtacatcttccagatcaacgtggaccggaacaagtggatcgacttgtcagtcattttcagcatgatcttcatctaccgcatcctcttcttcctcatgatcaagatcaacgaggatgtgctgccgtggatccgtggccacatcgcgaggaagagaatgcagaagaaaggccctagtcccagtttcggcaagacgccttcgctgagaggctatgttgtggatccagagctcggttccaacgagggctag

SEQ ID NO: 21213 - protein, 724 aa, Sorghum bicolor
  misc_feature: Ceres ANNOT ID no. 8702009
  misc_feature: Up-regulated in shoot tissues in response to methyl jasmonate treatment
  misc_feature (91)..(304): SWISSPROT Homolog: EC 3.6.3.28 Phosphonate-transporting ATPase
  misc_feature (107)..(296): Pfam ID: ABC_tran Pfam Description: ABC transporter
  misc_feature (409)..(621): Pfam ID: ABC2_membrane Pfam Description: ABC-2 type transporter
MRRAGGGDLQGDHGTTPRSAAAGQAMVELQANGSAAAAGGAMVVGLSPLSETLWRDSKALPPGAGPAALIGDVSARLTWKDLCVTVALGPGKTQTVLDELTGYAEPGSLTALMGPSGSGKSTLLDALAGRLAANAFLSGDVLLNGRKAKLSFGAAAYVTQDDNLIGTLTVRETIGYSALLRLPDKMPREDKRALVEGTIVEMGLQDCADTVIGNWHLRGVSGGEKRRVSIALELLMRPRLLFLDEPTSGLDSSSAFFVTQTLRGLARDGRTVIASIHQPSSEVFELFDMLFLLSGGKTVYFGQASQACEFFAQGGFPCPPLRNPSDHFLRCVNSDFDKVKATLKGSMKARAERSDDPLDRMTTSEAIRKLVGSYSRSQYYYAAREKVNDISRMKGTVLDSGGSQASFLMQACTLTKRSFINMSRDFGYYWLRLLIYLLVTVCIGTIYLDVGTKYTSILARASCSAFVFGFVTFMSIGGFPSFVEEMKVFQRERLNGHYGVAAFVISNTISATPFLILICFLSGTICYFMVRLHPGFEHYIFFVLNLYASVTVVESLMMAIASVIPNFLMGIIIGAGIQGIFMLVSGYFRLPYDIPKPFWRYPMQYISFHYWALQGQCQNDMKGLVFDNQYPDQPKIPGDFILKYIFQINVDRNKWIDLSVIFSMIFIYRILFFLMIKINEDVLPWIRGHIARKRMQKKGPSPSFGKTPSLRGYVVDPELGSNEG

SEQ ID NO: 21214 - DNA, 3072 bp, Sorghum bicolor
  misc_feature: Ceres ANNOT ID no. 8702017
  misc_feature: Up-regulated in root tissues in response to methyl jasmonate treatment
  misc_feature: Up-regulated in shoot tissues in response to methyl jasmonate treatment
  misc_feature: Encodes the peptide sequence at SEQ ID NO 21215
atggcgcgaccgcagctgggcggcggtggtcttgctgcctctgctctgctcgattacgtcgggtgcgcgcggttgcgtttgcgcttgcgccaccgcggcggcctgctccgctcgtccgtcccccgacgaaacgatccagaccgatcgcgactcgtggtcgagcgcagggaccgaagggacaccagatgcgttcgtgcctgccgccgtgctcctgctggctggcccgggaccgggagcgggaccgcgcggcgcgccgcggcagcgcgggaaattcaaaagacacttccttttccaccttctggaaaatcatcaatcaacgaacaagacaaaacagaggccactggtggacggaaagtttcaccaccagcaaggattcggccgcagccgcagccgcagcgggggagaggaggggaggggggtggcaagcgcaagcatcaccaccgcaataacaacgacgacggcaccagcaccaaccaccacttttcgagggaaggcacaggcacaggcaggcgcgcggcacggggcaggaacccgtcgcgattggcccgtccgacgacgaaccggtcgcgggcctcctcgtgcccgtggtggatctgtcgccacctgcgcgcaggcgcggtcgcgggcgctttgcttcccgctcctccctcctcgtcgacgccgcggcgtcgacgcctgccgccgaccgggcaatttgcatccgcgggacggcagcgccgtgtcgactccatcttcctcggcggtcaatgcgggcgcggagatgagcgccggcggcggggaggaggaagaggaggaggaggaggaggaggagacgatgacgacaacgaccgcccgcgacggcgccgggacggggccgcctctgccgccgctgccgcggcggcggcggcggcggcgctcgacgtgtggacgtctgagccggcgcccgtgcaggagcggcgccggaagctgctccagatgatggggctcgccggggaccccgccctagcgcgcctcgagatgggccgatcggtctcctacgacgggcccgtccgcccggcgccggtctcgcccatctcccgatccagatcagacggcgccgtgccggtctcagggaccaagcccccgctgggcgggcggtcgcgccaggcgtcgtcttcgggctcctccgaggccacgcccgaaggggaggagaccgacccgaggtgcctaatccggaacctcgacgacggcagcgagttcgtggtcaaggaggagttccagctccgcgaggtcggcacgggccgccagctcaccatggaggagtttgttgacctctgcgtcggccgctcgcctatcgtccaggagctcatgcgacgcgagaatgttgccaactccggctcaaacaacggctcgtccaccccaatccagaggtccaactccgactccagcaacggggcaacgcgtcaacggcggcatagcagctggcttcggagcattcgaaacgtcgtcggctcccgcgaccgccgcagcagcgacgacaaggacacgtcctcggagaaaggcgggcgccggtccagctcagcaacagatgacagccaggacagcgccggagccgtgcaccatggcccggtacgcgttaaggtgaggcagtatgggaagtcgtacaaggagctcagtggcctattcatgaaccaggagattcaggctcacaatgggtccatctggagcatcaggtttagtccagatggccggtacctcgcgagtgctggggaagactgcgtgatccatgtctgggaagtgtcagagtttgagaggaaacgcgaggaaaacggagtgtgcaaccctcttgttgccatggtgtgcaatggttcgccggagccaacattagcgttggccagcagtgtggatgggagcaattgtgagaagaagcgtcgggcaaggttcttggagggtcgtagtcgtaggtctgtgagctcagaccggctaatggtgccagagcatgtgtttgcgctgtcagaaaaaccgattcggaccttcgtggggcattcagaagacgtacttgatctctgctggtccaaatcccagtacttactttcatcttcaatggataaaacagtgaagttgtggcacatttcgagcgcttcctgtatgaaaacattctcacacagtgactatgtgacatgcatccagttcaaccctgttgatgatagatacttcattagtggttcactggatgaaaaagtccgcatatggagcattcaaaaccgtgaaattgttgattggaaagatttgcatgaaatggtcactgctgtttgctataccccagatggacagagtgcaataattggttccaataaaggcagctgccatatttatgatacatctgataataagcttctccgaaagaaacaaattgacctgcaaaataagaaaaagaagtccagtcagaagaaaatcactggatttcagtttctcccagggagtacttcaaaggtccttattacatctgcagattcaagaatcagggttgttgatggccttaatctagttcacaagtacaaaggtttccgaaacactaacagccagatttcagcctgtttagctgcaaatgggaggtatgtgatctcagcaagtgaggattcccatgtgtacatatggagaaacgatgataaccttggacaaggcagaagcaaggggaatgctactgtcaccaattcctatgaacatttccactgccaggatgtgacggttgctgttgcactgccatctaatggctcagcaatagtatccagagcaaactccatgaagcgcaacgagcaggattctgtattggagcattctctgctgcatgttgtccctgaaaaactgcaagattcctatgatcctcaaagtggcaatatcctaagcaccagttcaaatcacagcggtgatagagcaacttggcctgaagagctcatgacgccaacaaagcagagccctcgttctagtgccagtcttcccagtggcgctgatcaagctccaagccggtcagcctggggaactgtaattgtcacggcaggccggggaggtcagatcagaacatttcagaattttgggtttcctgctcgagtatag

SEQ ID NO: 21215 - protein, 1023 aa, Sorghum bicolor
  misc_feature: Ceres ANNOT ID no. 8702017
  misc_feature: Up-regulated in root tissues in response to methyl jasmonate treatment
  misc_feature: Up-regulated in shoot tissues in response to methyl jasmonate treatment
  misc_feature (662)..(779): SWISSPROT Homolog: EC 2.7.11.7 [Myosin heavy-chain] kinase
  misc_feature (659)..(696): Pfam ID: WD40 Pfam Description: WD domain, G-beta repeat
  misc_feature (547)..(585): Pfam ID: WD40 Pfam Description: WD domain, G-beta repeat
  misc_feature (700)..(738): Pfam ID: WD40 Pfam Description: WD domain, G-beta repeat
MARPQLGGGGLAASALLDYVGCARLRLRLRHRGGLLRSSVPRRNDPDRSRLVVERRDRRDTRCVRACRRAPAGWPGTGSGTARRAAAAREIQKTLPFPPSGKSSINEQDKTEATGGRKVSPPARIRPQPQPQRGRGGEGGGKRKHHHRNNNDDGTSTNHHFSREGTGTGRRAARGRNPSRLARPTTNRSRASSCPWWICRHLRAGAVAGALLPAPPSSSTPRRRRLPPTGQFASAGRQRRVDSIFLGGQCGRGDERRRRGGGRGGGGGGGDDDDNDRPRRRRDGAASAAAAAAAAAAALDVWTSEPAPVQERRRKLLQMMGLAGDPALARLEMGRSVSYDGPVRPAPVSPISRSRSDGAVPVSGTKPPLGGRSRQASSSGSSEATPEGEETDPRCLIRNLDDGSEFVVKEEFQLREVGTGRQLTMEEFVDLCVGRSPIVQELMRRENVANSGSNNGSSTPIQRSNSDSSNGATRQRRHSSWLRSIRNVVGSRDRRSSDDKDTSSEKGGRRSSSATDDSQDSAGAVHHGPVRVKVRQYGKSYKELSGLFMNQEIQAHNGSIWSIRFSPDGRYLASAGEDCVIHVWEVSEFERKREENGVCNPLVAMVCNGSPEPTLALASSVDGSNCEKKRRARFLEGRSRRSVSSDRLMVPEHVFALSEKPIRTFVGHSEDVLDLCWSKSQYLLSSSMDKTVKLWHISSASCMKTFSHSDYVTCIQFNPVDDRYFISGSLDEKVRIWSIQNREIVDWKDLHEMVTAVCYTPDGQSAIIGSNKGSCHIYDTSDNKLLRKKQIDLQNKKKKSSQKKITGFQFLPGSTSKVLITSADSRIRVVDGLNLVHKYKGFRNTNSQISACLAANGRYVISASEDSHVYIWRNDDNLGQGRSKGNATVTNSYEHFHCQDVTVAVALPSNGSAIVSRANSMKRNEQDSVLEHSLLHVVPEKLQDSYDPQSGNILSTSSNHSGDRATWPEELMTPTKQSPRSSASLPSGADQAPSRSAWGTVIVTAGRGGQIRTFQNFGFPARV

SEQ ID NO: 21216 - DNA, 1512 bp, Sorghum bicolor
  misc_feature: Ceres ANNOT ID no. 8702060
  misc_feature: Up-regulated in root tissues in response to aminocyclopropane carboxylic treatment
  misc_feature: Encodes the peptide sequence at SEQ ID NO 21217
atggcgacggcggctccggcagcggcggactgccggctggtgcgcaccgtgctcgcggcagcgctgtcgaggaccaccgccgccttcctcttcctctccgtcgtcgccgtcggggtggtcgtctccggccgctggatcaccgccgccaccaccgctggacccctgaccctcaacctctccaaccccgccaaagcgcccaaaacctcccaaaccctcgcgcgcgctctctcctctccctccatctgcccggcctccccgagcccgcccccgccctccccctccgccgccggctcgccatcctccaacaactcgtgcccgtcctacttccgcttcatccacgaggacctccgcccatggcgcgccgcgggcggtatcacgcgcgccatgctcgaccgcgcccgcctcaccgccaccttccgcctcgtcgtgctcgggggccgcgcctacgtccatcggttgcgcccggcgttccagacccgggacctattcaccatctggggcgtcctccagcttctccgtcgctaccccggccgcgtccccgatctcgacctcatgttcgacaccgtcgactggcccatcgtccgcgcccacctctaccgcgggaagtacgccgagatgttgccaccgctgttccgctactgcggggatgataaaacactggatatcgtcttcccggattggtcgttctggggatggccggagatcaacataaagccatgggatgccctgcaggaggacttgaaggatggtaataacagagtgagatggatggatagagagccttatgcttactggaaagggaatccatcagtttctgcgacacgtaaggaactggttaagtgtaatgtctctagtacacatgattggaacgcaaggatttacgctcaggactggttcaaggagagcaaggcaggatataaggactcagatttgagtagtcagtgtgctcacaggtacaagatctatattgaaggatcagcatggtccatcagtgagaaatatatactagcatgtgattcaatgaccctgttggttacaccaagatactatgatttcttttcaaggtcacttatgccaactcagcattattggcctgttcgggatgacaataaatgtgcctccataaaatatgctgttgattggggcaactctcacaagcaaatggcacagcacataggaaagcaagcaagtaatttcattcaagaagagctcaatatggaccatgtttatgactacatgcttcatcttctaactgaatatgccaagctcctaaaattcaagcccactaagccacctgaagctgttgaggtctgttcagagtctttggtctgccaagctgaaggtctcgagaagaagtttcttgtggaatccatggtgaagtttgcccgtgatgcaggcccatgtgatctgcctcctcctttcgaccctcatgagctaaagttgctaaagcagaggaaagaaaattcaataaagcagattcaaatgtgggagcaaagagatttaggggcttag

SEQ ID NO: 21217 - protein, 503 aa, Sorghum bicolor
  misc_feature: Ceres ANNOT ID no. 8702060
  misc_feature: Up-regulated in root tissues in response to aminocyclopropane carboxylic treatment
MATAAPAAADCRLVRTVLAAALSRTTAAFLFLSVVAVGVVVSGRWITAATTAGPLTLNLSNPAKAPKTSQTLARALSSPSICPASPSPPPPSPSAAGSPSSNNSCPSYFRFIHEDLRPWRAAGGITRAMLDRARLTATFRLVVLGGRAYVHRLRPAFQTRDLFTIWGVLQLLRRYPGRVPDLDLMFDTVDWPIVRAHLYRGKYAEMLPPLFRYCGDDKTLDIVFPDWSFWGWPEINIKPWDALQEDLKDGNNRVRWMDREPYAYWKGNPSVSATRKELVKCNVSSTHDWNARIYAQDWFKESKAGYKDSDLSSQCAHRYKIYIEGSAWSISEKYILACDSMTLLVTPRYYDFFSRSLMPTQHYWPVRDDNKCASIKYAVDWGNSHKQMAQHIGKQASNFIQEELNMDHVYDYMLHLLTEYAKLLKFKPTKPPEAVEVCSESLVCQAEGLEKKFLVESMVKFARDAGPCDLPPPFDPHELKLLKQRKENSIKQIQMWEQRDLGA

SEQ ID NO: 21218 - DNA, 1518 bp, Sorghum bicolor
  misc_feature: Ceres ANNOT ID no. 8702059
  misc_feature: Up-regulated in shoot tissues in response to aminocyclopropane carboxylic treatment
  misc_feature: Up-regulated in root tissues in response to methyl jasmonate treatment
  misc_feature: Up-regulated in shoot tissues in response to methyl jasmonate treatment
  misc_feature: Up-regulated in shoot tissues in response to salicylic acid treatment
  misc_feature: Encodes the peptide sequence at SEQ ID NO 21219
atggaggccgcggcggcaccgaaggcgtcgtcccggctcgctcggagcctggctgctgcagcgccttgttacagcggcgtgttcgtcttcttcgccgcgctcgtcgccggagctctcgtctccgcctgctggatgtctgtcagcgccagagtcactccgatcactcctgtcgccaccccaggcatagcacacaacgctgcaacggggccggagccagcgccgggtccgccacggttccccgccatcgtcggtgcgagcacgaaccaaacgccgtcggcagcggccagtttcgcgccacccgccccggcgcccgcggaagcagacgcgccgccgccggactgcccatcctacttccggtggatccacgaggacctgcggccgtggcgcgccgcgggggtcacgcgcggcgcgttggagggcgcgcgccggctattcgcgcccaagttccgcgtcaccgtggtcgcgggccgcctgtacgtggcgcgctacggccggtgcttccagacgcgcgccgcgttcacgcagtggggcatcctgcagctgctacgccgctaccccggccgcgtcccggacctcgacctcatgttcgactgtgacgacctgcccgtcgtcggcgctggcgaccgccaccaggcgccgccgccgctgttccggtactgcggcagcgagaccacgctggacatcgccttccctgactggtcattctggggttggccggagctcaacataaagccatgggaggcgctgcgaagggagatcaacgaagagaacgccatggtgaactggatggacagggcgccgtacgcgtactggaaggggaaccccaaggtgggcgccgaacgcctgcttctcctcaggtgcaacgcgtccggcgagcgtgactggaacgcgcgagtatacgcgcaggactggggaaaggaggtgcggcacggattcaggggatcggacctgtccaagcagtgcacacacaggtacaagatttacatcgaggggcgggggtggtcggtgagcgagaagtacatcctggcgtgcgactcggtggcgctcatggtgcggccgaggttccacgacttcttctcgcgggggctgtcgccgctgcgtcactactggcccgtccgcggcgaccgaggcatgtgccggtccatcaagtacgccgtggactggggcaacgctcacacggacagggcgcaggagatggcggggaacgcgagcaggttcatccaggaggagctgacgatggaccgcgtctacgactacatgttccacctcctcacagagtacgccaggctgctgcggtacaggcccgaggtgccgcgcggcgccgcggaggtcaccgtcgagtccatgacccggggaaagcgggggctggagaggcagttcatggcggacacggcggtggccgccgcgaacggcgaaggcccctgcaggctgcagccggcttacagtgccgaggaactagaggcgctgcggagagcgagagaggatgtggtgaggcaagtggaggcgtgggagaagtag

SEQ ID NO: 21219 - protein, 505 aa, Sorghum bicolor
  misc_feature: Ceres ANNOT ID no. 8702059
  misc_feature: Up-regulated in shoot tissues in response to aminocyclopropane carboxylic treatment
  misc_feature: Up-regulated in root tissues in response to methyl jasmonate treatment
  misc_feature: Up-regulated in shoot tissues in response to methyl jasmonate treatment
  misc_feature: Up-regulated in shoot tissues in response to salicylic acid treatment
MEAAAAPKASSRLARSLAAAAPCYSGVFVFFAALVAGALVSACWMSVSARVTPITPVATPGIAHNAATGPEPAPGPPRFPAIVGASTNQTPSAAASFAPPAPAPAEADAPPPDCPSYFRWIHEDLRPWRAAGVTRGALEGARRLFAPKFRVTVVAGRLYVARYGRCFQTRAAFTQWGILQLLRRYPGRVPDLDLMFDCDDLPVVGAGDRHQAPPPLFRYCGSETTLDIAFPDWSFWGWPELNIKPWEALRREINEENAMVNWMDRAPYAYWKGNPKVGAERLLLLRCNASGERDWNARVYAQDWGKEVRHGFRGSDLSKQCTHRYKIYIEGRGWSVSEKYILACDSVALMVRPRFHDFFSRGLSPLRHYWPVRGDRGMCRSIKYAVDWGNAHTDRAQEMAGNASRFIQEELTMDRVYDYMFHLLTEYARLLRYRPEVPRGAAEVTVESMTRGKRGLERQFMADTAVAAANGEGPCRLQPAYSAEELEALRRAREDVVRQVEAWEK

SEQ ID NO: 21220 - DNA, 657 bp, Sorghum bicolor
  misc_feature: Ceres ANNOT ID no. 8702091
  misc_feature: Down-regulated in shoot tissues in response to aminocyclopropane carboxylic treatment
  misc_feature: Up-regulated in root tissues in response to methyl jasmonate treatment
  misc_feature: Up-regulated in shoot tissues in response to methyl jasmonate treatment
  misc_feature: Encodes the peptide sequence at SEQ ID NO 21221
atggcgaccacggcgtttctatccccggccaagctggcgctgcaagggcgccggttcgcgagcgccaagacggcgggagcggggcgcgtcagcgtcagggtgagggtccctccggcgcgcgcccagcaacaagagcagcaggtggaggaggaggcggccgaggtggcgaccctgccgccggcgcagggcggcgccgaggagcaggcgcaggcgaggaagggggacgcgcagtcgctgccgcggcagccgctggcggagaacaagaacatgagccgcgagtacggcggacagtggctgagctgcacgacgcggcacgtccgcatctacgcggcgtacatcgacccggtgaccaacgtgttcgaccagacgcagatggacaagctgacgctcatgctcgacccgcaggacgagttcgcctggaccgacgaggcatgccagatggtcttcaacgagttccaggacctcgtcgatcactacgagggagctgagctgtcggagtacacacttcggttgatcgggtcagaccttgagcactacatccgcaaaatgctgtacgacggggtgctcaagtacaacatgaggtccagagtcctcaatttcagcatgggcaagcctcggatgaagttcaacagcaaccagatcccagaagcgaaatag

SEQ ID NO: 21221 - protein, 218 aa, Sorghum bicolor
  misc_feature: Ceres ANNOT ID no. 8702091
  misc_feature: Down-regulated in shoot tissues in response to aminocyclopropane carboxylic treatment
  misc_feature: Up-regulated in root tissues in response to methyl jasmonate treatment
  misc_feature: Up-regulated in shoot tissues in response to methyl jasmonate treatment
MATTAFLSPAKLALQGRRFASAKTAGAGRVSVRVRVPPARAQQQEQQVEEEAAEVATLPPAQGGAEEQAQARKGDAQSLPRQPLAENKNMSREYGGQWLSCTTRHVRIYAAYIDPVTNVFDQTQMDKLTLMLDPQDEFAWTDEACQMVFNEFQDLVDHYEGAELSEYTLRLIGSDLEHYIRKMLYDGVLKYNMRSRVLNFSMGKPRMKFNSNQIPEAK

SEQ ID NO: 21222 - DNA, 1017 bp, Sorghum bicolor
  misc_feature: Ceres ANNOT ID no. 8702102
  misc_feature: Up-regulated in shoot tissues in response to salicylic acid treatment
  misc_feature: Encodes the peptide sequence at SEQ ID NO 21223
atggaggcgctgtggaagcaggcctccaggctcaaggaccaggtcgctcggcagtttggctatgggaattctgataatgcgtttacagacgagtcagaggttaaactgcatcagagattggaaaagctttacttatccactcgtgctgctaaacattttcaaagggacattgttcggggtgtggagggctatatagtcacaggatccaaacaagttgaaatagggaataaattgtctgatgacagccagaaatatggtgttgaaaacacatgtacaagtggtgatactttatccaaagctgctacatacttcggaaaggcacgctcacagatggaaaaggagcgtggcaacatgttgaaagcgtttggcacacaggtggcagagccactgcgggcaatggtaatgggtgcacctttagaggatgccagacatctggcccagagatatgacagaatgaggcaagaagctgaagcacaggttgttgaagtatcaagacggcagaacagggtgagggaatcagctgggaatggagatatgatatctaagttggaagctgctgagtacaagcttgaagaattgaagtcaaacatggtgggattagggagggaagctatcgcagcaatgtcggctgttgagactcagcagcaacggttgaccttacagcgtctcattgcactggttgaggctgagagagcttaccataagagagttctggagatacttgaccagttggaacaagaaatggtgtctgagcgccaaaaaattgaagcacccccgactccagcagctgaaaattatatgccaccaccaccaccaccatcttatgatgaagttaatggagcatttgcatccacttctgttaatgagtcagtccaatctgtcgatttcttcctaggagagatctcaagcaatggttgggcagaaggtgaatgcaagggcaaagcaggatggtttcctcatgcttatatcgaaaggcaagagcgtgttctagcaagcaaagttccacatatcttttag

SEQ ID NO: 21223 - protein, 338 aa, Sorghum bicolor
  misc_feature: Ceres ANNOT ID no. 8702102
  misc_feature: Up-regulated in shoot tissues in response to salicylic acid treatment
MEALWKQASRLKDQVARQFGYGNSDNAFTDESEVKLHQRLEKLYLSTRAAKHFQRDIVRGVEGYIVTGSKQVEIGNKLSDDSQKYGVENTCTSGDTLSKAATYFGKARSQMEKERGNMLKAFGTQVAEPLRAMVMGAPLEDARHLAQRYDRMRQEAEAQVVEVSRRQNRVRESAGNGDMISKLEAAEYKLEELKSNMVGLGREAIAAMSAVETQQQRLTLQRLIALVEAERAYHKRVLEILDQLEQEMVSERQKIEAPPTPAAENYMPPPPPPSYDEVNGAFASTSVNESVQSVDFFLGEISSNGWAEGECKGKAGWFPHAYIERQERVLASKVPHIF

SEQ ID NO: 21224 - DNA, 1755 bp, Sorghum bicolor
  misc_feature: Ceres ANNOT ID no. 8702171
  misc_feature: Down-regulated in shoot tissues in response to salicylic acid treatment
  misc_feature: Encodes the peptide sequence at SEQ ID NO 21225
atggcaagagacgggaaggagactaggcgccggagccgcaagagatcccgcgacgcctccctctccccctcctcggattccgactccccttcctcggcgtcctccccaagcagcagccctgagcgacggagccgcagcagcaagcggagtagatcatcctcatcgcaccgccaccgccaccgccacagccgcaaggacagcggccggtcgcggagctcccgcgacgaggaccgccgccgccggcatcggagaagacgggaccaggagagaaagcggcacggtggggatggtggcgggtcctccgactcccaatcgtcggaggaggatagggcggaggaggcgcgggagatcgtccgagatatcctcagggaattgccggccgtagccggagagcttcgccagcttctccaaatgatagacagtggtgaaggcattgatatttctggaatttctgacaagccattggtgaagcgcttgaagaaacttttccgatctctgagactgaaagaaagtgcaagtggggcttacttgctgcctccaaaaaatgttcctacacttgatattgttggatcattactattagcaggttccaaactttcagacaacaaaagtgaaaagtcagtatcaccatatagagaagaactaccacaggctaactttgatgtgcaaaataaagataaagatgactctatttccgaagagccgaaaattattggtgtggaagaggaacctcctaaaagaagggtaatcggtcctgcaatgccatctcgtgaattactggctgcagcagctgaaatgacagaggctcttaggtgccgggatgctgaactggaagccgatgatgatttgctcataggccccccaccgccagctgtagtcgctgaagctgcatctgcaaatgaagctgagcgatttgaagaggttactcgaatattggcagctgacacaaattcaccttatgatgttctgggggtaaattggaagatgtcaactgataacatgaagaaaaggtattggaagttgtcccttttagtgcacccggacaaatgtcctcatcctttagcacaagaggcattcgtgaaattaaataatgccttcaaagacttacaagaccctgataagagaggtgcaatagatgagaaaataaaaaagaaagaggagatggaacaatttgagattgagcttaaagcaatgcgtgaggctgcggaatggagacggttacaaggtgatgatgaacttttagcaggtccaaaagagtcacaggcacctaagagagatgaatggatgaccacattgccaccagagagaaaagcaggagtgccgatgcattcaactaaatcatttagtatgaatggtaaagaaggacgtggagacacaagtgtctggactgatacccctcttgatagagcacaaaaagcacaacaaagctatctagaagcctacaataagacaaaggcgattgcagaaggcgaggatgtaaagagcaaaaacccggatgcttcaattgtagataagtacaatacctccaaaagatcagtgtctcttgtgcagaagcaccgagagagtaaaaaggagaaaaagaaacaaaaacagcacgagaaagaagaatgggagggaaaccacccatggaagccatgggaccgggagaaggatctgactgctgggcgccaaaaggtagctttagacccagagaacatgtcacaaggattaacttcccgtttcgcatctggttctgttcagaggaacttcctgtaa

SEQ ID NO: 21225 - protein, 584 aa, Sorghum bicolor
  misc_feature: Ceres ANNOT ID no. 8702171
  misc_feature: Down-regulated in shoot tissues in response to salicylic acid treatment
  misc_feature (318)..(379): Pfam ID: DnaJ Pfam Description: DnaJ domain
MARDGKETRRRSRKRSRDASLSPSSDSDSPSSASSPSSSPERRSRSSKRSRSSSSHRHRHRHSRKDSGRSRSSRDEDRRRRHRRRRDQERKRHGGDGGGSSDSQSSEEDRAEEAREIVRDILRELPAVAGELRQLLQMIDSGEGIDISGISDKPLVKRLKKLFRSLRLKESASGAYLLPPKNVPTLDIVGSLLLAGSKLSDNKSEKSVSPYREELPQANFDVQNKDKDDSISEEPKIIGVEEEPPKRRVIGPAMPSRELLAAAAEMTEALRCRDAELEADDDLLIGPPPPAVVAEAASANEAERFEEVTRILAADTNSPYDVLGVNWKMSTDNMKKRYWKLSLLVHPDKCPHPLAQEAFVKLNNAFKDLQDPDKRGAIDEKIKKKEEMEQFEIELKAMREAAEWRRLQGDDELLAGPKESQAPKRDEWMTTLPPERKAGVPMHSTKSFSMNGKEGRGDTSVWTDTPLDRAQKAQQSYLEAYNKTKAIAEGEDVKSKNPDASIVDKYNTSKRSVSLVQKHRESKKEKKKQKQHEKEEWEGNHPWKPWDREKDLTAGRQKVALDPENMSQGLTSRFASGSVQRNFL

SEQ ID NO: 21226 - DNA, 2184 bp, Sorghum bicolor
  misc_feature: Ceres ANNOT ID no. 8702257
  misc_feature: Up-regulated in shoot tissues in response to salicylic acid treatment
  misc_feature: Encodes the peptide sequence at SEQ ID NO 21227
atgacgacggctacctggtggcccggacaacacggcgacgtcttaaacggcgtaggaaggcaacgacatggaacatccggtggaggagccgaggaggacaggtggttgtgggagccgctggccgcctggctagctggacctatggtcgaacaagtgggaggcaataatggaggtgctcacggtgatgcaggcataggtggtggacagattgagattctcgccgaagtcgaggtcgctgccgaaggagtcgtgcctcgtcgagcgggaggactatctctattctttccggtcaggatgatgaggtttttggtcgccgatgacgggagagagcgctcacggagtggtggtcgtgtgccccattcactagagggagttggtgtccgaggcaaggtcggcactgctgtgcacgggcagaatgctgcacttggcgagcttgacattgatggacttgctcgatgggcgaagcctgacatgggccgacgctcatctccctcgcagcgccgctcaggctcggtccctcagcgcagatcttctgctccttcccccactcgcgctcaggctcggtcccaaggatcggatcttccgcgcgtcggcggctcccccctcggcggcgtccagcgacggaggggcagtcccaggctcggcggcggcgtcggcggcttcccccaccttctctcgccagtcgcctcgcgccctcgcctgcgtcctccgcgcaccggccgacgaccctgcgcaaaccttgctgattcttttctagcagatctggatgaactgtcagacaatgaaggctatcctgaagaagacaatgctgaggaagtgggaagagaagaagaagacgacgatatggctgaccttgagtctctaaattatgatgatcttgatagtgtctcaaagttgcaaaagacacaacgctatcatgatataatgcaaaaagttgaagttgcacttcagaaaggcactgacttctctagtcaaggtttcatcctggaggaggatccagagtaccagcttattgttgactgcaatgctttatcagtagatattgagaatgaaataatcataatccataatttcatacgggacaaatataggttgaagtttcctgaattggagtcccttgttcatcacccaatcgattatgcccgtgttgtcaagaagattggaaatgagatggatttaacacttgtagatctggaagggcttttaccttctgcaattataatggttgtttcagtgacagcatcaacaacaagtgggaagcctctttctgaagacaatttggaaaaaaccactgaagcatgtgacagagcccttacccttgatgcggcaaagaagaaagtgcttgattttgtagagagcagaatggggtaccttgcaccaaacctttctgcaattgttggcagtgctgttgcctccaaactgatgggtactgcaggtggtctgggagcacttgcaaaaatgcctgcttgtaatgttcagttacttggtgcaaagaggaaaaatcttgctggattttctactgcctcttctcagtttcgtgttggctatctggaacaaactgaagtatttcagagcacccctccagctttaaggactcgtgcctgcagacttattgctgcaaaatcaactctggcggcaaggattgattcaattagaggtgatccaactggaaaagctggacgaaacttgttagaagaaattcgtaagaagatcgagaagtggcaagaaccgcctcctgccaagctcccaaagccacttccagttccggactccgagcctaaaaagaagagagggggccgtcgtcttcgaaaaatgaaagaaagatatgcgcagactgatatgatgaagcttgcaaaccgaatgcagtttgggattccagaggaaagctcactaggtgatggcttgggggaaggttatggcatgcttggacaggcagggagtggcaagctacgtgtctcagctggacaaagcaaacttgctgctaaagtggccaaaaaattcaaggagaagagctatggtagcagtggtgcaacttcaggattgacatccagtttggcatttacaccagttcagggaatagagctgtcaaatccacaggcccaaggaaaccttcttggaggcggaactcaaagcacttacttttctgagaccggcacgttttcaaagatcaggaggacgcaatag

SEQ ID NO: 21227 - protein, 727 aa, Sorghum bicolor
  misc_feature: Ceres ANNOT ID no. 8702257
  misc_feature: Up-regulated in shoot tissues in response to salicylic acid treatment
  misc_feature (429)..(577): Pfam ID: Nop Pfam Description: Putative snoRNA binding domain
  misc_feature (337)..(389): Pfam ID: NOSIC Pfam Description: NOSIC (NUC001) domain
MTTATWWPGQHGDVLNGVGRQRHGTSGGGAEEDRWLWEPLAAWLAGPMVEQVGGNNGGAHGDAGIGGGQIEILAEVEVAAEGVVPRRAGGLSLFFPVRMMRFLVADDGRERSRSGGRVPHSLEGVGVRGKVGTAVHGQNAALGELDIDGLARWAKPDMGRRSSPSQRRSGSVPQRRSSAPSPTRAQARSQGSDLPRVGGSPLGGVQRRRGSPRLGGGVGGFPHLLSPVASRPRLRPPRTGRRPCANLADSFLADLDELSDNEGYPEEDNAEEVGREEEDDDMADLESLNYDDLDSVSKLQKTQRYHDIMQKVEVALQKGTDFSSQGFILEEDPEYQLIVDCNALSVDIENEIIIIHNFIRDKYRLKFPELESLVHHPIDYARVVKKIGNEMDLTLVDLEGLLPSAIIMVVSVTASTTSGKPLSEDNLEKTTEACDRALTLDAAKKKVLDFVESRMGYLAPNLSAIVGSAVASKLMGTAGGLGALAKMPACNVQLLGAKRKNLAGFSTASSQFRVGYLEQTEVFQSTPPALRTRACRLIAAKSTLAARIDSIRGDPTGKAGRNLLEEIRKKIEKWQEPPPAKLPKPLPVPDSEPKKKRGGRRLRKMKERYAQTDMMKLANRMQFGIPEESSLGDGLGEGYGMLGQAGSGKLRVSAGQSKLAAKVAKKFKEKSYGSSGATSGLTSSLAFTPVQGIELSNPQAQGNLLGGGTQSTYFSETGTFSKIRRTQ

SEQ ID NO: 21228 - DNA, 1359 bp, Sorghum bicolor
  misc_feature: Ceres ANNOT ID no. 8702306
  misc_feature: Up-regulated in shoot tissues in response to methyl jasmonate treatment
  misc_feature: Encodes the peptide sequence at SEQ ID NO 21229
atggatcgtgaagaaggtaaagcagcgcccgctcggacctcgccgaatttgggagcgattctggctaacctggggcctggttgccattggtgtgcagtgaccgagttcctggggcaggtgcccctcctgcagtgcctcccgggttcctccatccgcagaatcgccgaggccgtcgagatcaggaactacgagcctggtgactatgtcgctcgtgacggtgaacctgttgatggcctttacataatattggatggtcaggctgaagtttctgcacctgcaaatgctgaagaagcgaaccgcccagactatgtgttaaataaatacgactactttggttacggaactaatagttctgttcatcaagtaaatgttgttgcactatcaaagctgacctgcttcatattgcccaatcaacatggacatttgttacaaccaaaaacaatttggaatgcggaggaaacacctgaacattctttgctggaacaaattttgcacttagaaccactggaggtagatatcttccgtgggtttactttgccagaagctccaacttttaggcaagtttttggaggacaattcattggacaggcactagcagcagcatccaagactgttgattgtctaaaaatggtgcacagtttgcatgcgatttttcttgttgctggagacaataacataccaataatatatcaagttcatcgggcacgtgatggatccagctttgccacaagaaaagtggaggcaaagcagaagggactagttgtattcaccttgattgcttctttccagaaggaagaagtgggttttgagcatcaggctgcaatcatgcctgatgttcctcctccagaacagctccttaatctggaggagctacgagaaagacggcttactgatgatccacgcttcccaccccaatataggaacttggcagctaacaaaaagtttactccttggcccatagaaataagattatgtgaagattcagcgtctcaacataaaccaagcttaaactactggtttagagctcggggaaaactttcagacgatcaagctctacatagatgtgttgtagcatatgcttcggatctactatattctcctgtgagccgtcaccctcatctggcgaagtctttggagatacacgtgctcagtcttaatcattccatctggttccacaaacctgtgaatgctgacgaatggttgctctatgtgatcgagagcccatctgcgcatggtggtcggggtttcgtcactggacgcatgttcaacaggcaaggagagcttatcatgtcgctgacccaagaggcgttgattagaagggagaagccacgaggacgaaatccgaggccaaagctttga

SEQ ID NO: 21229 - protein, 452 aa, Sorghum bicolor
  misc_feature: Ceres ANNOT ID no. 8702306
  misc_feature: Up-regulated in shoot tissues in response to methyl jasmonate treatment
  misc_feature (319)..(444): SWISSPROT Homolog: EC 3.1.2.27 Choloyl-CoA hydrolase
  misc_feature (158)..(275): SWISSPROT Homolog: EC 3.1.2.2 Palmitoyl-CoA hydrolase
  misc_feature (35)..(143): SWISSPROT Homolog: EC 2.7.11.12 cGMP-dependent protein kinase
  misc_feature (309)..(437): Pfam ID: Acyl_CoA_thio Pfam Description: Acyl-CoA thioesterase
  misc_feature (169)..(269): Pfam ID: Acyl_CoA_thio Pfam Description: Acyl-CoA thioesterase
  misc_feature (60)..(148): Pfam ID: cNMP_binding Pfam Description: Cyclic nucleotide-binding domain
MDREEGKAAPARTSPNLGAILANLGPGCHWCAVTEFLGQVPLLQCLPGSSIRRIAEAVEIRNYEPGDYVARDGEPVDGLYIILDGQAEVSAPANAEEANRPDYVLNKYDYFGYGTNSSVHQVNVVALSKLTCFILPNQHGHLLQPKTIWNAEETPEHSLLEQILHLEPLEVDIFRGFTLPEAPTFRQVFGGQFIGQALAAASKTVDCLKMVHSLHAIFLVAGDNNIPIIYQVHRARDGSSFATRKVEAKQKGLVVFTLIASFQKEEVGFEHQAAIMPDVPPPEQLLNLEELRERRLTDDPRFPPQYRNLAANKKFTPWPIEIRLCEDSASQHKPSLNYWFRARGKLSDDQALHRCVVAYASDLLYSPVSRHPHLAKSLEIHVLSLNHSIWFHKPVNADEWLLYVIESPSAHGGRGFVTGRMFNRQGELIMSLTQEALIRREKPRGRNPRPKL

SEQ ID NO: 21230 - DNA, 1617 bp, Sorghum bicolor
  misc_feature: Ceres ANNOT ID no. 8702316
  misc_feature: Down-regulated in shoot tissues in response to aminocyclopropane carboxylic treatment
  misc_feature: Down-regulated in shoot tissues in response to methyl jasmonate treatment
  misc_feature: Down-regulated in shoot tissues in response to salicylic acid treatment
  misc_feature: Up-regulated in root tissues in response to methyl jasmonate treatment
  misc_feature: Up-regulated in shoot tissues in response to methyl jasmonate treatment
  misc_feature: Encodes the peptide sequence at SEQ ID NO 21231
atggaggccggggcgtgggcggtggtggcggcggccgtggcgctgtacatggcgtggttctggcggatgtcgcgcgggctcagcgggccgcgggtgtggccgctggccggcagcctcccgggcctcgtgcagcacgccgaggacatgcacgagtggatcgccgccaaccttcgccgcgcggggggcacgtaccagacctgcatcttcgccgtgcccggggtggcgcgccggggcgggctggtcaccgtgacgtgcgacccgcggaacctggagcacgtcctcaaggcgcgcttcgacaactaccccaagggccccttctggcacggcgtcttccgggacctgctcggcgacggcatcttcaactccgacggcgagacgtgggtggcgcagcgcaagacggccgcgctcgagttcaccacgcgcacgctgcgcaccgccatgtcgcgctgggtgtcgcgatccatccacgcccgcctcctccccatcctgggcgacgccgacgccgacgtcgtcgtcgtcgacctgcaggacctcctgctccgcctcaccttcgacaacatctgcggcctcgcgttcggcaaggaccccgagacgctcgccaggggcctccccgagaacgccttcgcctccgcgttcgaccgcgccacggaggccacgctcaaccgcttcatcttcccggagtgcgtgtggcgcttcaagaagtggctgggcctcggcatggagaccacgctggcgcgcagcgtccagcacgtcgaccggtacctctcggccgtcatcggcgcgcgcaagctcgagctcaccggcggcaagcagaacgacgcgtcggccacgccgcacgacgacctcctctcgcgcttcatgcgcaaggggacctactccgacgagtcgctgcagcacgtggcgctcaacttcatcctcgccggccgcgacacctcctcggtggcgctctcctggttcttctggctcgtctccacgcacccggacgtggagcgcaaggtcgtgcgcgagctgtgcgccgtcctggccgcgtcccgcggcgtcgaggacccggcattgtggctcgccgcgcccttcgacttcgacgagctcgaccgcctcgtctacctcaaggcggcgctctcggagacgctccgcctgtacccctcggtgcccgaggactccaagcacgtcgtcgccgacgacgtgctcccggacggcacgttcgtccccgcgggctcgtcggtcacctactccatctactcggcggggcgcatgaagacggtgtggggggaggactgcctcgagttccgccccgagcggtggctgtccgccgacggcaccaggttcgagccccacgactcgtacaggttcgtggcgttcaacgccggcccgcggatatgcctgggcaaggacctcgcgtacctgcagatgaagaacatcgccgggagcgtgctcctccgccaccgcctcgccgtcgcgccgggccaccgcgtggagcagaagatgtcgctcacgctgttcatgaagcacgggctccggatggaggtgcgcccgcgcgacctcggcgccgtcatcgacgagctccgcggcgccggggggtacgacgcggcggccagagccaccgcggcctctgcctag

SEQ ID NO: 21231 - protein, 538 aa, Sorghum bicolor
  misc_feature: Ceres ANNOT ID no. 8702316
  misc_feature: Down-regulated in shoot tissues in response to aminocyclopropane carboxylic treatment
  misc_feature: Down-regulated in shoot tissues in response to methyl jasmonate treatment
  misc_feature: Down-regulated in shoot tissues in response to salicylic acid treatment
  misc_feature: Up-regulated in root tissues in response to methyl jasmonate treatment
  misc_feature: Up-regulated in shoot tissues in response to methyl jasmonate treatment
  misc_feature (86)..(510): SWISSPROT Homolog: EC 1.14.15.3 Alkane 1-monooxygenase
  misc_feature (27)..(511): Pfam ID: p450 Pfam Description: Cytochrome P450
MEAGAWAVVAAAVALYMAWFWRMSRGLSGPRVWPLAGSLPGLVQHAEDMHEWIAANLRRAGGTYQTCIFAVPGVARRGGLVTVTCDPRNLEHVLKARFDNYPKGPFWHGVFRDLLGDGIFNSDGETWVAQRKTAALEFTTRTLRTAMSRWVSRSIHARLLPILGDADADVVVVDLQDLLLRLTFDNICGLAFGKDPETLARGLPENAFASAFDRATEATLNRFIFPECVWRFKKWLGLGMETTLARSVQHVDRYLSAVIGARKLELTGGKQNDASATPHDDLLSRFMRKGTYSDESLQHVALNFILAGRDTSSVALSWFFWLVSTHPDVERKVVRELCAVLAASRGVEDPALWLAAPFDFDELDRLVYLKAALSETLRLYPSVPEDSKHVVADDVLPDGTFVPAGSSVTYSIYSAGRMKTVWGEDCLEFRPERWLSADGTRFEPHDSYRFVAFNAGPRICLGKDLAYLQMKNIAGSVLLRHRLAVAPGHRVEQKMSLTLFMKHGLRMEVRPRDLGAVIDELRGAGGYDAAARATAASA

SEQ ID NO: 21232 - DNA, 1599 bp, Sorghum bicolor
  misc_feature: Ceres ANNOT ID no. 8702330
  misc_feature: Down-regulated in shoot tissues in response to methyl jasmonate treatment
  misc_feature: Down-regulated in shoot tissues in response to aminocyclopropane carboxylic treatment
  misc_feature: Down-regulated in shoot tissues in response to salicylic acid treatment
  misc_feature: Encodes the peptide sequence at SEQ ID NO 21233
atgtcgtccagcaagcaggacgcgatcagcgaggtggagtcggcgccgccgactccgcgcccgccgacgacgccgccggtggtgtcgaccccgccgtcgcagatacactccccgcgggggcccgccagcggcgggcggtcgccgctgcacgccatggcgtccccgctgcgcgccatggcgtcgccgcttcgcgccatggcgacgccgctcgccagccccgtgaggaaggcggtggcgggcgtgaaggcggtgggcaacatcacgcggctcgcggacccgcgcgacgcctggctgcccatcaccgagtcccggagcggcaacgcctactacgccgcgttccacaacctcagctccgggatcgggttccaggcgctcgtgctccccgtggccttcgcctccctgggatggacgtgggcgatcatctgcctcaccctggcgttcggctggcagctctacacgctgtggctcctcgtcaggctccacgagcctgtcgccggcgccgcccgctacagccggtacatgcacctcgccaacaccgtgttcggcgagagatgggccaagatcctggcgctgttcccggtgatgtacctgtcggcggggatctgcacggcgctcatcatcgtgggcggcggcagcatgaagagtctgttcagcctggcgtgcggcgagtcgtgcctggcgcacaacctcaccaccgtggagtggtacctcgtcttcatctgcgcggccgtgctgctgtcccagctccccaacctcaactccatcgccggcgtgtcactggtgggcgccacggccgccgtcgcctactgcaccatgatctgggtcgtgtccgtgtccaagggcagggtggccggcgtgtcctacgaccccgtcaagtccaacaacgacgtggacgccgcacttagcatcctcaatggcctcggaatcattgccttcgctttcaggggccacaatgtcgtgctggagattcagggcacgatgccgtcgactctgaaacatccttctcatgtgcccatgtggaaaggcgttaaggtagcatacggcatcatcgcgctctgcctgtaccccattgccattggtggcttctgggcttatggcaaccagataccttcaggtggcatcctgaccgcgctgtaccagttccacagccgcgacgtgtcgaggctagtgctggggacgaccacgctgctggtgatcatcaactgcctgacgacgtaccagatctacgccatgccggtgtacgacaacatggaggccgggtacgtgcacaagaagaaccggccgtgcccctggtggctgcgctcgggcttccgcgccttcttcggcggcatcaacttcctcatcgccgtcgcgctgccgttcctgtcgcagctcgcgggcctcatggggggcatctcgctgcccatcacactggcgtacccgtgcttcatgtgggtggccatcaagaagccccggaagggcaccgcgacgtggaacgtcaactgggcgctgggaatcctcggcatggccatcagcgtcgtcctcatagtcggaaacctctggggtctcgtgcagacaggcttgcggctcaacttcttcaagcctgacaatatgcagtga

SEQ ID NO: 21233 - protein, 532 aa, Sorghum bicolor
  misc_feature: Ceres ANNOT ID no. 8702330
  misc_feature: Down-regulated in shoot tissues in response to methyl jasmonate treatment
  misc_feature: Down-regulated in shoot tissues in response to aminocyclopropane carboxylic treatment
  misc_feature: Down-regulated in shoot tissues in response to salicylic acid treatment
  misc_feature (104)..(518): Pfam ID: Aa_trans Pfam Description: Transmembrane amino acid transporter protein
MSSSKQDAISEVESAPPTPRPPTTPPVVSTPPSQIHSPRGPASGGRSPLHAMASPLRAMASPLRAMATPLASPVRKAVAGVKAVGNITRLADPRDAWLPITESRSGNAYYAAFHNLSSGIGFQALVLPVAFASLGWTWAIICLTLAFGWQLYTLWLLVRLHEPVAGAARYSRYMHLANTVFGERWAKILALFPVMYLSAGICTALIIVGGGSMKSLFSLACGESCLAHNLTTVEWYLVFICAAVLLSQLPNLNSIAGVSLVGATAAVAYCTMIWVVSVSKGRVAGVSYDPVKSNNDVDAALSILNGLGIIAFAFRGHNVVLEIQGTMPSTLKHPSHVPMWKGVKVAYGIIALCLYPIAIGGFWAYGNQIPSGGILTALYQFHSRDVSRLVLGTTTLLVIINCLTTYQIYAMPVYDNMEAGYVHKKNRPCPWWLRSGFRAFFGGINFLIAVALPFLSQLAGLMGGISLPITLAYPCFMWVAIKKPRKGTATWNVNWALGILGMAISVVLIVGNLWGLVQTGLRLNFFKPDNMQ

SEQ ID NO: 21234 - DNA, 1524 bp, Sorghum bicolor
  misc_feature: Ceres ANNOT ID no. 8702453
  misc_feature: Up-regulated in root tissues in response to salicylic acid treatment
  misc_feature: Encodes the peptide sequence at SEQ ID NO 21235
atggactcgccaccgcttagccccgctctgctcgcgctgtccctgctcctcctcctagcgctctacatcgctcgccggcgccgcggcggaggcaggaaccggaactacccgcccgtggcgggcaccgtgttccaccagctgctcaatttcggccggctgatggagtaccagacggagctcgcccagaggtaccgcaccttccgcatgctcaccccgacctgcaactacgtgtacaccgtcgagcccgccaacgtggagtacatgctcaagaccaacttcgccaactacggcaagggggtgatgacccacgacgtgctggaggacctcctcggcgacggcatcttcaacgtggacggcgccaagtggcggcaccagcggaaggtcgccagccacgagttctccacgcgagtgctgcgcgactacagcagcggcgtgttccgcgacacggccgcggagctcgcgggcatcgtggccatggccgctggcgccggggagaggctggatgtcgccgacctgctgttgcggtcgacgctggactccatgttcaaggtcgggttcggggtcaacctgggctcgctgtccggctgcagcgacgagggcgcggcggcgttcgccagggcgttcgacgacgccagcgagcaggtcctgtaccgcttcttcgacgtgtcctggaagctcaagaggctcctcaacatctcgtcggaggcggccatgaaggggtcgatccgcaccattgatggattcgtgtacggcgtcatcgacaggaagatcgagcagatgggcagagaccaacaggaattcgccaagaaagaggacatcttgtcgaggttcctgatggagcgggagagcgatcccggctgcttcgacaacaagtacctgcgggacatcatcctcaacttcgtgatcgccggccgcgacaccacggcggggacgctgtcgtggttcctctacatgctctgcaggaaccagcacatccaggacaaggtcgcgcgggaggtccgtgccgccaccacgggcgaccgcgacgtcggcgtccaggagttcgtcgcgttcttaaccgaggacgccatcagcagaatgcagtacctgcacgccgtgctgacggagacgcttcggctgtacccggctgtgcccatcgatgtgaagtattgcttttcggatgacacgttaccggacggctacgctgtcaagaaaggtgacatggtgaactaccagccgtaccaaatgggcaggatgaagttcctgtggggcgcggacgccgaggagttcaggccggagaggtggctcggcgacgacggcgtgttcgtccccgagagccccttcaagttcacggctttccaggcggggcctcgcgtctgcttgggaaaggagttcgcgtacaggcagatgaagatcttcgcggcggtgctgctctacctcttcagatttgagatgtgggaagccaatgctaccgtgggtttccggcccatgctcacgctcaaaatggatggcccgctgtatgttcgtgcaacgctccggcaatga

SEQ ID NO: 21235 - protein, 507 aa, Sorghum bicolor
  misc_feature: Ceres ANNOT ID no. 8702453
  misc_feature: Up-regulated in root tissues in response to salicylic acid treatment
  misc_feature (58)..(502): SWISSPROT Homolog: EC 1.14.14.1 Unspecific monooxygenase
  misc_feature (37)..(502): Pfam ID: p450 Pfam Description: Cytochrome P450
MDSPPLSPALLALSLLLLLALYIARRRRGGGRNRNYPPVAGTVFHQLLNFGRLMEYQTELAQRYRTFRMLTPTCNYVYTVEPANVEYMLKTNFANYGKGVMTHDVLEDLLGDGIFNVDGAKWRHQRKVASHEFSTRVLRDYSSGVFRDTAAELAGIVAMAAGAGERLDVADLLLRSTLDSMFKVGFGVNLGSLSGCSDEGAAAFARAFDDASEQVLYRFFDVSWKLKRLLNISSEAAMKGSIRTIDGFVYGVIDRKIEQMGRDQQEFAKKEDILSRFLMERESDPGCFDNKYLRDIILNFVIAGRDTTAGTLSWFLYMLCRNQHIQDKVAREVRAATTGDRDVGVQEFVAFLTEDAISRMQYLHAVLTETLRLYPAVPIDVKYCFSDDTLPDGYAVKKGDMVNYQPYQMGRMKFLWGADAEEFRPERWLGDDGVFVPESPFKFTAFQAGPRVCLGKEFAYRQMKIFAAVLLYLFRFEMWEANATVGFRPMLTLKMDGPLYVRATLRQ

SEQ ID NO: 21236 - DNA, 582 bp, Sorghum bicolor
  misc_feature: Ceres ANNOT ID no. 8702463
  misc_feature: Up-regulated in root tissues in response to methyl jasmonate treatment
  misc_feature: Encodes the peptide sequence at SEQ ID NO 21237
atgcctgccctcgccaagcccgcctcccgccccgccaagaccgccgcggcgccgaagccgaagcccgccgccgccaagccgaaggcggccgccgccggtgcctcccacccgccctacttcgagatgatcaaggaggcgatctcggcgctgaaggagaggactggctccagctcccacgccatcgccaagtacatggaggacaagcacggcgcgtcgctgccggccaacttcaagaagatgctctccatccagctccgcggattcgccgccaagggcaagctcgtgaaggtcaaggcctcgtacaagctctccgacgccgccaagaaggccgcccccaagccgaaggccaagctcgccgccgccaagaccgctgcgcccaagccgaccaagaaggacgccgccaagcccaagaagactgccgccgcagccaagcccaagaaggccgccgcggggaccaagcgcaaggcgcctgagaagaaggtcgtggccaagccgaagaagtcccccgccgccaaggccaaggccaagcccaagaccgtcaagtcccccgccgccaagaaggcccggaaggtcgccgcatga

SEQ ID NO: 21237 - protein, 193 aa, Sorghum bicolor
  misc_feature: Ceres ANNOT ID no. 8702463
  misc_feature: Up-regulated in root tissues in response to methyl jasmonate treatment
  misc_feature (35)..(105): Pfam ID: Linker_histone Pfam Description: linker histone H1 and H5 family
MPALAKPASRPAKTAAAPKPKPAAAKPKAAAAGASHPPYFEMIKEAISALKERTGSSSHAIAKYMEDKHGASLPANFKKMLSIQLRGFAAKGKLVKVKASYKLSDAAKKAAPKPKAKLAAAKTAAPKPTKKDAAKPKKTAAAAKPKKAAAGTKRKAPEKKVVAKPKKSPAAKAKAKPKTVKSPAAKKARKVAA

SEQ ID NO: 21238 - DNA, 1557 bp, Sorghum bicolor
  misc_feature: Ceres ANNOT ID no. 8702450
  misc_feature: Up-regulated in shoot tissues in response to salicylic acid treatment
  misc_feature: Encodes the peptide sequence at SEQ ID NO 21239
atggactcgccgccgggccaacccacggtggtcaccctgatacttgctctcctcctagttctatacctcgcgctccggcgccgcgccggcgccggcggcgccaagaaccggagctacccgccggtggccggcaccgtgctccaccagctgttcaacttcggccgcctgatggagtaccacactgagctctcccgcaggtaccgtactttccgcatgctcaccccgagcagcagctacatctacaccgtcgagcccgccaacgtggagtacatcctcaagaccaacttctccaactacggcaaggggagcaaggtgcacgaggtgggcgaggacctcctcggcgacggcatcttcagcgtggacggcgccaagtggcggcaccagcggaaggtcgccagccacgagttctccacgcgggtgctgcgcgactacagcaccggcgtgttccgcgacacggccgcggagctcgcgggcatcgtggccgccgacgccggggagaaggtggacatgcaggacctgctgctgcggtcgacgctggactccatcttcacggtcgggtttggggtcagactgggcgttctctccgggtctagcaaggaaggcgccgcgttcgccaaggcgttcgacgatgccagcgagcaggtgttacaccgcttcttggacccgttttggaaggccaagaggttcctaaacttctcgttggagacggccatgaagcgctcggtccgcaccatcaacgacttcgtctacgccgtcgtcgacaagaagatcgagcagatgggaagagaccaacaagaatttgtgagctctgacaccgatgcgcggaagcacgccaagaaagaggacatcctgtcgaggttcttggtggagcgggagagcgatcccggctgcttcgacaacaagtacctgcgggacatcatcctcaacttcgtgatcgccggccgcgacaccacggcggggacgctgtcgtggttcctctacgtgctgtgccggaaccagcacatccaggacaaggtcgccgaggaggtgcgcgccgccgccacctccggcgacggcgacctcggcgccccggagctcgtcgcgtgcctgaccgacgacgccatcggcaagatgcactacctgcacgcagcgctgacggagaccctccggctctaccctgctgtgcccatcgatgtcaagtgctgcttttcggacgacacgttgccggacggctacgccgtcaacaaaggggacatggtgcactaccagccgtaccaaatgggcaggatgcagttcctgtggggcgccgacgccgaggagttccggccggagaggtggctcgacgacggcggggtgttcgtccccgagagccccttcaagttcacggctttccaggctggccctcgcgtctgcttgggaaaggaattcgcgtacaggcagatgaagatcttcgcggccgtgcttctctacctgttcaggtttgagatgtgggatgccaacgccaccgtgggttaccgggccatgctcactctcaaaatggatggcccgctctatgttcgtgcgtcgctccggcggtga

SEQ ID NO: 21239 - protein, 518 aa, Sorghum bicolor
  misc_feature: Ceres ANNOT ID no. 8702450
  misc_feature: Up-regulated in shoot tissues in response to salicylic acid treatment
  misc_feature (41)..(486): SWISSPROT Homolog: EC 1.14.14.1 Unspecific monooxygenase
  misc_feature (40)..(513): Pfam ID: p450 Pfam Description: Cytochrome P450
MDSPPGQPTVVTLILALLLVLYLALRRRAGAGGAKNRSYPPVAGTVLHQLFNFGRLMEYHTELSRRYRTFRMLTPSSSYIYTVEPANVEYILKTNFSNYGKGSKVHEVGEDLLGDGIFSVDGAKWRHQRKVASHEFSTRVLRDYSTGVFRDTAAELAGIVAADAGEKVDMQDLLLRSTLDSIFTVGFGVRLGVLSGSSKEGAAFAKAFDDASEQVLHRFLDPFWKAKRFLNFSLETAMKRSVRTINDFVYAVVDKKIEQMGRDQQEFVSSDTDARKHAKKEDILSRFLVERESDPGCFDNKYLRDIILNFVIAGRDTTAGTLSWFLYVLCRNQHIQDKVAEEVRAAATSGDGDLGAPELVACLTDDAIGKMHYLHAALTETLRLYPAVPIDVKCCFSDDTLPDGYAVNKGDMVHYQPYQMGRMQFLWGADAEEFRPERWLDDGGVFVPESPFKFTAFQAGPRVCLGKEFAYRQMKIFAAVLLYLFRFEMWDANATVGYRAMLTLKMDGPLYVRASLRR

SEQ ID NO: 21240 - DNA, 2019 bp, Sorghum bicolor
  misc_feature: Ceres ANNOT ID no. 8702672
  misc_feature: Up-regulated in root tissues in response to salicylic acid treatment
  misc_feature: Encodes the peptide sequence at SEQ ID NO 21241
atggactcagcggagcctgcgctgaaagcaataccttccggagttccggcccctgcgccatgtggcccatgtcacggtccaattgctgacgaatgcacggttttcgttggtggcccggagccggaggaaagagatttttacggtctccatcgcggtcacccctttcctctcgccccacgactccacgagttttgcgtcctctgtttgcaacccaacggcacggccgcacgccgcacccctccatggatagaccagcggatgcggatgctaccagcacggatgccgatgtcgagcgggcgagctcgccgctccaagcggaggccgaggtacgcgtgtcctcgtcctcgtcctcgtcctcgtctgctctgtagcttccgtatcctttcgaggaggccttcagctgcgcgcgcgcgttgcgctggcctggtgttcttggaagtcactgctttctacggggtctacctgaacctaatcgtgtatctccaggacgttcttcatggcgacagtgcctccaacgcggcggccgtcagtttctgggctggagctagctacctgatgcccgtggtcggcgccgccatcgccgattcttactggggcaagtacaagaccgtggtcgtcggcctctccatctctctcgctgggatggccgtgatcacgacatcggctacgctgccgtcactgaggcctccgccgtgcgagcacggcaccggcacgtactgcgccccggcggctctgcaccaacggctggtgttctttgcgggcatatacctgtgcgccatcgggatcggcgggttgaaggcggccatagcctcgttcggcgcggagcagttcgacgacgagaacggcaagaacgtggcggagcgggagaggaaggcctcctacttcagctggtactacggcgtggccaacctgggcattctcacctcggggaccctgctggtctgggtcgaggacaaggtcagctgggggctcgggtacggcgtctgcgcgtcgttcgtcgcggtggccgtcgtcgccctcgccgcgacggcgcccgtgtaccggctcgtgcctccggtgggcagccccttgaagggcgcgtgccaggtgctcgtcgcgttcgctcgcaaggtgaacgtgagagtgcctgacgatgctgccgagctgtacgcggaggagcatgccaaggtgtctttcctgcaacaacctcgcgagttgttagagcacacggaccagttcaggtgcttggacaaagctgcggttgtcacgagcgcggacttggaagacggcaacccatggaggctgtgcacggtgacccaggtggaggagctcaagacgctgctgcggctgatcccggtttggctcacgtcggccgtgtacttcgtcgccaactcccaggcgcagaccaccttcgtgcagcagggctccatgacggactccaagatcgggcgcggcgcgttctccgtgccggccgcgtcactgacgtgcatcgagacggtgttcgtggtggccgccatcgcgctctacaaccgggccgtcgcgcccgcggcgcgccgcttcctcggccgcgcggaggcgttcacgccgctgcagctcatggggctcggccacggcgcggtgatcgccgcggtggccctcgcagcgtgcgccgagtcgcgcaggctggcgaatgtcagggccggggcagcgctcttgggcattgcgtggctgctgccgcagtacgtcgtgatggccgtctccgatgcgtcgctcagcgtcgggcagctggagttcttctacgaccaggcgccggagacgatgcgcagcgcctcgacggcgttctacttcctgtcgtgctcgctcgggaacctcattagctcgcagctggtgacgctggtggcgtcggtgaccgagatgagcgggaggacgggatggtttccgccaaacctggacgatgggcacttggattactacttcatgctcattgtcggcatcaacgcagtgaactttgccgtttttgtttacctcgccaagaattacacgcccaagagggttagatag

SEQ ID NO: 21241 - protein, 672 aa, Sorghum bicolor
  misc_feature: Ceres ANNOT ID no. 8702672
  misc_feature: Up-regulated in root tissues in response to salicylic acid treatment
  misc_feature (201)..(605): Pfam ID: PTR2 Pfam Description: POT family
MDSAEPALKAIPSGVPAPAPCGPCHGPIADECTVFVGGPEPEERDFYGLHRGHPFPLAPRLHEFCVLCLQPNGTAARRTPPWIDQRMRMLPARMPMSSGRARRSKRRPRYACPRPRPRPRLLCSFRILSRRPSAARARCAGLVFLEVTAFYGVYLNLIVYLQDVLHGDSASNAAAVSFWAGASYLMPVVGAAIADSYWGKYKTVVVGLSISLAGMAVITTSATLPSLRPPPCEHGTGTYCAPAALHQRLVFFAGIYLCAIGIGGLKAAIASFGAEQFDDENGKNVAERERKASYFSWYYGVANLGILTSGTLLVWVEDKVSWGLGYGVCASFVAVAVVALAATAPVYRLVPPVGSPLKGACQVLVAFARKVNVRVPDDAAELYAEEHAKVSFLQQPRELLEHTDQFRCLDKAAVVTSADLEDGNPWRLCTVTQVEELKTLLRLIPVWLTSAVYFVANSQAQTTFVQQGSMTDSKIGRGAFSVPAASLTCIETVFVVAAIALYNRAVAPAARRFLGRAEAFTPLQLMGLGHGAVIAAVALAACAESRRLANVRAGAALLGIAWLLPQYVVMAVSDASLSVGQLEFFYDQAPETMRSASTAFYFLSCSLGNLISSQLVTLVASVTEMSGRTGWFPPNLDDGHLDYYFMLIVGINAVNFAVFVYLAKNYTPKRVR

SEQ ID NO: 21242 - DNA, 651 bp, Sorghum bicolor
  misc_feature: Ceres ANNOT ID no. 8702707
  misc_feature: Down-regulated in shoot tissues in response to salicylic acid treatment
  misc_feature: Encodes the peptide sequence at SEQ ID NO 21243
atggccaccgcagcgcgcgccctcgtcgccgcacgcccggcgcggccgctcctcccgtcacggcgcctcccgtcctcctcttccatccgccccccgcggcaacgtggcggcggcgttgggtccgtccgctgcatggcgcggcggccggattcctcatattccccgctgcggtcgggtcagggcggtgaccgtgcgccgacggagatggcgcctctgttccctggctgcgactacgagcactggctcatcgtcatggacaagcccggcggcgagggcgccacgaagcagcaaatgatcgattgctacatccagacccttgcccaggtggtagggagcgaagaggaggcgaagaagaggatatacaatgtgtcctgcgagcgctattttggattcggctgcgaaattgatgaagagacctccaacaaactggaaggccttccaggggttctatttgtgcttcctgactcttatgttgatgctgagaacaaggattatggtgctgagttatttgtgaacggtgaaatcgttcagcgatcgccagaaaggcagagaagggtggagccagtgcctcagagagctcaagatcgaccccggtacagtgaccggacccgctatgtgaagcggagggagaaccagtcttaccagcgatga

SEQ ID NO: 21243 - protein, 216 aa, Sorghum bicolor
  misc_feature: Ceres ANNOT ID no. 8702707
  misc_feature: Down-regulated in shoot tissues in response to salicylic acid treatment
MATAARALVAARPARPLLPSRRLPSSSSIRPPRQRGGGVGSVRCMARRPDSSYSPLRSGQGGDRAPTEMAPLFPGCDYEHWLIVMDKPGGEGATKQQMIDCYIQTLAQVVGSEEEAKKRIYNVSCERYFGFGCEIDEETSNKLEGLPGVLFVLPDSYVDAENKDYGAELFVNGEIVQRSPERQRRVEPVPQRAQDRPRYSDRTRYVKRRENQSYQR

SEQ ID NO: 21244 - DNA, 1950 bp, Sorghum bicolor
  misc_feature: Ceres ANNOT ID no. 8702736
  misc_feature: Down-regulated in shoot tissues in response to salicylic acid treatment
  misc_feature: Encodes the peptide sequence at SEQ ID NO 21245
atggcgatcttcgagcgaatcgagggtgaagcggaggacgaggagaaggcggcgacaggggaggaagttgttacccaagtcgagtcggccatcgggccgggcggcgaccgtgttcggcagccgaccgggcgcgcgacgatgggcgtcagcgcgacaggcccgccgcaagggacggggagccagcctccgctcgacggacaaggggcgtcgtccgagtatctaactgcgtctccaacgctgcgtggctcggttctgccttcaaaacttaatttaaagagagtgtctgcaccgcccagtgatgagtcagaaaccattccgttgaaaaactcagtcgatgcagcaaccagcacggagggggttacccaaggtgagaaccgtgggcagcatctgaccaagcatgccccgggatgcatcaccgtgaccggtgtgacgcaagggacggtgagccagaatctggttgacgggcatgagaaatctgagggtccaaccaagtccccgaggccgcattgctcgctatacactgatgaagacatcgaaagaatgaagaggcgtattgaagagttagaactgttaaatgcagacctaaaacaacgattagaagaagctaaacttcagttgaagttcaatgatgcgattacccaccctaagaatgaaattcctgatggactgaacatttgccacggcattttcatttgttccaatgaatctggctacgaaaagttggaaaagaagcttgctcacgcagactcaaagatcatccatgttgtttctgttcatggaaggacaatttggttaaatgtcagacgttccaggtacggtcgtcaggcaaggaagaaagacagaagttccccagaatttgatttcagaagattgactccattgggtaaaataattctgctgggaatcattgaggacatctatcgacttcatcgcaggggattttgcctggatggtcgattcactttacagagcttttactggacagatgagaagaagattaagttggaccctagtttgaagcttatcgctgtatcaactgaaggaagaaagtcttgtatgatcaatgactatcacagaatccatgagattataatgcagattctcttgctttgcaaggaaaccgcttcagaagatttggaacaattgttggatctcctgaaatgtactgaccctgtggatgttgaggacataattcgatacaatgtctctctaatgacagaaatagcaaagcgaagtcactttataactctatatgatcgctggcggcagatggaagcccaagagcaggaaatggaagagggtaagggtaagcctactgaagctgaaggttcagaaacaaaaatacccaattcaaaaaaggtacttaaatttatccccactagttccataaactctgatggctcagtggaagattggtcaaactttgtgtatctcaatgaccatgtcaagcttgtatatgatcgtcgatgtcaaaaaactgggtacgggaagctatatggagcaaaagagctcctggtggtttggcaaaatgccctcacacatatacttgaagattcattggccgaaggaaaacttgagttctatgatgaagatgtgaaagggatgcactctattggccacgaggagctacctcatctcatgaggataatgagaatggaactaaacagggccttagcgagtcgtggtctgacagcgctggcggatgtggagagtctaaaattatcccacaaagaagttcagattgatattgatgataagaatgaagaggagatctccactccatacaatctgttgttcaaagttggtccaccaccaccacatggtcaaatttcaaggtcagttattctccaaatgtttgagaagtcaatgacggcagcatggggccatcaattcataaggtttctcagattattcccagtatgttcatggctcattttcgtgaagggatga

SEQ ID NO: 21245 - protein, 649 aa, Sorghum bicolor
  misc_feature: Ceres ANNOT ID no. 8702736
  misc_feature: Down-regulated in shoot tissues in response to salicylic acid treatment
MAIFERIEGEAEDEEKAATGEEVVTQVESAIGPGGDRVRQPTGRATMGVSATGPPQGTGSQPPLDGQGASSEYLTASPTLRGSVLPSKLNLKRVSAPPSDESETIPLKNSVDAATSTEGVTQGENRGQHLTKHAPGCITVTGVTQGTVSQNLVDGHEKSEGPTKSPRPHCSLYTDEDIERMKRRIEELELLNADLKQRLEEAKLQLKFNDAITHPKNEIPDGLNICHGIFICSNESGYEKLEKKLAHADSKIIHVVSVHGRTIWLNVRRSRYGRQARKKDRSSPEFDFRRLTPLGKIILLGIIEDIYRLHRRGFCLDGRFTLQSFYWTDEKKIKLDPSLKLIAVSTEGRKSCMINDYHRIHEIIMQILLLCKETASEDLEQLLDLLKCTDPVDVEDIIRYNVSLMTEIAKRSHFITLYDRWRQMEAQEQEMEEGKGKPTEAEGSETKIPNSKKVLKFIPTSSINSDGSVEDWSNFVYLNDHVKLVYDRRCQKTGYGKLYGAKELLVVWQNALTHILEDSLAEGKLEFYDEDVKGMHSIGHEELPHLMRIMRMELNRALASRGLTALADVESLKLSHKEVQIDIDDKNEEEISTPYNLLFKVGPPPPHGQISRSVILQMFEKSMTAAWGHQFIRFLRLFPVCSWLIFVKG

SEQ ID NO: 21246 - DNA, 2775 bp, Sorghum bicolor
  misc_feature: Ceres ANNOT ID no. 8702719
  misc_feature: Up-regulated in root tissues in response to salicylic acid treatment
  misc_feature: Down-regulated in root tissues in response to salicylic acid treatment
  misc_feature: Encodes the peptide sequence at SEQ ID NO 21247
atggggttacaggtggaggcgaaggttctcttcagtaagagctttgaagagctgcggtgtagctggttgcgtatggaggagagtggcggcagcagcggaaggcgggaggacgcggcgccgccgtggaagccgagcgaggccactgcgttcgcccgttttgcggcggccgctgcttcgccggaggcgtccccgtcggcctccgccaatggggctgctgcccgcgtcagcagccttcatggggtcaagcggaaatcgtttgttgcaagattgacagcaggcatcattcagacatatctacaatgtgatcctgagtttaagtactcagaggttctaaatccaaaacgcttcctcaccaatccctctaccccagcccacaatgatgggcttgacaatgcaaattgggacctcatattgtatgtcaacttggagttggttaataagatgtcaaacagaaggtttattgtcaaggaaatgcttgggcagggaacttttggtcaagtagttaagtgctgggacacagaaactaatgactatgttgctgtgaaggtgataaaaaatcagcctgcattttaccatcaagctatcatggaggtttcgttattaagaacgttaaatcagaaatttgatcctgatgatcagcataacattgtccgtatgcttgattatctgtcgtttcaaaatcatttgtgcatagcttttgagatgctgggtcaaaacctgtatgaactgctcaaaaggaatcacttaagaggtctgaaactgaaatacgttcaagccttctcaaaacagatattggatgccatggttgtgatgagagaagctggaataattcattgtgatctcaagccagaaaatatcctgttagctcccagtgtcgcaacagctgcagcagtgaaagttattgattttggatcagcatgcctggagggtaaaacagtttactcatatactactgcgatcgacatgtggtcgttcggctgcatagttgctgaactgtttctaggcttgccattgtttcctggagcgtcagaatatgatgtgcttcagcgaatgatgacaattctcgggggccaaccaccagatgaactgctaagggaagctaaaaacactataagattttttaaacatgttggaatatatcctggcaatgaggcacctagtggtctatctagtgcatacagaattttaagtgaagaagaggttgaagtgagagattccaagaggccaaagatgggaaagtggtacttcccacacctgaagcttgacaaactcatatgtacctatccttggaacaattctgaactgtcagagacagaaaaaacagatcgtttgggattagttgatttcttgaagggactccttgaatttgatccaaataagcgatggtcaccattgcaggctctatatcatccattcataacaggcgaatcgttcactggtccatatgagcctgtacccgagactgcaagaattcctgttgctcgtgctgcagcaattgatcacaatcctggagggggccactggctacattcaggtctttccccgcaggttggaagtgtgaacagataccttcctctgaataatgcctaccctccaaaggttcctttttcatatgggagtagttatggaagctatggtagccatggtagctataccggtaatcctggttttggtaacagctacggaagcaccggtgatgttaatactatgaatatgtattactcacccttaggtttttctggattagcgcaaattggctctagtccagatgttagattaaggatgcgtctcccacatgatagaggaattcgattgagccctggtagtcttgggcctatgtctcttggagccagtccatcgcactttacgccaccaaactaccagatgcaaatcccagctaattctactgggaaacatggttccggttctcctgcaagtggaggcattcatggttctccattaggaagagctgcagcagtgggcccatataacatgaggaggaatttgccaatgccgccacatgattatgtatctcagcatggacaagggcgttttggagatggtgtcagtttcagtcattctgatgcctatgctcgaggacatacaggccactctcatactgcagcaggacctagttcttgtcattctagttggagaccacaaataggtccaaggagtggtatttccttagaggagtcgtttagtcatgtgccttcacaggctccgtcacaatcacttgacttttcagcttcatcagaacttgatcctgctaattgggaccctaattacagtgatgagtcactattgcaagaagacaattccctgtcagctgatctaagtagcaatctccactttggagatgcaggtggccaagggagcggatctatcagatcagcaaatttccaaggccatgtatttgctgcatctaaccctgtaccaacaaaccaaagagcagatcaattatttgatgtgtcctcggaaggagcgagtgcccattctagtgttcccatcaactacggtggttacaaccctccaaactatcctcagcaaaatctccgtccccatcatggacagccaattcttcatcagcgatataaccaggcaacttccagtccaatgcggccaatgggaagccatcacagtgggcagcctgcatggtctagtagttttggcatgggtgacggggtgccttggggaggaacaggagggcactcatatacgacaagtgggctaccttcatctcttccaagaaaggattatgggagcatcttttag

SEQ ID NO: 21247 - protein, 924 aa, Sorghum bicolor
  misc_feature: Ceres ANNOT ID no. 8702719
  misc_feature: Up-regulated in root tissues in response to salicylic acid treatment
  misc_feature: Down-regulated in root tissues in response to salicylic acid treatment
  misc_feature (90)..(479): SWISSPROT Homolog: EC 2.7.11.1 Non-specific serine/threonine protein kinase
  misc_feature (153)..(473): Pfam ID: Pkinase Pfam Description: Protein kinase domain
MGLQVEAKVLFSKSFEELRCSWLRMEESGGSSGRREDAAPPWKPSEATAFARFAAAAASPEASPSASANGAAARVSSLHGVKRKSFVARLTAGIIQTYLQCDPEFKYSEVLNPKRFLTNPSTPAHNDGLDNANWDLILYVNLELVNKMSNRRFIVKEMLGQGTFGQVVKCWDTETNDYVAVKVIKNQPAFYHQAIMEVSLLRTLNQKFDPDDQHNIVRMLDYLSFQNHLCIAFEMLGQNLYELLKRNHLRGLKLKYVQAFSKQILDAMVVMREAGIIHCDLKPENILLAPSVATAAAVKVIDFGSACLEGKTVYSYTTAIDMWSFGCIVAELFLGLPLFPGASEYDVLQRMMTILGGQPPDELLREAKNTIRFFKHVGIYPGNEAPSGLSSAYRILSEEEVEVRDSKRPKMGKWYFPHLKLDKLICTYPWNNSELSETEKTDRLGLVDFLKGLLEFDPNKRWSPLQALYHPFITGESFTGPYEPVPETARIPVARAAAIDHNPGGGHWLHSGLSPQVGSVNRYLPLNNAYPPKVPFSYGSSYGSYGSHGSYTGNPGFGNSYGSTGDVNTMNMYYSPLGFSGLAQIGSSPDVRLRMRLPHDRGIRLSPGSLGPMSLGASPSHFTPPNYQMQIPANSTGKHGSGSPASGGIHGSPLGRAAAVGPYNMRRNLPMPPHDYVSQHGQGRFGDGVSFSHSDAYARGHTGHSHTAAGPSSCHSSWRPQIGPRSGISLEESFSHVPSQAPSQSLDFSASSELDPANWDPNYSDESLLQEDNSLSADLSSNLHFGDAGGQGSGSIRSANFQGHVFAASNPVPTNQRADQLFDVSSEGASAHSSVPINYGGYNPPNYPQQNLRPHHGQPILHQRYNQATSSPMRPMGSHHSGQPAWSSSFGMGDGVPWGGTGGHSYTTSGLPSSLPRKDYGSIF

SEQ ID NO: 21248 - DNA, 1695 bp, Sorghum bicolor
  misc_feature: Ceres ANNOT ID no. 8702752
  misc_feature: Up-regulated in shoot tissues in response to salicylic acid treatment
  misc_feature: Down-regulated in shoot tissues in response to salicylic acid treatment
  misc_feature: Encodes the peptide sequence at SEQ ID NO 21249
atggctcggcggtcgtcttcctcgtcgtcgggggcctggcggtacctgaacccggcgtactacctcaagcggcccaagcgcctggcgctcctcttcttcgtcttcgtcgcggccaccttcgccttctgggaccgccagtcgctcgtcagcgagtacgagtctgagatttcccgattagaagatgatataaatcggttgcatgaccagctaagaaaggctggagttcatctggatgaaaatccagtagtaagcaacaggaattccagaaaagatcttgtagaaattgatcctgtcaataatgaaaggcgggaaaaagttaaagaggcaatgctccatgcttggaattcttatgtgaagtatgcctggggaatggatgagcttcagccacaatcgaagaatggtatcaatagcttcggtggtcttggagcaacccttgttgactcacttgatacgctgtatataatgggcctgaaagatgaatttgagaaagctagagactgggtggcggagtcattagactttgacaaggattatgatgcaagtgtttttgaaacgaccataagggttgttggaggtctgcttagtgcatacgatctatctggtgataaagtatttcttgagaaggctaaagatattacagatcgactattacctgcttgggatacaacatctggcatcccctataataggataaacctagctcatggacgagcccataatcctggatggaccaatggtgacagtatccttgcagattctggtaccgagcaacttgaattcatagctctgtcacagaggactggggatcccaaataccagcagaaggcggagaacgtcatcacacagcttcagaagatatatcccagtgatggtttgcttcctatctacataaatcctcattctgggacagcatcatactcaactatcacatttggtgctatgggagatagcttctacgaatatttgctcaaggtctgggtccaggggaataaaactgagcatgtaaaacactacagacaaatgtgggagacatcaatggaaggtctattaagtttaaccaagaaaactacaccatctaattactactacatttgtgaaaagaatggtggctcgttatctgacaagatggatgaacttgcttgctttgctcctggtatgctggcattaggagcctctggttatggaccagaaaaatcagagcaaattatgaatcttgcaaaagagcttgctaggacctgctataatttctaccaaaccactcccacgaagttggctggagaaaattattttttccatactggacaggacatgagtgtgggcacatcgtggaacatcttgagaccggagactgttgaatcacttatgtacctgtggcgcttgacggggaataaaacataccaagattgggggtgggacatattccaggcatttgagaagaactcccgcatagaatctggatatgtgggactgagagatgtgaacactggtgaaaaagataacatgatgcagagcttcttcctggcagagacgctcaagtacctctacctacttttctcccctccatcagtcatatccttcgacgagtgggttttcaatactgaagctcacccattgagaattgttccagtaaatgataacaaaggcattggaacgccggtccgaccattcgggagaaaacagggaaagcctgagtaa

SEQ ID NO: 21249 - protein, 564 aa, Sorghum bicolor
  misc_feature: Ceres ANNOT ID no. 8702752
  misc_feature: Up-regulated in shoot tissues in response to salicylic acid treatment
  misc_feature: Down-regulated in shoot tissues in response to salicylic acid treatment
  misc_feature (96)..(541): SWISSPROT Homolog: EC 3.2.1.113 Mannosyl-oligosaccharide 1,2-alpha-mannosidase
  misc_feature (109)..(540): Pfam ID: Glyco_hydro_47 Pfam Description: Glycosyl hydrolase family 47
MARRSSSSSSGAWRYLNPAYYLKRPKRLALLFFVFVAATFAFWDRQSLVSEYESEISRLEDDINRLHDQLRKAGVHLDENPVVSNRNSRKDLVEIDPVNNERREKVKEAMLHAWNSYVKYAWGMDELQPQSKNGINSFGGLGATLVDSLDTLYIMGLKDEFEKARDWVAESLDFDKDYDASVFETTIRVVGGLLSAYDLSGDKVFLEKAKDITDRLLPAWDTTSGIPYNRINLAHGRAHNPGWTNGDSILADSGTEQLEFIALSQRTGDPKYQQKAENVITQLQKIYPSDGLLPIYINPHSGTASYSTITFGAMGDSFYEYLLKVWVQGNKTEHVKHYRQMWETSMEGLLSLTKKTTPSNYYYICEKNGGSLSDKMDELACFAPGMLALGASGYGPEKSEQIMNLAKELARTCYNFYQTTPTKLAGENYFFHTGQDMSVGTSWNILRPETVESLMYLWRLTGNKTYQDWGWDIFQAFEKNSRIESGYVGLRDVNTGEKDNMMQSFFLAETLKYLYLLFSPPSVISFDEWVFNTEAHPLRIVPVNDNKGIGTPVRPFGRKQGKPE

SEQ ID NO: 21250 - DNA, 2361 bp, Sorghum bicolor
  misc_feature: Ceres ANNOT ID no. 8702761
  misc_feature: Up-regulated in shoot tissues in response to salicylic acid treatment
  misc_feature: Encodes the peptide sequence at SEQ ID NO 21251
atggatcttcttccaatcgttgccacactcctctgcctatgctttgttcgagcccagtgcgatgcgggatcagcctctccgtcgccagagcatgagcaggaaaatcagatgctgagatcgaaggtcgcgtccttagaggatgagattagcaggaggaaggaggagacctcggagctggagagcgttgtcagggacaggaccgcacagatggcaacattggtaggcgacctagaacttttgcagaaattgaacttgggtgatgacgagtctgtgatgaaggcgaacacacatgatggaatgcttgagaagcagacactgactcatgaagcaaagcagattgagaggttgggcaacgatttggaagaccagattaggaaaggtgaatcattagaagcacgggctattgaagctgaaagaagcttggaagaattcggtcgcaagttggagcatgctgagaaaactaatattgatcagaagaaaaagattcaggacctcagtgacagacttcagtatgcagaggacaaactttcaacattggaaaatgaagcaaaatcgaaggcagaagagttggcaaaggttcatggcatgtggcttccccactggctttcagtgcgtgttttacgctaccagagcatattttactcttcacttttggtcaatttcctgacttgcaatatcttttgcctcctgatgaagaaactagttccagtggcaaaagaccatctcgacgcactcaggaatactaccgcggcgttggcatcagcagtagctaactgcacctccacagcatacagagtctgcagggatgttatccaagcgtgtgcagtgacggcaggaggattcgcagataactattggcagagattctcccagccatacctcagtcgcatcgtcgcagcgtctgaacctcacctgtctagagcaagcgtggttctcgaaccttacatgaggcccgcaacatccgcgtggagaagcctcgtctcgtttacaagcgaataccatcatcagtttcagctgacaagctggcatggatcacggcgcccgctctgttggcgctgccggtgttgtccatttacaagatcgtctcagcaatcgtccggtacccaaggaactaaacaaggcctgagtcccttcttttgccactcgatatggcagctaaatgatctaatagtgatccaaacaggaggtgttcataagagtggggtgtacatgttcaaagggtttggcgttaaggacatgaaggccgttccacttcctcgcccgagggcagctcccaaacgacgagcgtggatacttggcgttgcaacttttatcttcatcgcactagcctgggcttacctgtatcctcccccgcattacacttctcctgtgagagattggcttcctggaaggcttcctgcggagcctgccagggaattgactgatgaggagagggcctcgcgtgttgttttcagacagatcctaacaacacctgctgttcgatccaagaattcaaaaatagctttcatgttcttgactccggggacgctgccatttgaaagattgtgggaaaaattctttgagggccatgagggaaggtataccatatatattcatgcctcaagggagaagccagagcatgtcagtcccatatttgttggtcgagagatacacagtgaaaaggtaacttggggtaaaatttctatggttgatgctgagaggaggttgctggcaaatgctctacaagacattgacaatcagcattttgttttgctatctgatagctgtgtacctttgcacaattttgattatgtatatgactacctgatgggggcaaatctcagttttattgactgcttttatgatcctggaccacatggaaattttagatattcacagaatatgttacctgaggtcacagagactgattttaggaagggttcacagtggttctcagtcaaacgccaacatgcattgatgattattgcagatagtctttactatactaagttcaagcttcattgcaggcctgggatggaagatggtcgcaactgctatgctgatgaacattatttgccaacagtattccatatgatggacccagatggaattgctaactggtctgtaacccatgttgactggtctgaagggaagtggcatccgaaagcttacagggcaaaggatgtcactttcgagcttctgaagaatataacatcaattgacatgaaccaccatgtcactagtgatagcaagaaagtggttacagagaaaccctgcctatggaatggagcaaagagaccatgctacctgtttgcgaggaagttctaccctgaatccataaataatctcttgaccctgtttgcgaattatacacttatttga

SEQ ID NO: 21251 - protein, 786 aa, Sorghum bicolor
  misc_feature: Ceres ANNOT ID no. 8702761
  misc_feature: Up-regulated in shoot tissues in response to salicylic acid treatment
MDLLPIVATLLCLCFVRAQCDAGSASPSPEHEQENQMLRSKVASLEDEISRRKEETSELESVVRDRTAQMATLVGDLELLQKLNLGDDESVMKANTHDGMLEKQTLTHEAKQIERLGNDLEDQIRKGESLEARAIEAERSLEEFGRKLEHAEKTNIDQKKKIQDLSDRLQYAEDKLSTLENEAKSKAEELAKVHGMWLPHWLSVRVLRYQSIFYSSLLVNFLTCNIFCLLMKKLVPVAKDHLDALRNTTAALASAVANCTSTAYRVCRDVIQACAVTAGGFADNYWQRFSQPYLSRIVAASEPHLSRASVVLEPYMRPATSAWRSLVSFTSEYHHQFQLTSWHGSRRPLCWRCRCCPFTRSSQQSSGTQGTKQGLSPFFCHSIWQLNDLIVIQTGGVHKSGVYMFKGFGVKDMKAVPLPRPRAAPKRRAWILGVATFIFIALAWAYLYPPPHYTSPVRDWLPGRLPAEPARELTDEERASRVVFRQILTTPAVRSKNSKIAFMFLTPGTLPFERLWEKFFEGHEGRYTIYIHASREKPEHVSPIFVGREIHSEKVTWGKISMVDAERRLLANALQDIDNQHFVLLSDSCVPLHNFDYVYDYLMGANLSFIDCFYDPGPHGNFRYSQNMLPEVTETDFRKGSQWFSVKRQHALMIIADSLYYTKFKLHCRPGMEDGRNCYADEHYLPTVFHMMDPDGIANWSVTHVDWSEGKWHPKAYRAKDVTFELLKNITSIDMNHHVTSDSKKVVTEKPCLWNGAKRPCYLFARKFYPESINNLLTLFANYTLI

SEQ ID NO: 21252 - DNA, 1446 bp, Sorghum bicolor
  misc_feature: Ceres ANNOT ID no. 8702754
  misc_feature: Down-regulated in root tissues in response to aminocyclopropane carboxylic treatment
  misc_feature: Down-regulated in shoot tissues in response to salicylic acid treatment
  misc_feature: Encodes the peptide sequence at SEQ ID NO 21253
atggcttcaaggttatcacatcagctgagcaatggcctgtatgtttctggtcgacctgagcaacctaaggagaaggccccaaccatttgttccactgcgatgccatatactgggggtgacatcaagaaatctggagagctggggaagatgtttgatcttcatgttgagaagtcaagaaaatctggtcctctaggaaatgctccttcaagaaatacttcatttggcggtgctgcttccaactctggacccgtctccaatgctggtggtcgttccaactactctggttctctttcatcttcagttcctggtgctggcggatcagccagagcaaaatcaaactccggaccgctcaataaacatggagagccaacaaagaggtcatctggtccccagtctggaggagtgaccccaatggcacgccagaactctggcccccttccacctgtgcttccgacaactgggcttatcacatctgggcctatctcttcagggccacttaactcgtctggtgctccaaggaaagtatctgggccacttgattctgctgcatcgatgaaaatgcgggctacttcctttgctcacaatcaagctgttactaatctcaacactgaagatggttactcaattcagggaagctttccgaagccaatactctgggctgtgattctgctctttgtgatgggtttcatagcaggtggcttcattctgggtgctgttcacaatgcaattttgctgatagttgttgtggtgatatttggttttgttgctgcacttcttatctggaatgcttgctggggtaggagaggcgcaattgggtttgttaatcgctatcctgatgctgatctcaggactgccaaagatggacagtatgtaaaggttacaggggtggttacttgtggaaatttccccctcgaatcctcgttccaaagggttccaagatgtgtatacacttctactagcttgtatgagtacaggggttgggattccaaagctgccaatactgagcatcggcgttttacctggggtttacgctcaatggagcgacatgcggttgatttctacatctcagattttcagtctgggcttcgagcattggtgaaaacaggatatggtgcacgtgtgaccccttacgtcgatgaatctgttataattgacatcaatccagacaacaaggatatgtcccctgattttttgagatggctaagggagagaaacctttcaagcgatgatcggacaatgcgcctaaaagaaggatacatcaaggaaggtagcactgtgagtgtgatgggggttgtccaaaggaacgacaatgttctgatgattgttcctccatcagagcccatctcaactggttgtcagtggaccaagtgtgttctcccaaccaaccttgacgggcttgttttaagatgcgaagatacttcgaacattgatgtgataccagtttaa

SEQ ID NO: 21253 - protein, 481 aa, Sorghum bicolor
  misc_feature: Ceres ANNOT ID no. 8702754
  misc_feature: Down-regulated in root tissues in response to aminocyclopropane carboxylic treatment
  misc_feature: Down-regulated in shoot tissues in response to salicylic acid treatment
MASRLSHQLSNGLYVSGRPEQPKEKAPTICSTAMPYTGGDIKKSGELGKMFDLHVEKSRKSGPLGNAPSRNTSFGGAASNSGPVSNAGGRSNYSGSLSSSVPGAGGSARAKSNSGPLNKHGEPTKRSSGPQSGGVTPMARQNSGPLPPVLPTTGLITSGPISSGPLNSSGAPRKVSGPLDSAASMKMRATSFAHNQAVTNLNTEDGYSIQGSFPKPILWAVILLFVMGFIAGGFILGAVHNAILLIVVVVIFGFVAALLIWNACWGRRGAIGFVNRYPDADLRTAKDGQYVKVTGVVTCGNFPLESSFQRVPRCVYTSTSLYEYRGWDSKAANTEHRRFTWGLRSMERHAVDFYISDFQSGLRALVKTGYGARVTPYVDESVIIDINPDNKDMSPDFLRWLRERNLSSDDRTMRLKEGYIKEGSTVSVMGVVQRNDNVLMIVPPSEPISTGCQWTKCVLPTNLDGLVLRCEDTSNIDVIPV

SEQ ID NO: 21254 - DNA, 1767 bp, Sorghum bicolor
  misc_feature: Ceres ANNOT ID no. 8702686
  misc_feature: Down-regulated in root tissues in response to salicylic acid treatment
  misc_feature: Encodes the peptide sequence at SEQ ID NO 21255
atggatttcatgaaggttttcgatcagactgtaaagagggaggtaaatctgaaggtgctcaaggtccccgagatggagcagaaggtacttgatgcaacaagtgatgaaccgtggggccctcatggaagtgccctttcagagcttgcacacgctaccaagaagtttgctgagtgccagatggtaatgaatgtcctctggactaggctgtccgagagaggcgcgaactggcgtcatgtgtataaggcattgacaattattgagtacttgatagccaatggttctgagagggcagttgatgacattctagatcattattctaagatctcggttctttcgagttttgaatatgttgagcctaatggtaaagacgctggaataaatgtgaggaaaaaagtagaaaccattgtgggcatcataaatgacaaggagagaataaaggccgtgagagacaaagcagccagtaatcgtgataagtacgttggactatcatccacaggcataacatataaatcaagctcagcctcatttggtagcaactacagttcaggcgaacgttatgggagtttcagtggtgaaaaggaagctgactcatatggtgacagttacagggacaaagaacctgttaaaacctccacaagtaatagtggcgtccggaaatctggcagcaagctgaggaaggatgcgaagcctgataggaggaatgaggattcacccagctctttcaacccctcatctaatacaaataacactgaggacggctttgatgacttcgatcctcgcggatcaaatggaaaaacaactgctaaaccaaatgaggtggatctgtttggcccaaacttgatggatgattttattgatacatctgcagcaactccagcaacagagagtgctgtagagccacaggtcgatctgtttgctgatgcagatttccaatcggcaacagagacagctgcaaatacagatgtccagggcaatgttgacctttttgcggaaaaggcatcttttcctgcagcatttccaccacaggctgggtttattccaccaccaagtgccgggacatcttctgaaaatacttctgtatccaagaaggctgctcctgaaccttttgatccttttggtgctattcccttgaacagttttgatggatctgacccatttggtggcttcagctcaaatgctggatcatctactgcagcaccacccacccacagttctacaggaaatatcagcacacgagaccagaaccttcaggctgcatccgacttcggtgccttcgtatcaaacaatgagggagcagctaaagatccatttgatctttcttcaagtgccaatgtcagaaaaacacctttggcagctccgaagattgatgcatctgattttggtgcatttgtctctagtactgaggaagcagctaaggaccctttcgatctttcttcgggtagcaaccttggaaggacagaccaagcacccgcggcagctcccaagcctaacatgaagaaagaaaattttcaggtcaagtctggcatatgggcagactccttgagcaaaggattgattgatcttaacataactgcaccgaagaaggtgaacctagctgatattggcatcgttggtggccttggtgatgggtccgatgagaaggccatgccctcgtggaccatgggcaccggatctgggctaggaatatctgggattccaccatcaacacaaggcggtggcatcgagagcttagccaactacaacaagcatcaattcggcttcaaataa

SEQ ID NO: 21255 - protein, 588 aa, Sorghum bicolor
  misc_feature: Ceres ANNOT ID no. 8702686
  misc_feature: Down-regulated in root tissues in response to salicylic acid treatment
  misc_feature (22)..(145): Pfam ID: ENTH Pfam Description: ENTH domain
MDFMKVFDQTVKREVNLKVLKVPEMEQKVLDATSDEPWGPHGSALSELAHATKKFAECQMVMNVLWTRLSERGANWRHVYKALTIIEYLIANGSERAVDDILDHYSKISVLSSFEYVEPNGKDAGINVRKKVETIVGIINDKERIKAVRDKAASNRDKYVGLSSTGITYKSSSASFGSNYSSGERYGSFSGEKEADSYGDSYRDKEPVKTSTSNSGVRKSGSKLRKDAKPDRRNEDSPSSFNPSSNTNNTEDGFDDFDPRGSNGKTTAKPNEVDLFGPNLMDDFIDTSAATPATESAVEPQVDLFADADFQSATETAANTDVQGNVDLFAEKASFPAAFPPQAGFIPPPSAGTSSENTSVSKKAAPEPFDPFGAIPLNSFDGSDPFGGFSSNAGSSTAAPPTHSSTGNISTRDQNLQAASDFGAFVSNNEGAAKDPFDLSSSANVRKTPLAAPKIDASDFGAFVSSTEEAAKDPFDLSSGSNLGRTDQAPAAAPKPNMKKENFQVKSGIWADSLSKGLIDLNITAPKKVNLADIGIVGGLGDGSDEKAMPSWTMGTGSGLGISGIPPSTQGGGIESLANYNKHQFGFK

SEQ ID NO: 21256 - DNA, 2448 bp, Sorghum bicolor
  misc_feature: Ceres ANNOT ID no. 8702804
  misc_feature: Up-regulated in root tissues in response to methyl jasmonate treatment
  misc_feature: Encodes the peptide sequence at SEQ ID NO 21257
atgccgcaccgccgccgagtccttaacccgacgctgcccccgccacctccccccgccaccgcgttcggccacctcggcgcggacgaggcggcgcggctgccgctcctcgcggactacgcgctgctccaccagtcctccgccgccgcctccgtctccgtcgtcgacgcgcccgcggcggccccggcgtcgtccgagtggagcgccgggagcgccttcaccgccatctccgacgcggccaccaccaccgcctcctccaccgctacggcgccgggctcctcctcccagctgctgaccgccgccgaagccgtcggcgggagggagagggacacgtgggtccgccgcgccagggaggggtactacctccagctctcgctcgccatccgcctcacctcgcaggccttcctcgccggcgcccctcccccgcccgagctcctcttcggctgcggctccggcgtcgtcgccgaacaccacgctgctggcgacggcgcggatgatccggaggccatctcctaccggctctgggtgaacgggtgcctgtcgtggggcgacaagatcacgcacggcttctacaacatcatgggcatcgacccgcacctgtgggccatgtgcaacgtcgcggaggagggccgccggctgccgtcgctggcggcgctgcgggcggtggacgccagcgagtcgtcgctggaggtggtgctcgtcgacaagggcgccgactcggtgctcctcgacctcgagcgccgcgccctcgacctcgtccgcgcgctcggcgtcacgctcgacctcgcccgcagcctcgccgtcctcgtctccgaccacatgggaggtgcgttgcgatcggaggacggggacctgtacctgcggtggaaggcggtgagcaagaagctgaagaagaggcagaagtgcgtcgtcgtccccatcggcggcctgtccataggcttctgccggcaccgtgccattcttttcaaggtactcgcggacttcatcggcctgccatgccggattgcgcaaggctgcaagtactgctctgcgcctcaccgatcatcttgccttgtcaaagttgacagtgagaggagatatgcaagggagtacgttgtggaccttgtagttgagcctgggagcatcagcagcccggattcatccatcaacggccagctgctgtcgacagtgccttcacctttcaagacttcgagtgcagttggctcagggaactacacaacaccagttgcagcctggaatcaagcaatagcagatgaacgtcgcaacatggtattgttaaattcccagtattcagttgctaggtgccgcgttgtggagaacaactctgttcaggtagccagcaaagaagagctggtgcgtggacagatcacgcagaatggaaactgtaatggcgtatcaaatttacaagtgtcggagcaattcaaggcaatggacatcggtgctgagaatggtaacaaggagaacgtccctggtactacgcttccagaaagcttgagcattgaaccaccttttgctgtagactggctcgagatatcatgggaggagctcgacctcaaggaacgcgtaggcgccggttctttcggcacagtttatcgtgcagattggcatggttcagatgttgcagtaaaggtgcttacagatcaggatgtcggcgaagctcagctgaaggaattcctaagagagattgctattatgaaacgagtccgccatccgaatgtggtattgttcatgggtgcagtgacaaaatgcccacatttgtcaatagtgacagagtatttgcccagagggagcctcttccgcctcatcaacaaggcagctagtggagaaatgctggatctaaagcgccgtttgcgcatggcactagatgttgcaaaaggcatcaactatctccactgcctgaatcctcctattgtgcattgggatctcaagacaccaaacatgctggttgaccggaactggtctgtgaaggtaggtgactttggcttgtccagatttaaggcaaacaccttcatatcatcaaaatcagttgctggaacaccagaatggatggcacccgaatttctccgtggcgagccatccaacgagaagtgcgatgtttacagcttcggcgtggtcttgtgggagctcctgacaatgcagcaaccatggagtggcctaggccctgcgcaggtagtaggagctgtagcatttcagaacagaaggctttcaattccgaaagataccaatccagaacttgctgctcttgttgaatcctgctgggatgacgatccaaggcagcggccttcgttttcgagcattgtggatacactgaagaagttgctgaaggctcttctaggaggtggagtcggagacggtgcaaacaaaacagctgtcgtcgcgcgccgccttcgatcggatccggcggttctgttttgggttgggagtggcctagctaagggtctcttcgtttag

SEQ ID NO: 21257 - protein, 815 aa, Sorghum bicolor
  misc_feature: Ceres ANNOT ID no. 8702804
  misc_feature: Up-regulated in root tissues in response to methyl jasmonate treatment
  misc_feature (99)..(767): SWISSPROT Homolog: EC 2.7.11.1 Non-specific serine/threonine protein kinase
  misc_feature (515)..(769): Pfam ID: Pkinase_Tyr Pfam Description: Protein tyrosine kinase
MPHRRRVLNPTLPPPPPPATAFGHLGADEAARLPLLADYALLHQSSAAASVSVVDAPAAAPASSEWSAGSAFTAISDAATTTASSTATAPGSSSQLLTAAEAVGGRERDTWVRRAREGYYLQLSLAIRLTSQAFLAGAPPPPELLFGCGSGVVAEHHAAGDGADDPEAISYRLWVNGCLSWGDKITHGFYNIMGIDPHLWAMCNVAEEGRRLPSLAALRAVDASESSLEVVLVDKGADSVLLDLERRALDLVRALGVTLDLARSLAVLVSDHMGGALRSEDGDLYLRWKAVSKKLKKRQKCVVVPIGGLSIGFCRHRAILFKVLADFIGLPCRIAQGCKYCSAPHRSSCLVKVDSERRYAREYVVDLVVEPGSISSPDSSINGQLLSTVPSPFKTSSAVGSGNYTTPVAAWNQAIADERRNMVLLNSQYSVARCRVVENNSVQVASKEELVRGQITQNGNCNGVSNLQVSEQFKAMDIGAENGNKENVPGTTLPESLSIEPPFAVDWLEISWEELDLKERVGAGSFGTVYRADWHGSDVAVKVLTDQDVGEAQLKEFLREIAIMKRVRHPNVVLFMGAVTKCPHLSIVTEYLPRGSLFRLINKAASGEMLDLKRRLRMALDVAKGINYLHCLNPPIVHWDLKTPNMLVDRNWSVKVGDFGLSRFKANTFISSKSVAGTPEWMAPEFLRGEPSNEKCDVYSFGVVLWELLTMQQPWSGLGPAQVVGAVAFQNRRLSIPKDTNPELAALVESCWDDDPRQRPSFSSIVDTLKKLLKALLGGGVGDGANKTAVVARRLRSDPAVLFWVGSGLAKGLFV

SEQ ID NO: 21258 - DNA, 1599 bp, Sorghum bicolor
  misc_feature: Ceres ANNOT ID no. 8702836
  misc_feature: Up-regulated in root tissues in response to salicylic acid treatment
  misc_feature: Up-regulated in shoot tissues in response to salicylic acid treatment
  misc_feature: Encodes the peptide sequence at SEQ ID NO 21259
atgcccccgcccagtactctggtcgcgcccttctaccgttttcttggagaaagtacgataaattatgtacggcttattctagttctaattaccagctgcttcgaggcaagcagcttattgaagcatgtaactggcactgcgagtttgcaagggcatgcggatagtttgttggatgcctcagtcagacattttagttcagctccatctgcacagtctgcctcaactgaagaaaatgggtttaagggccatggcatgttggcaccttttacagctggctggcagagcaatgatttgcatccactgattattgagagatctgagggttcctatgtttatgacattaatgggaacaagtacctggattctcttgcaggattatggtgcacagcgttaggtggtagcgagcctcgattagtcaaagcagcaactgagcaattaaacaagttacccttctaccattccttttggaaccgtactaccaaaccttcgttggatcttgcacaggagatccttagcatattcactgcaaggaaaatgggaaaagttttcttcacaaacagcggttcagaagcaaatgactctcaggtcaaactagtatggtattataacaatgcattggggaggccaaacaagaagaaatttattgcacgatcaaaagcataccatggatctacattgatatcagcgagtctaactggtcttcctgccctgcaccagaagtttgatctaccagcaccttttgttctgcacactgactgccctcactactggagatatcatcttcctggtgagacagaagaagaatttgcgactagacttgccaccaatttagagaatcttattctcaaagaaggaccagaaacaatcgctgctttcattgctgaacctgtgatgggtgctggtggtgtcatccctcctccaaaaacctattttgaaaaggttcaagcagtggtcaagaagtatgacattcttttcatagcagatgaggttatcactgcatttggaaggttggggactatgtttggatgtgattattataacatcaagccagatctagtttcattggccaaggctctttcaaatgcctatgtacccatcggggcaactcttgttagccaagagatatcagatgtgattcattcccagagcaataagcttggttcatttgctcatgggtttacatactctggtcatccagttgcctgtgctgtggccatagaagctctgaaactttatcgcgaaagggatattcctggtcatgtcaagcaaatcgctccaaagttccaggacggaattagggcgttcgcagacagtccaattattggggagatacgcggcttagggatgataatgggaaccgaattcactaacaacaaatcaccgaccgatctattccctgccgaatggggggttggtgcgatctttggagaggagtgccagaagcgcggcatgttggtcagggttgccggcgacgcaatcatgatgtcgccgacgctgatcatgacacccgctgaagtcgacgagctggtgagcatctatggggaagccctcaaggccacggaggagagggtggcagccctgaaatccaagaagaactag

SEQ ID NO: 21259 - protein, 532 aa, Sorghum bicolor
  misc_feature: Ceres ANNOT ID no. 8702836
  misc_feature: Up-regulated in root tissues in response to salicylic acid treatment
  misc_feature: Up-regulated in shoot tissues in response to salicylic acid treatment
  misc_feature (81)..(517): SWISSPROT Homolog: EC 2.6.1.62 Adenosylmethionine--8-amino-7-oxononanoate transaminase
  misc_feature (102)..(457): Pfam ID: Aminotran_3 Pfam Description: Aminotransferase class-III
MPPPSTLVAPFYRFLGESTINYVRLILVLITSCFEASSLLKHVTGTASLQGHADSLLDASVRHFSSAPSAQSASTEENGFKGHGMLAPFTAGWQSNDLHPLIIERSEGSYVYDINGNKYLDSLAGLWCTALGGSEPRLVKAATEQLNKLPFYHSFWNRTTKPSLDLAQEILSIFTARKMGKVFFTNSGSEANDSQVKLVWYYNNALGRPNKKKFIARSKAYHGSTLISASLTGLPALHQKFDLPAPFVLHTDCPHYWRYHLPGETEEEFATRLATNLENLILKEGPETIAAFIAEPVMGAGGVIPPPKTYFEKVQAVVKKYDILFIADEVITAFGRLGTMFGCDYYNIKPDLVSLAKALSNAYVPIGATLVSQEISDVIHSQSNKLGSFAHGFTYSGHPVACAVAIEALKLYRERDIPGHVKQIAPKFQDGIRAFADSPIIGEIRGLGMIMGTEFTNNKSPTDLFPAEWGVGAIFGEECQKRGMLVRVAGDAIMMSPTLIMTPAEVDELVSIYGEALKATEERVAALKSKKN

SEQ ID NO: 21260 - DNA, 2658 bp, Sorghum bicolor
  misc_feature: Ceres ANNOT ID no. 8702846
  misc_feature: Up-regulated in root tissues in response to salicylic acid treatment
  misc_feature: Encodes the peptide sequence at SEQ ID NO 21261
atgtctgtttctaattggtcttccttttcttttttggtagaacgcatcacatccagtgaattggccagagtagaaccaccagcatccacactagctgcgacatcttcagttggcacacgagtgccaatgcagagacctgattctggaggttcattatctcaagcaaaggtcaaacttttggtgaatcacttcattgtcaactaccgagaagtgtcaactatttttcactatgacataagcatcaagcttgatgaagcttcccctaaggcttcgggcaaagaactctccaaggcagaatttctttctgtcaaggatgaactcttcagggaaagcagtttacggcgtctttcctcatgtgttgcttatgatggtggaagaaacctctacacttctgctgaactgccagcaggtttatttcgtgtgagagttcgatcaaagacctacattgtatcagtagatttgaagaagcagctgccattaagtcaactctcagagttacctgtgcctagagaggtcttgcagggtcttgatgttgttgtgcgtgaggcctccagatggcgcaagattatccttggtagaggattttactcaccaagcagcagtgtagacattgggcagggtgctgtagctatgaaaggaacccagcagacccttaaatacactcagcaagggctgatcctatgtgttgactattcagttatgccattttacaaagctgggccggtgatggatattgttcagaaattagtaccccaccttgattaccggacaacactgaacaggaggcaactggaaaatctgattgaggagctcaaaggccgacgtgtgactgtggttcatcggaggactaatcagaagtacacagtgcaaggcttgacacccttacctgccatccagatgacctttgtggatgctgaatctggccaaacgaagaggcttgtggattattatgctcagaaacatgacaaggtgattgagtaccagatgcttccatgcttggatttgagcaagagcaaggacaaaccaaatcatgtaccaattgagctctgcactcttcttgaaggacagaggtttccaaaagcaaacttggataagaattctgacaggatactgaaaggaaaggctctaattcctccatctcatcggaggaatgagattcaagacttggtgaatgcttcggatggaccttgcagaggagaaattgcacagcaatttgggatttccttggatttacgaatgacagaagtcacgggtaggatccttcccccaccaaatctcaaacttggggcatccaatggccacatgtccaaattcagtatggatcagaactgccagtggaatcttgtgaagaagagactagtagagggccgggatcttcagtgctggggcattgtcgacttcagtgctgagccgtctcacccccggcaggagcccctcaatggaaggatgtttgttgacaagatcgtgaggaagtgctgtgagcttggtatccaaatgaactctaatccttgcttcatacacatatcaaagatggcagtgctctccgatccacatcgactaaaggaggagctaaacaaagcaaaacaggctgcagtgagcaagaagcagaggttgcagctccttttctgcccgatgtccgagcagcacccagggtacaagacactgaagctgatttgtgacacacagctcgggatcctgacccagtgtttcctgagcgaccgcgcaaacaagccaaatgggcaggaccagtacatgaccaaccttgctctcaagattaatggcaagcttgggggcagcaacgttcagctgtttgactcgcttccacgggtcggtggtggggcacctttcatgttcatcggtgctgacgttaaccacccgtcacccgggaacgtggagagcccatcaatcgcaggcgtggttgcatctatcaacagcggtgccaacaagtatgtgtcaagaatccgtgcacagccacaccgctgcgaggtgatccagcagctgggtgagatctgcctggagctcattggagtctttgtgaagataaatcgcgtgaagccacagaagatcatctacttccgtgacggcgtgagtgacgggcagtttgacatggtcctgaacgaggagctggctgacctggagaaggcaatcaaggtggacggctatgcacctaccatcactgtgatcgtggccaagaagcggcaccacacgcggctgttccccaaggaccagggccagcagcagacgaagactgggaacgtgccgcctggcacggtggtggacactggtgtggttgacccgtctgcatacgacttctacctgtgcagccacaccgggcttctagggacgagcaggccgacacactactacagcctggtggacgagcacggcttcgggtctgacgacctgcagaagctgatctacaacctgtgcttcgtgttcgcgcggtgcaccaagccggtgtcactggcgacgcccgtctactatgctgacctcgtggcgtaccgtggaagggtctactacgaggcagccatgatggtgtcccagcgagggatggggtcggcttcttcagcttcctcgacctcctctgctgggactgttgacttcactaacttcccgaggttgcacaaggatgtggaggacaacatgttcttcatctga

SEQ ID NO: 21261 - protein, 885 aa, Sorghum bicolor
  misc_feature: Ceres ANNOT ID no. 8702846
  misc_feature: Up-regulated in root tissues in response to salicylic acid treatment
  misc_feature (540)..(841): Pfam ID: Piwi Pfam Description: Piwi domain
  misc_feature (250)..(377): Pfam ID: PAZ Pfam Description: PAZ domain
MSVSNWSSFSFLVERITSSELARVEPPASTLAATSSVGTRVPMQRPDSGGSLSQAKVKLLVNHFIVNYREVSTIFHYDISIKLDEASPKASGKELSKAEFLSVKDELFRESSLRRLSSCVAYDGGRNLYTSAELPAGLFRVRVRSKTYIVSVDLKKQLPLSQLSELPVPREVLQGLDVVVREASRWRKIILGRGFYSPSSSVDIGQGAVAMKGTQQTLKYTQQGLILCVDYSVMPFYKAGPVMDIVQKLVPHLDYRTTLNRRQLENLIEELKGRRVTVVHRRTNQKYTVQGLTPLPAIQMTFVDAESGQTKRLVDYYAQKHDKVIEYQMLPCLDLSKSKDKPNHVPIELCTLLEGQRFPKANLDKNSDRILKGKALIPPSHRRNEIQDLVNASDGPCRGEIAQQFGISLDLRMTEVTGRILPPPNLKLGASNGHMSKFSMDQNCQWNLVKKRLVEGRDLQCWGIVDFSAEPSHPRQEPLNGRMFVDKIVRKCCELGIQMNSNPCFIHISKMAVLSDPHRLKEELNKAKQAAVSKKQRLQLLFCPMSEQHPGYKTLKLICDTQLGILTQCFLSDRANKPNGQDQYMTNLALKINGKLGGSNVQLFDSLPRVGGGAPFMFIGADVNHPSPGNVESPSIAGVVASINSGANKYVSRIRAQPHRCEVIQQLGEICLELIGVFVKINRVKPQKIIYFRDGVSDGQFDMVLNEELADLEKAIKVDGYAPTITVIVAKKRHHTRLFPKDQGQQQTKTGNVPPGTVVDTGVVDPSAYDFYLCSHTGLLGTSRPTHYYSLVDEHGFGSDDLQKLIYNLCFVFARCTKPVSLATPVYYADLVAYRGRVYYEAAMMVSQRGMGSASSASSTSSAGTVDFTNFPRLHKDVEDNMFFI

SEQ ID NO: 21262 - DNA, 690 bp, Sorghum bicolor
  misc_feature: Ceres ANNOT ID no. 8702863
  misc_feature: Up-regulated in root tissues in response to methyl jasmonate treatment
  misc_feature: Up-regulated in shoot tissues in response to methyl jasmonate treatment
  misc_feature: Up-regulated in shoot tissues in response to salicylic acid treatment
  misc_feature: Up-regulated in root tissues in response to salicylic acid treatment
  misc_feature: Encodes the peptide sequence at SEQ ID NO 21263
atggcgccggtgaaggtgttcgggccggcgatgtcgacgaacgtggcccgggtgctggtgtgtctcgaggaggtcggcgccgagtacgaggtcgtcaacatcgacttccaatccaaggagcacaagagtcccgagcacctcgccagaaacccgtttggccaaatcccggcgttccaggacggtgatgtcgtgctcttcgagtcccgagcgatctcaaagtacatcctccgcaagtacaagtacagcaagtcatcagcctcagccgccgacctcctgcgcgaaggcgacctcaaggaggcggccatggtggacatgtggacggaagtggaggcgcaccagtacaacccggcgctgtcgccggtcgtctacgagtgcctcatccacccggccatgcgcgggatccccaccgaccagcgggtggtggacgagagcctggagaagctgaggaaggtgctggacgtctacgaggcgcgcctgtgcaagcacgcgtatctggcgggggacttcgtcagcttcgcggacctgaaccacttcccttacaccttctacttcatggcgacgccgcacgcgtcgctcttcgactcgtacccgcacgtcaaggcgtggtgggagaggctcctggccaggccctccgtgaagaagctcggcgccaccatggctgctgctgccgctgccggtgtcaaggcttga

SEQ ID NO: 21263 - protein, 229 aa, Sorghum bicolor
  misc_feature: Ceres ANNOT ID no. 8702863
  misc_feature: Up-regulated in root tissues in response to methyl jasmonate treatment
  misc_feature: Up-regulated in shoot tissues in response to methyl jasmonate treatment
  misc_feature: Up-regulated in shoot tissues in response to salicylic acid treatment
  misc_feature: Up-regulated in root tissues in response to salicylic acid treatment
  misc_feature (1)..(215): SWISSPROT Homolog: EC 2.5.1.18 Glutathione transferase
  misc_feature (114)..(210): Pfam ID: GST_C Pfam Description: Glutathione S-transferase, C-terminal domain
  misc_feature (2)..(77): Pfam ID: GST_N Pfam Description: Glutathione S-transferase, N-terminal domain
MAPVKVFGPAMSTNVARVLVCLEEVGAEYEVVNIDFQSKEHKSPEHLARNPFGQIPAFQDGDVVLFESRAISKYILRKYKYSKSSASAADLLREGDLKEAAMVDMWTEVEAHQYNPALSPVVYECLIHPAMRGIPTDQRVVDESLEKLRKVLDVYEARLCKHAYLAGDFVSFADLNHFPYTFYFMATPHASLFDSYPHVKAWWERLLARPSVKKLGATMAAAAAAGVKA

SEQ ID NO: 21264 - DNA, 2079 bp, Sorghum bicolor
  misc_feature: Ceres ANNOT ID no. 8702929
  misc_feature: Down-regulated in root tissues in response to aminocyclopropane carboxylic treatment
  misc_feature: Encodes the peptide sequence at SEQ ID NO 21265
atgagctccaggaaccgctccgccgccgccgcctcatgcgctgccccggccgcggcgccgtctctccggacgccgcggcgcctgaaacggcggccggttaagtcgccggcgggcgcgcccggcggcgggcggcggagcgggcccgcgacgccgctgctgaaatgggacgtgggcggcggcgggcgtggtgaggggaggaagggggctggcgccgccgacgaagcgggggacgctgcgcgggcgcgggagaccaaggcgagggaggtgtcggtgcggaggctcgcggccggggtttggcggctgcgcccgccggaagccgtggccgggggcggcggcgagagcagagtccgcgtgggtgtcgagcatatcccaaggcatctgcaagtccagcttctcaagcagaacacttcaggtcatcaccagagtttgaagaatgaggtttcaagccccatatctgttttggagcggaagagcggagagctccacaaggtacaacttcatgctacttctgctatgctgcctgtcactaccatggaaaaggcaacaaaatgggagcctggggacataaagggaatggaatcacatgatgcgtatctgatagccagccagctaaatcttcttaatgagcagcaggatacagcatatgttgctaacctccagatggaactccagcaagcacgtgataggataagtgagctggaaactgagcggcggtcagctaagaagaagcttgaccacttgttcaagaaacttgcagaggagaaagcggcttggaggaacagagagcatgaaaaggtgcgtgctattctcgaagatatgaaggcagaccttgaccatgagaagaaaaaccggaggcgtctggagatgattaacttgaaactcgtcaatgagttgaaggaggccaagatgtcagcaaaacaactgttacaagagtatgatacagagaggaaggcacgtgagctcactgaggaggtgtgcaacgagctagcaagagaggtggaggaagacaaagctgaaattgaggccttgaaacaggactccctgaggctgcgagaggaggtagacgaggagcggaagatgctgcaaatggctgaggtgtggcgtgaagaacgggtgcagatgaagcttgttgatgcaaaacttactctcgacgcaaagtacacacagctgagcaaactgcaacaggatgttgaggcgtttattgctgcatgcagtactgcaaatgcagacataacagcagtagaggaagcagagaacataatacaggcaataaagtcagtcagagcccaagatgctgaattcagatatgagccaccggtcgcatcagaagacatattttccatttttgaagagctgcgtccaagtgaggagcctgtcatcaaggagattgagccatgctacaagaatagctctgccaaatgtgaatcagaaattcaagaggttagcccaatgactgatatattcctcgagaagaaagccaaggtatactcaaacaaaagccctaaagatgaaagcgtcactgaagatggtagcagctgggagacaataagccatgaagatatgcagggttcaagtggttcacctgatggaagcgaaccttcagtcagcaacaagatctgtgatggaagcatttcttggaagagcaggaatggtttcgagtatatggagaatgagaagctgaaggatgacttagctgatgcctacctgacaaacatgaaccaacctaagaagaaagaatcagccatttcaaagctctggaagtcgtcccgcccgaagaacagcgagatatgcaagaaagatgcagttgaaaccgtaaatgcaagatcatccaatgtacggctgtcagtagggacttattccactgttgaaagtggcatccaagaaataggactcagtccaccgagtgtcgagcagtggagctcgccagactcaatgaacattcaattcaaccgtggcttcaagggctgtatagagtacccgcggacgtcccagaagcacagcttgaaggcaaagctcatggaggcacggatggagagccagaaggtccagctccgccaggtgctcaagcagaagatctag

SEQ ID NO: 21265 - protein, 692 aa, Sorghum bicolor
  misc_feature: Ceres ANNOT ID no. 8702929
  misc_feature: Down-regulated in root tissues in response to aminocyclopropane carboxylic treatment
  misc_feature (128)..(509): SWISSPROT Homolog: EC 2.7.11.1 Non-specific serine/threonine protein kinase
MSSRNRSAAAASCAAPAAAPSLRTPRRLKRRPVKSPAGAPGGGRRSGPATPLLKWDVGGGGRGEGRKGAGAADEAGDAARARETKAREVSVRRLAAGVWRLRPPEAVAGGGGESRVRVGVEHIPRHLQVQLLKQNTSGHHQSLKNEVSSPISVLERKSGELHKVQLHATSAMLPVTTMEKATKWEPGDIKGMESHDAYLIASQLNLLNEQQDTAYVANLQMELQQARDRISELETERRSAKKKLDHLFKKLAEEKAAWRNREHEKVRAILEDMKADLDHEKKNRRRLEMINLKLVNELKEAKMSAKQLLQEYDTERKARELTEEVCNELAREVEEDKAEIEALKQDSLRLREEVDEERKMLQMAEVWREERVQMKLVDAKLTLDAKYTQLSKLQQDVEAFIAACSTANADITAVEEAENIIQAIKSVRAQDAEFRYEPPVASEDIFSIFEELRPSEEPVIKEIEPCYKNSSAKCESEIQEVSPMTDIFLEKKAKVYSNKSPKDESVTEDGSSWETISHEDMQGSSGSPDGSEPSVSNKICDGSISWKSRNGFEYMENEKLKDDLADAYLTNMNQPKKKESAISKLWKSSRPKNSEICKKDAVETVNARSSNVRLSVGTYSTVESGIQEIGLSPPSVEQWSSPDSMNIQFNRGFKGCIEYPRTSQKHSLKAKLMEARMESQKVQLRQVLKQKI

SEQ ID NO: 21266 - DNA, 996 bp, Sorghum bicolor
  misc_feature: Ceres ANNOT ID no. 8702998
  misc_feature: Down-regulated in root tissues in response to aminocyclopropane carboxylic treatment
  misc_feature: Encodes the peptide sequence at SEQ ID NO 21267
atgtcctatgctaggtccgcctctggtgctagcggaggtttcggtcgctgtggggggctttcggatttctccgtccccccttttgtttgggttctaaaaatttcagttcctggattggaactgagtctggcttaccaagacatggaaaagttctgctgcttcggcgccggttgctcagatttcacggggcatgggtcaacagcatctggtaaagggaaagtctgtcacgggcaagtcaaggtctcctatggatataaccttgtaagagggatgacgaatcatccaatggaggactatcattttgtcgatcttgttgaggtcaaaggaaacgagcttggtctttttgctatttatgatggtcatctaggagacaccgttcctgcgtatttacagaagaatctatttacaaatattttgaatgaggaagagttttggacacatacagatagagcgattacaaaagcgtatgaaaaaacagaccaggctattctgtcacatactccagatttgggacagggtggctccactgctgtaactgccattcttgtgaatggcaggaagttatgggtagctaatgttggtgattcaagagctgttcttttgaaaggtggtgagcccatacagatgtcaatagaccatgacccgaatgttgagcgaagtgtaattgaaaataggggtggctttgtttcaaatatgccaggagatgttccccgagtatgtggtcagttggctgtctccagagcttttggagacaggaatctaaaatcactattgagatcagagcctgatataaaagtcgaagacatagatcacactgctgagctacttgtccttgcgagtgacggtctttggaaggtgatgaacaatcaagaggttgtcgatttggccaaaaggtacaaggatccctatgctgctgccaagcaactaactgctgaagcgcaaaaaagagagagtaaagatgatatatcgtgcattgttgttcgtttcaaggcgtaa

SEQ ID NO: 21267 - protein, 331 aa, Sorghum bicolor
  misc_feature: Ceres ANNOT ID no. 8702998
  misc_feature: Down-regulated in root tissues in response to aminocyclopropane carboxylic treatment
  misc_feature (115)..(331): SWISSPROT Homolog: EC 3.1.3.16 Phosphoprotein phosphatase
  misc_feature (81)..(322): Pfam ID: PP2C Pfam Description: Protein phosphatase 2C
MSYARSASGASGGFGRCGGLSDFSVPPFVWVLKISVPGLELSLAYQDMEKFCCFGAGCSDFTGHGSTASGKGKVCHGQVKVSYGYNLVRGMTNHPMEDYHFVDLVEVKGNELGLFAIYDGHLGDTVPAYLQKNLFTNILNEEEFWTHTDRAITKAYEKTDQAILSHTPDLGQGGSTAVTAILVNGRKLWVANVGDSRAVLLKGGEPIQMSIDHDPNVERSVIENRGGFVSNMPGDVPRVCGQLAVSRAFGDRNLKSLLRSEPDIKVEDIDHTAELLVLASDGLWKVMNNQEVVDLAKRYKDPYAAAKQLTAEAQKRESKDDISCIVVRFKA

SEQ ID NO: 21268 - DNA, 1038 bp, Sorghum bicolor
  misc_feature: Ceres ANNOT ID no. 8703012
  misc_feature: Up-regulated in root tissues in response to methyl jasmonate treatment
  misc_feature: Down-regulated in root tissues in response to salicylic acid treatment
  misc_feature: Encodes the peptide sequence at SEQ ID NO 21269
atgtcgtcgtctgcgcgcaacacgacgaagctgaagacggcgtgcgtgaccggaggaaatggctacatcggctccgcgctcattaagatgctgctggaggaaggctacgccgtgaagacgacggtcaggaaccccgatgacatggagaagaactcccatctcaagggcttgcaggagcttggaccgctgacggtcctccgcgccgacatggacgaagaaggcagcttggacgacgccgttgccggctgcgattacgccttcctcgttgccgccccggtgaacctctgggcgcaggatccagagaaacagcagatcgagccgtctgtccgaggaacgctgaacgcagtgaggtcgtgcgtgaaggccgggacggtgcggcgcgtgatcctgacctcgtcggcggccggagtctacatcaggccggacctgcaaggcgacgggcacgcgctggacgaggactcctggtccgacgtcgacttcctcagagcaaacaagccgccgacctggggatactgcgtgtcgaaggtgctcctggagaaggcggcgtgcaggttcgcggaggagcacggcatcagcctcgtcaccgtctgccccgtcctcaccgtcggcgccgcgccggcacccaaggtccgcaccagcatcgtcgacagcctctccatgctgtctggcgacgaggccgggctcgccgtgctcagaggcatcgagacgacctccggcgctctgcagctggtccacatcgacgacctctgccgcgccgagctgttcctggcagaggaggcggcggccggcgggaggtacatctgctgcagcctcaacacgaccgtcgtcgagctcgcgcgtttcctggcacacaagtacccgcagtaccgcgtgaagacaaatttcgacgacgatgagcatctcctggagaggccgagagtgatcatgtcgtcggagaagctggtccgggaagggtttgagtacaggcacaacacgctggatgagatatacgacaacgtggtcgagtacggcaaggcattaggaattctgccctactga

SEQ ID NO: 21269 - protein, 345 aa, Sorghum bicolor
  misc_feature: Ceres ANNOT ID no. 8703012
  misc_feature: Up-regulated in root tissues in response to methyl jasmonate treatment
  misc_feature: Down-regulated in root tissues in response to salicylic acid treatment
  misc_feature (9)..(343): SWISSPROT Homolog: EC 1.3.1.77 Anthocyanidin reductase
  misc_feature (14)..(269): Pfam ID: Epimerase Pfam Description: NAD dependent epimerase/dehydratase family
MSSSARNTTKLKTACVTGGNGYIGSALIKMLLEEGYAVKTTVRNPDDMEKNSHLKGLQELGPLTVLRADMDEEGSLDDAVAGCDYAFLVAAPVNLWAQDPEKQQIEPSVRGTLNAVRSCVKAGTVRRVILTSSAAGVYIRPDLQGDGHALDEDSWSDVDFLRANKPPTWGYCVSKVLLEKAACRFAEEHGISLVTVCPVLTVGAAPAPKVRTSIVDSLSMLSGDEAGLAVLRGIETTSGALQLVHIDDLCRAELFLAEEAAAGGRYICCSLNTTVVELARFLAHKYPQYRVKTNFDDDEHLLERPRVIMSSEKLVREGFEYRHNTLDEIYDNVVEYGKALGILPY

SEQ ID NO: 21270 - DNA, 1359 bp, Sorghum bicolor
  misc_feature: Ceres ANNOT ID no. 8703036
  misc_feature: Up-regulated in shoot tissues in response to salicylic acid treatment
  misc_feature: Encodes the peptide sequence at SEQ ID NO 21271
atgggggatcatgctgagatgttgcatgccgctccggccatgtacaacggcgtcggcgccggtgctgctgcccctcatggcgggtggtggaatactacggcggtgcccgcgacgacgtgctcgacggagctggccgggttcacgacgtggtcgtccgccctggctgctagctacgacctggcggccgaggggggaaaggccaagtgcgcggccaccactgcctcgtcggagtcgcccgggaacaacagctccgtgaccttccaagaaccggcaagcgtcacggatcctgctggcgtcggaaccgccgtggtgcagcagcctcttgctggttacactgactggacccatccgagcagtggtgctactactttgcatgggtttctgcaagatggtcaccagcaggacatgagctcaacaactgagcaaagcgccatgacggcatcaagcctgatgaacccttcatccaataacctagccctggccctgcaaggtcaccatcaccaagagcaggaccaccagcagcagatgctgtccagcttcggatccgagctgctcttgtcgccgacctcgccctacgggttccagtcatccctgctaagaagcctcatggagccgacagcaacggcggcggcgaagccgcaggctttgccggggtaccagcagtatgatcagtaccagcagatgggcatgggccaggcgaggtttccaccggccggagctaccagggaggcacttcagttcaccaacgacgcgccgttctggaacccttctgctgctgggttcggcgtggcgccggcgccggcgcctgaccaagctagcagcgttcgttctgtcaaaccatcgccgacggctgcgcgtactacagcaacccttgcattaaagactgcgttggaaggagtaggagagtctgctagctcaatcatcaccaagaagaaggcgaacggcgagccggccttcaagaaatcgaggctcgagacgccgtcgccgttgccaacgttcaaggttaggaaggagaagctaggggacagggtcactgcactccaacaactagtcgccccttttggaaagacggatacggcatcggtgctccatgagaccatcgagtacatcaagttcctccacgaccaagttggtgtccttagtgctccatacttgaagaacaacggccatcatcaagtgccccacttgaagagctcaagtcctgacaagtccaacaaggacgacaacagccatgccggcgaggtatcgctcaagggccgggggttgtgcctggtcccgatatcgagcacgttcgcggtagccagcgaggtgcccgtcgacttcgtgtggagtactccatttgctgccaactttaggtag

SEQ ID NO: 21271 - protein, 452 aa, Sorghum bicolor
  misc_feature: Ceres ANNOT ID no. 8703036
  misc_feature: Up-regulated in shoot tissues in response to salicylic acid treatment
MGDHAEMLHAAPAMYNGVGAGAAAPHGGWWNTTAVPATTCSTELAGFTTWSSALAASYDLAAEGGKAKCAATTASSESPGNNSSVTFQEPASVTDPAGVGTAVVQQPLAGYTDWTHPSSGATTLHGFLQDGHQQDMSSTTEQSAMTASSLMNPSSNNLALALQGHHHQEQDHQQQMLSSFGSELLLSPTSPYGFQSSLLRSLMEPTATAAAKPQALPGYQQYDQYQQMGMGQARFPPAGATREALQFTNDAPFWNPSAAGFGVAPAPAPDQASSVRSVKPSPTAARTTATLALKTALEGVGESASSIITKKKANGEPAFKKSRLETPSPLPTFKVRKEKLGDRVTALQQLVAPFGKTDTASVLHETIEYIKFLHDQVGVLSAPYLKNNGHHQVPHLKSSSPDKSNKDDNSHAGEVSLKGRGLCLVPISSTFAVASEVPVDFVWSTPFAANFR

SEQ ID NO: 21272 - DNA, 660 bp, Sorghum bicolor
  misc_feature: Ceres ANNOT ID no. 8703253
  misc_feature: Up-regulated in root tissues in response to methyl jasmonate treatment
  misc_feature: Up-regulated in shoot tissues in response to methyl jasmonate treatment
  misc_feature: Up-regulated in shoot tissues in response to salicylic acid treatment
  misc_feature: Encodes the peptide sequence at SEQ ID NO 21273
atggatctgttggagcggaacattaagaagggggacacgacggaggaggagaaggcgcgcaaggaagacgagcggaaggaggaggaggaagtcggtgagaggaagacgaagacccaggaccaggagccgcagccgcaaggccaagtcctcagcctctcgctcgccaacggcagcgccaggtctggaatgttgccgatggcgaacccgtcagctaatcctgcacagcttacgattttctatggtggatcagtatgtgtgtatgactcagtgcctccagaaaaggctcaagcaatcatgcttatagctgcagctgcagcggctgcggcagccaccaaaggcagtgctgccactgctgttaagcctcctatgatgcctgcagccactgttgccccagcagcagttgtttctcctgtgcttacaaggtctccatcactgcagagcacttctgtagcaaatgggcaacctcaggttgttgctgaccctagctcaatatgcaaacttcaggctgatctccccattgccaggaggcactctcttcagcgcttccttgagaaacgccgtgacaggatcgtgagcaaagctccctacagccccgccaagtcgtccgacggcatggagtcaccggggatggaggtgactgcggagggcaagacccagtaa

SEQ ID NO: 21273 - protein, 219 aa, Sorghum bicolor
  misc_feature: Ceres ANNOT ID no. 8703253
  misc_feature: Up-regulated in root tissues in response to methyl jasmonate treatment
  misc_feature: Up-regulated in shoot tissues in response to methyl jasmonate treatment
  misc_feature: Up-regulated in shoot tissues in response to salicylic acid treatment
MDLLERNIKKGDTTEEEKARKEDERKEEEEVGERKTKTQDQEPQPQGQVLSLSLANGSARSGMLPMANPSANPAQLTIFYGGSVCVYDSVPPEKAQAIMLIAAAAAAAAATKGSAATAVKPPMMPAATVAPAAVVSPVLTRSPSLQSTSVANGQPQVVADPSSICKLQADLPIARRHSLQRFLEKRRDRIVSKAPYSPAKSSDGMESPGMEVTAEGKTQ

SEQ ID NO: 21274 - DNA, 1446 bp, Sorghum bicolor
  misc_feature: Ceres ANNOT ID no. 8703258
  misc_feature: Up-regulated in shoot tissues in response to methyl jasmonate treatment
  misc_feature: Encodes the peptide sequence at SEQ ID NO 21275
atggcggcgctggaggcggcgaggtcgtgggcgggctccgtcatcccgccggagctcgccgccgccgcgggcggagacccgctcgccgcgctggcggccaccgccgcggccctcgtcgcggggctgcttatcctcgccgtctggttccgatccggaggcggcgcgccgtccaagccggtcgccgcgccggtacgcccgccgccggtcaaggtggacgccgacgccgacgtggacgacggccggaagcgcgtcaccatcttcttcggcacgcagaccggcaccgccgagggattcgccaagtccatggcggaggaagcgagggcgcggtacgagaaggccgtgttcaaagtggtggatctggatgactatgctcaggaggacgaggaatacgaggagaagctgaagaaggaaaccgtggtgctgttcttcttagcaacatatggggacggagagccaactgataacgcagcaagattctacaaatggtttactgagggaaaagagaaggaagtttggctgaaggctcttaaatatggtatttttggccttggaaacaggcagtacgaacattttaataaggttgcaaaggtggttgatgagctactagaggagcagggtgggaaacgtcttgttcctgttggccttggagatgatgatcagtgtattgaggatgatttcactgcatggaaagaactagtgtggccagagttagatcaattgctccgcgacgaggatgacacaactggcgcatcgactccatatactgctgctattcctgaatacagagttgttttcattgataaatctgacctgtcattccaagatagatcatggacactagccaacggtactggtgtgattgatattcaacacccttgcagggctaatgttgctgttcggaaggagctgcacaaaccagcttcagatcgctcttgtatccatcttgagttcgacatttctggcactggtcttgtgtatgaaaccggagatcatgttggtgtatatgcagaaaattctgttgagactgtggaggaggctgaaaggctacttgacctttctccagatacgttcttctccatccatgcagatgcagaagatggatctcctcgtaaaggaggaggttccttggccccacctttcccatctccatgtaccttgcggactgcgcttctacgatacgctgatctactcaatccaccgaagaaggctgctttgcttgctttagcttctcatgcatctgatccagctgaagctgaacgacttagattcttggcttctcccgctggaaaggatgagtactctcaatggataactgctagtcagaggagccttattgaagttatggctgcattcccttcagctaagccaccactgggagtgttttttgcagcaatagctcctcgtctgcaaccacgatactactcaatttcatcatctccaatgtaa

SEQ ID NO: 21275 - protein, 481 aa, Sorghum bicolor
  misc_feature: Ceres ANNOT ID no. 8703258
  misc_feature: Up-regulated in shoot tissues in response to methyl jasmonate treatment
  misc_feature (85)..(480): SWISSPROT Homolog: EC 1.6.2.4 NADPH--hemoprotein reductase
  misc_feature (285)..(480): Pfam ID: FAD_binding_1 Pfam Description: FAD binding domain
  misc_feature (86)..(229): Pfam ID: Flavodoxin_1 Pfam Description: Flavodoxin
MAALEAARSWAGSVIPPELAAAAGGDPLAALAATAAALVAGLLILAVWFRSGGGAPSKPVAAPVRPPPVKVDADADVDDGRKRVTIFFGTQTGTAEGFAKSMAEEARARYEKAVFKVVDLDDYAQEDEEYEEKLKKETVVLFFLATYGDGEPTDNAARFYKWFTEGKEKEVWLKALKYGIFGLGNRQYEHFNKVAKVVDELLEEQGGKRLVPVGLGDDDQCIEDDFTAWKELVWPELDQLLRDEDDTTGASTPYTAAIPEYRVVFIDKSDLSFQDRSWTLANGTGVIDIQHPCRANVAVRKELHKPASDRSCIHLEFDISGTGLVYETGDHVGVYAENSVETVEEAERLLDLSPDTFFSIHADAEDGSPRKGGGSLAPPFPSPCTLRTALLRYADLLNPPKKAALLALASHASDPAEAERLRFLASPAGKDEYSQWITASQRSLIEVMAAFPSAKPPLGVFFAAIAPRLQPRYYSISSSPM

SEQ ID NO: 21276 - DNA, 1521 bp, Sorghum bicolor
  misc_feature: Ceres ANNOT ID no. 8703591
  misc_feature: Up-regulated in shoot tissues in response to methyl jasmonate treatment
  misc_feature: Up-regulated in shoot tissues in response to salicylic acid treatment
  misc_feature: Up-regulated in root tissues in response to salicylic acid treatment
  misc_feature: Encodes the peptide sequence at SEQ ID NO 21277
atggtggcgtcggccaagggacggctcgtgtccgtgctcgcggtggcggcggcgctcgcggccgtgctcctctaccgcgcccccttctccaagagcttgggcggcgaagggtgcagcctcctcccgcacgaccacttctgggtcgccagcgaccgcgtcgtcacgctcggccgcgtcggccccgccgcagtggaggtcaaaggagggctcatcaacgccatcgcggtcggggactaccggagcttcgtgctccgccgtcctctcctggactacggggacgccgtcatcatgcccggcctcatcgacgtgcatgcccatctcgacgagcctggacgtgccgagtgggagggcttctctactggtacaagagcagctgcggcaggcgggataacgacgttggtggatatgccactcaacagcttcccgtcgacagtctctgaagaaactctcaaactgaagctggaagcagctcaagataagctatatgttgatgttgggttctggggaggacttgtgccagagaacgccttcaacccaagtgctttggagggcctcctaaatgcaggcgttttaggactcaagtcttttatgtgcccctcaggcatcaacgacttccccatgacaaattcaactcatattgaggaaggattggttacactggcaaaatacaagagacctttacttatccatgcagaacgtatacctgaggctgaggatgatgatatgcgagaggatgaactagatcctcgatcctatatgacgtatctaaagtctagaccaccatcatgggaggaatcagctatcagagatctacaccgtgcaatgaaggatacggagtcggggggtcggtccgaaggagctcatattcacattgttcatctatcagatgcaaaaacttccttggaacttatgaaggatgctaaacgcagtggtgcaagtttatcaatagaaacatgccctcattacctggcattttcatctgaagaagttccagatggcgatactcgctttaaatgttctcctcccatacgtgatgacacaaacagagaaaatctttggaaagctctacttgatggacacatagacatgctaagttcagaccactcaccatcaactcctgatctcaaactaatggaggaaggcaactttttaagggcatggggaggcatatcatcattgcagtttgtcctcccggtaacatggtcatatgggcgaaagtacggcattactctgaatcagctatcctcatggtggagcgaaaatccagccaagcttgcaggccaaaagaacaagggagctattctaccaggataccatgctgacatagtagtatggaaacccgaaactgagttccaactcgatgacagccatgttatatatcataaacatcagaatatttcggcgtatctaggaaagcaactttctggtaaggtcctgtcaacttttgtgagaggaaaccttgtgtttgctgaagacaagcatgcaaatgttgcttgtggtgttcctatcctcgctaagtaa

SEQ ID NO: 21277 - protein, 506 aa, Sorghum bicolor
  misc_feature: Ceres ANNOT ID no. 8703591
  misc_feature: Up-regulated in shoot tissues in response to methyl jasmonate treatment
  misc_feature: Up-regulated in shoot tissues in response to salicylic acid treatment
  misc_feature: Up-regulated in root tissues in response to salicylic acid treatment
  misc_feature (48)..(503): SWISSPROT Homolog: EC 3.5.2.5 Allantoinase
  misc_feature (95)..(446): Pfam ID: Amidohydro_1 Pfam Description: Amidohydrolase family
MVASAKGRLVSVLAVAAALAAVLLYRAPFSKSLGGEGCSLLPHDHFWVASDRVVTLGRVGPAAVEVKGGLINAIAVGDYRSFVLRRPLLDYGDAVIMPGLIDVHAHLDEPGRAEWEGFSTGTRAAAAGGITTLVDMPLNSFPSTVSEETLKLKLEAAQDKLYVDVGFWGGLVPENAFNPSALEGLLNAGVLGLKSFMCPSGINDFPMTNSTHIEEGLVTLAKYKRPLLIHAERIPEAEDDDMREDELDPRSYMTYLKSRPPSWEESAIRDLHRAMKDTESGGRSEGAHIHIVHLSDAKTSLELMKDAKRSGASLSIETCPHYLAFSSEEVPDGDTRFKCSPPIRDDTNRENLWKALLDGHIDMLSSDHSPSTPDLKLMEEGNFLRAWGGISSLQFVLPVTWSYGRKYGITLNQLSSWWSENPAKLAGQKNKGAILPGYHADIVVWKPETEFQLDDSHVIYHKHQNISAYLGKQLSGKVLSTFVRGNLVFAEDKHANVACGVPILAK

SEQ ID NO: 21278 - DNA, 1158 bp, Sorghum bicolor
  misc_feature: Ceres ANNOT ID no. 8703572
  misc_feature: Down-regulated in shoot tissues in response to methyl jasmonate treatment
  misc_feature: Down-regulated in shoot tissues in response to salicylic acid treatment
  misc_feature: Encodes the peptide sequence at SEQ ID NO 21279
atggcccttcaggcggcgctcctcccttccactctctccgtccccaagaagggcagcctcgccgccgcggtgaaggacacggcattcctcagcgtcccccagaagaagctgcaggcggcgtcgctgtcggtgaggacgcaggtggcgacggcgcctgtggccacgccggggtcgagcacggcgaccaaggacgggaagaagacggtgcggcagggcgtggtggtgatcacgggcgcgtcgtcgggtctgggccttgcggcggccaaggcgctggcggagaccggcaagtggcacgtggtgatggcctgccgcgacttcctcaagacggcgaaggcggccaagggcgccggcatggcggacggcagctacaccatcatgcacctggacctggcctccctcgacagcgtgcggcagttcgtcgacaacttccgccgtgccgggatgccgctcgactcgctcgtctgcaacgccgccatctaccggcccacggcgcggacgccgacgttcacggcggacgggtacgagatgagcgtcggcgtcaaccacctgggccacttcctcctggcgcgcctgctcctcgacgacctgcagaggtccgactacccgtcccgccgcctcatcatcctcggttccatcaccggcaacaccaacacgctggccgggaacatcccgcccaaggccgggctgggcgacctccgcggcctcgcgggcgggctgcgcggccagaacggttccgccatgatcgacggctccgagagcttcgacggcgccaaggcgtacaaggacagcaagatctgcaacatgctcacgatgcaggagctgcaccggcggtaccacgaggacacgggcatcacgttcgcgtcgctctacccgggctgcatcgccaccacggggctgttccgcgagcacatcccgctcttccggctgctcttcccgccgttccagaagttcatcaccaaggggttcgtgtcggaggcggagtccggcaagaggctggcgcaggtcgtcagcgaccccagcctcaccaagtcgggggtgtactggagctggaacaaggactcggcgtcgttcgagaaccagctgtcgcaggaggccagcgacccggagaaggccaggaagctctgggagatcagcgagaagctcgtcgggcttgcctga

SEQ ID NO: 21279 - protein, 385 aa, Sorghum bicolor
  misc_feature: Ceres ANNOT ID no. 8703572
  misc_feature: Down-regulated in shoot tissues in response to methyl jasmonate treatment
  misc_feature: Down-regulated in shoot tissues in response to salicylic acid treatment
  misc_feature (1)..(385): SWISSPROT Homolog: EC 1.3.1.33 Protochlorophyllide reductase
  misc_feature (72)..(244): Pfam ID: adh_short Pfam Description: short chain dehydrogenase
MALQAALLPSTLSVPKKGSLAAAVKDTAFLSVPQKKLQAASLSVRTQVATAPVATPGSSTATKDGKKTVRQGVVVITGASSGLGLAAAKALAETGKWHVVMACRDFLKTAKAAKGAGMADGSYTIMHLDLASLDSVRQFVDNFRRAGMPLDSLVCNAAIYRPTARTPTFTADGYEMSVGVNHLGHFLLARLLLDDLQRSDYPSRRLIILGSITGNTNTLAGNIPPKAGLGDLRGLAGGLRGQNGSAMIDGSESFDGAKAYKDSKICNMLTMQELHRRYHEDTGITFASLYPGCIATTGLFREHIPLFRLLFPPFQKFITKGFVSEAESGKRLAQVVSDPSLTKSGVYWSWNKDSASFENQLSQEASDPEKARKLWEISEKLVGLA

SEQ ID NO: 21280 - DNA, 2118 bp, Sorghum bicolor
  misc_feature: Ceres ANNOT ID no. 8703594
  misc_feature: Up-regulated in root tissues in response to methyl jasmonate treatment
  misc_feature: Up-regulated in shoot tissues in response to methyl jasmonate treatment
  misc_feature: Up-regulated in shoot tissues in response to salicylic acid treatment
  misc_feature: Down-regulated in root tissues in response to aminocyclopropane carboxylic treatment
  misc_feature: Encodes the peptide sequence at SEQ ID NO 21281
atgggagggcccctcggcgcgatcatcggccgctacccgtcggcggccggcggcgacgagcagctgggaggcggcgccagcggcggcattatacgccacgaccgcaggtgccgcgacatcgccttcctcgtgctcttcgccgccttctgggtcgccatgattgtcaactccagcttcggcttcaaccagggcaacccgctcaggctgacttatgaactggactacaaagggaacatctgtggcgacaagcatggcagcccaaatttgcaggagctggatgttagatactggatgaatccgaaccaagtctaccaaagtggactcaaggacagcaaggttaacctggctgatgccaaagccatctgcctgatggagtgcccaaatccagctgtagatggattgaactttatttgtgattatccagaaggggacatccacctctctgttgatgactggatcaatagggactatgactattttgagtttctcacaccagacatgaggaatagctcacttcaactccagggtccatgctaccctatcatattcccaactgttaatgtctattggagctgccaatttattgcacgagcatccaatgtctctttgaagcactggcatgagatgggtggtgtcagcattgatgaaaatatcctcattgataaaacagtgcacaaggccattgattctagatctgctgtattaaagagatatattgcagacattgggaagtcctggcctgtgttcatcgtttgtggtggaatcctccctgttttcctgtcagtgatctggttgcttatgattcgttatttcgttgctgctatgacttggataacagtagtcctcttcaatgcccttgttatatctgtaacgatgttcttttacatcaaagctggctggataggcaatgaccccttaactgttgtcattggtgaaagtgacccatatgttcacataagtgggcgggaaataagtcaccttcatactgttacaatcctaatgacagcagtaatgatcattgctttcctatcctcaatagctattgtccgccgtatactgatagcaacacctgtcttaaaggttgctgcaaaggtcattggtgaagttcaggcactgatagcttttccacttttgccgtggctgatcctttccatcttttatatgttctggttttctgctacactccatctcttcagctctggtcaagttgtccgaaatgattgcaatactgattgttgttcgtatgatctgaagctggggaaagtaaattgtgacaactgttgtgggtacaacatccattacacccctcatatcagcattgccattctattccacttgtttggttgctactgggcgactcaattcattctcgcatgctcttcaactgtggttgcgggatcagttgcttcgtactactgggcacgtggtgaaatatcacatgatataccatttcttactgtagtctcttcactgaagcgactgatgcgctacagccttggatctgttgctctgggttcacttcttgtatctgtcgttgagtgggtgcggtttatactagaatgcctccgtcgcaagttgaagctagttgattctgctcgagaaagctgctttggaaaagcgacgtcttcctcttctgaatgctgcctgggttgcatagactggactctaaagtcagtaaatcgaaatgcctacattatgattgccattactgggaaaggtttcttcaaagcttcagtgctcgcaactggattaataatgaagaacattctgcgcattggaaaagtcaatgtcattggggatgttatcctcttcctgggaaaactgtgtgtgagcctattctgtgcgctttttgcctttctgatgttagacacccacaagtacaagtctgcacacaacaagatatcatctccagttatccctgtcctggtaacatgggccctcggctatatagtcgcgaagcttttctttgcggtggttgagatgtcgatcgacaccataatcctctcgttctgccaggacgccgaagagcaccaggggaatgcacagtatgcgccccctgctttgatggaaactctggatgaacagggcgaactgcagagactaactcaagggccttga

SEQ ID NO: 21281 - protein, 705 aa, Sorghum bicolor
  misc_feature: Ceres ANNOT ID no. 8703594
  misc_feature: Up-regulated in root tissues in response to methyl jasmonate treatment
  misc_feature: Up-regulated in shoot tissues in response to methyl jasmonate treatment
  misc_feature: Up-regulated in shoot tissues in response to salicylic acid treatment
  misc_feature: Down-regulated in root tissues in response to aminocyclopropane carboxylic treatment
MGGPLGAIIGRYPSAAGGDEQLGGGASGGIIRHDRRCRDIAFLVLFAAFWVAMIVNSSFGFNQGNPLRLTYELDYKGNICGDKHGSPNLQELDVRYWMNPNQVYQSGLKDSKVNLADAKAICLMECPNPAVDGLNFICDYPEGDIHLSVDDWINRDYDYFEFLTPDMRNSSLQLQGPCYPIIFPTVNVYWSCQFIARASNVSLKHWHEMGGVSIDENILIDKTVHKAIDSRSAVLKRYIADIGKSWPVFIVCGGILPVFLSVIWLLMIRYFVAAMTWITVVLFNALVISVTMFFYIKAGWIGNDPLTVVIGESDPYVHISGREISHLHTVTILMTAVMIIAFLSSIAIVRRILIATPVLKVAAKVIGEVQALIAFPLLPWLILSIFYMFWFSATLHLFSSGQVVRNDCNTDCCSYDLKLGKVNCDNCCGYNIHYTPHISIAILFHLFGCYWATQFILACSSTVVAGSVASYYWARGEISHDIPFLTVVSSLKRLMRYSLGSVALGSLLVSVVEWVRFILECLRRKLKLVDSARESCFGKATSSSSECCLGCIDWTLKSVNRNAYIMIAITGKGFFKASVLATGLIMKNILRIGKVNVIGDVILFLGKLCVSLFCALFAFLMLDTHKYKSAHNKISSPVIPVLVTWALGYIVAKLFFAVVEMSIDTIILSFCQDAEEHQGNAQYAPPALMETLDEQGELQRLTQGP

SEQ ID NO: 21282 - DNA, 1044 bp, Sorghum bicolor
  misc_feature: Ceres ANNOT ID no. 8703701
  misc_feature: Up-regulated in shoot tissues in response to salicylic acid treatment
  misc_feature: Encodes the peptide sequence at SEQ ID NO 21283
atgatgagcggcagccgtgtattattcgtcgtggccgccgccgtgggcgtgctgctcgccgccgctgccgtctcctcgaggcccgtcgtcgtgcctctggctactggccgccctggtgccggcggtaacgacgagctgtcggtgtacttccacgtggagtcgtgcccgcagctggagacgatcgtgcggtccgccgtggacgcggcgctccagcagaacgtgcggctgacggcggggctcctccgtgtgttcttccacgactgcttcccgcagggttgcgacgcgtcgatcctgctggacaacggcgagcgcggcctcccgcccaacgtcggtctgcagcaggaggccgtgcagctggtggaggacatccgcgccaaggtgcacgcggcgtgcgggcccacggtgtcgtgcgccgacatcaccgtgctggccacccgcgacgccgtgagcctgtccggcgggccctccttcacggtgccgctggggcggctcgacagcgtggcgccggcgtccagcaacgacgtgttcacgctgccgccgccgacgtcgaccgtggacgcgctgctgtcggcgttcgccagcaagaacctgtcggacccggcggacctggtggcgctgtcgggcgcgcacacggtggggaaggcgcggtgcagctcgttcggcgacgtggcggggccggccaccgacgacatcacccggtgcgtgacggccacgtgctccgcggccggcgccggcgacacgctgcgggatctggacttcctgacgccggcggtgttcgacaacctctacttcatcgagctgacgctgaagaagaacaagggggtgatgctgccgtcggaccagggcctggccacggacccgcgcaccagctggctcgtccagggcttcgccgacaaccactggtggttcttcgaccagttcgggacctccatggtcaagatgagccagctcaagggaccgcaggggaacgtcggcgagatccgccggaactgcttacgcccaaacaccaacagcgatgtcgatatcgccgccgccactgcttga

SEQ ID NO: 21283 - protein, 347 aa, Sorghum bicolor
  misc_feature: Ceres ANNOT ID no. 8703701
  misc_feature: Up-regulated in shoot tissues in response to salicylic acid treatment
  misc_feature (46)..(342): SWISSPROT Homolog: EC 1.11.1.7 Peroxidase
  misc_feature (62)..(299): Pfam ID: peroxidase Pfam Description: Peroxidase
MMSGSRVLFVVAAAVGVLLAAAAVSSRPVVVPLATGRPGAGGNDELSVYFHVESCPQLETIVRSAVDAALQQNVRLTAGLLRVFFHDCFPQGCDASILLDNGERGLPPNVGLQQEAVQLVEDIRAKVHAACGPTVSCADITVLATRDAVSLSGGPSFTVPLGRLDSVAPASSNDVFTLPPPTSTVDALLSAFASKNLSDPADLVALSGAHTVGKARCSSFGDVAGPATDDITRCVTATCSAAGAGDTLRDLDFLTPAVFDNLYFIELTLKKNKGVMLPSDQGLATDPRTSWLVQGFADNHWWFFDQFGTSMVKMSQLKGPQGNVGEIRRNCLRPNTNSDVDIAAATA

SEQ ID NO: 21284 - DNA, 2595 bp, Sorghum bicolor
  misc_feature: Ceres ANNOT ID no. 8703706
  misc_feature: Up-regulated in shoot tissues in response to methyl jasmonate treatment
  misc_feature: Up-regulated in root tissues in response to methyl jasmonate treatment
  misc_feature: Up-regulated in shoot tissues in response to salicylic acid treatment
  misc_feature: Encodes the peptide sequence at SEQ ID NO 21285
atgccggcgctgctgcccttccgccgccggtcctccccgattcccctgctactgcttttatcgctcttcgcctcctccccactcttcttctccccgagccccgcagcaaccgccgtcggagattgccctctggattttagctgggcaaacttcacactagctgcggccgcctgctctgatccgtcccagcgggcgacgtgctgccgctacatcaatgcgttcgttgccatctccattgctcgctacgccaacgcaactggtaggctgggggtccctcctgcctttgcagagatctgtctcagctccgtgtccgagacgttcaagctgcgggggatccccactgatgccgatgtcttctgcgggctgggacccaagatacgggtttcgtatcagtgcgctgggcgggataccgtgctggagatgatgcagtccccgaatttcaacgatgttatcgggagctgcaggggccctctgtcgctggatatcacctgcaagacttgcttgaattatggcatcgtgtacctccatcgcctcatcggttcagacgataatgttggcctgagcgtgtgccgcaacgcggtttttgtaacgcttgcgactcaagagggtattctttcatacgaagatatcgtcaagtgcttctttggtgtgcagggaatcaccacatttccagtggtactgattcgtagaaagagcagggaattgaagaatgctgaatttccttctcggaatccagataacacatttcactacaatcaatcctggagatgccctgaaggccaatcaccaatgttccaaaggtatagctacaaagaaacaatgaaagcaacggataacttcagcacagtcattggaaagggaggttttggaactgtctgtaaagctcaatttagtgatggctctatagttgcggtgaaaaggatggacaaggtttcaaagcaagctgaagaagagttctgtagggaaatggaactcttggctaggttgcatcatcgccatctcgtgaccctcaagggcttctgtatcgaaaagaaagaaagagacatcaaatcgagcaacattcttttagatgagcattttgttgcaaaggttgctgattttggccttgcacatgcatcaagaactggagctatcagctttgaagcagtgaacacggatatacgaggaaccccagggtacatggaccctgaatatgtggttactcaagagttgacagagaagagtgatatatacagctacggtgtgcttcttctggagcttatgcatctcgtggtcggcatcgtgcaatggtgcacccagagagaagggcggcagaggccctccatcaggcaggttctgaggatgctctcggagaggctggacccggggaatggcagctttggcgagggcatggaagacgcagaggggggcttttatccccggagcagcaaatgtggcgcccatcagcggaacgagctggtcccctacagcggtgacatgaggtctctgcattcctcatcgagcacgaccagatcttactgcagccgcagcatgctgcttgagagtggaactagcttgtgtgatgtaaaggcaggcaggcaggcaagcaggatgcctcacgccaagacggactcggaggtgacgagcctggcgccgtcgtcgccgccgcggtcgccgccacggacccgcggggccgtgtactacgtgcagagcccgtcccgggactcccacgacggcgagacgaagacggccacctccgtgcactccaccccggcgctgagccccatggcgtcgccgcggcactcgcactcgtccgtgggcagggactcctcctccagccgcttctcggggcacggccaccacaagcgcaaggccgacaagggacaccaccacggcagcagcaacaagggcgcgccgggcggcaaggggtggcaggagatcggcgtcatcgaggaggaggggttcctggacgacgaggaggagcacacccgcatcgtgccccgcaagtgctactacttcctcgtcttcgtcctcggcttcgtcgcgctcttctccttcttcgcgctcgtgctgtggggcgccagcaggtcgcagaagccccacgtcgtgatgaagagcatccggttcgacaacttcatcatccaggccggcaccgacgcgtcgctcgtccccaccgacatggccaccaccaactccaccgtcaagttcacctaccgcaacaagggaaccttcttcggaatccatgtcaccgccgaccccttccagctctcctacagccagctaacgctcgcatccggagacctcaacaagttctaccaggctcgcagcagcagccgcacggtcagcgtctccgtggtcggcaacaaggtgccgctgtacggcggcggcccgacgctgacggcggcgccggcggccggcggcaagggggcgcaggcgaccaccaccacggtggcgtcggtgcccatggtgctgaggacgacgctgcactcgcgggcctacgtgctgggcgcgctggtgaagcccaagttcaccctcgccgtcgagtgcagagtggtcatgaaccccagcaagcagaacaagccaatctccctcgagaaggcctgccactactcataa

SEQ ID NO: 21285 - protein, 864 aa, Sorghum bicolor
  misc_feature: Ceres ANNOT ID no. 8703706
  misc_feature: Up-regulated in shoot tissues in response to methyl jasmonate treatment
  misc_feature: Up-regulated in root tissues in response to methyl jasmonate treatment
  misc_feature: Up-regulated in shoot tissues in response to salicylic acid treatment
  misc_feature (332)..(421): SWISSPROT Homolog: EC 2.7.11.1 Non-specific serine/threonine protein kinase
  misc_feature (280)..(341): SWISSPROT Homolog: EC 2.7.10.1 Receptor protein-tyrosine kinase
  misc_feature (279)..(449): Pfam ID: Pkinase_Tyr Pfam Description: Protein tyrosine kinase
  misc_feature (685)..(842): Pfam ID: Hin1 Pfam Description: Harpin-induced protein 1 (Hin1)
MPALLPFRRRSSPIPLLLLLSLFASSPLFFSPSPAATAVGDCPLDFSWANFTLAAAACSDPSQRATCCRYINAFVAISIARYANATGRLGVPPAFAEICLSSVSETFKLRGIPTDADVFCGLGPKIRVSYQCAGRDTVLEMMQSPNFNDVIGSCRGPLSLDITCKTCLNYGIVYLHRLIGSDDNVGLSVCRNAVFVTLATQEGILSYEDIVKCFFGVQGITTFPVVLIRRKSRELKNAEFPSRNPDNTFHYNQSWRCPEGQSPMFQRYSYKETMKATDNFSTVIGKGGFGTVCKAQFSDGSIVAVKRMDKVSKQAEEEFCREMELLARLHHRHLVTLKGFCIEKKERDIKSSNILLDEHFVAKVADFGLAHASRTGAISFEAVNTDIRGTPGYMDPEYVVTQELTEKSDIYSYGVLLLELMHLVVGIVQWCTQREGRQRPSIRQVLRMLSERLDPGNGSFGEGMEDAEGGFYPRSSKCGAHQRNELVPYSGDMRSLHSSSSTTRSYCSRSMLLESGTSLCDVKAGRQASRMPHAKTDSEVTSLAPSSPPRSPPRTRGAVYYVQSPSRDSHDGETKTATSVHSTPALSPMASPRHSHSSVGRDSSSSRFSGHGHHKRKADKGHHHGSSNKGAPGGKGWQEIGVIEEEGFLDDEEEHTRIVPRKCYYFLVFVLGFVALFSFFALVLWGASRSQKPHVVMKSIRFDNFIIQAGTDASLVPTDMATTNSTVKFTYRNKGTFFGIHVTADPFQLSYSQLTLASGDLNKFYQARSSSRTVSVSVVGNKVPLYGGGPTLTAAPAAGGKGAQATTTTVASVPMVLRTTLHSRAYVLGALVKPKFTLAVECRVVMNPSKQNKPISLEKACHYS

SEQ ID NO: 21286 - DNA, 1677 bp, Sorghum bicolor
  misc_feature: Ceres ANNOT ID no. 8703834
  misc_feature: Up-regulated in root tissues in response to methyl jasmonate treatment
  misc_feature: Up-regulated in shoot tissues in response to methyl jasmonate treatment
  misc_feature: Up-regulated in root tissues in response to salicylic acid treatment
  misc_feature: Up-regulated in shoot tissues in response to salicylic acid treatment
  misc_feature: Encodes the peptide sequence at SEQ ID NO 21287
atgtgtcacctgctggatttggcacaccaactctcgcacccgacctcctcttctcccttagtcgtcgttctagcaaaatggctactattgctcgtcgttcctctcctgctcctgctgcactactacacctcccggcggtcaagccgccgtcatggcagcgatgacgacaagcagctgcttccgccgtcgcctcccgggctgccaatcatcggccaccttcacctcgtcggagaactccctcacgtctccctccgcgacctcgccacaaagcatgccggcggcggcctgatgctcctccgccttggctctgtccccaccctcgtcgtgacatctccgccggctgcggaggcgatcatgcgcacgcacgaccacgtgtttgcgtcgcggcccacgtccactgtcagcgacgacctcctgtacgggtcctctgacatcgccttctccccctacggcgagcactggcggcaggccagaaagcttgtcaccacgcacctcttgaccgtcaagaaggtgaactcatattgccgttcccgcaaagaagaggtgagcttggtgatggacaagataagagaggcagcgaccgcgggcacggccgtggacatgagcacgatgatgaacacgttcgccaacgacatcgtgagccgcgccgtgtcgggcaagttcttccgagcagaaggccggaacaagctcttccgagagctggtggaggccaacacttctttgtttggagggttcaacctagaagactacttcccagtgctggcgaggtcgttaggtttccttagcagaaggtttctgctcaacagggcacaggagacgcacaagagatgggacgagctgcttgaaaccatactgagcgaccacgagagaagaaactcctctctgcgtcgccatgacggaggtgacttcactgatctgttgctctcggtccagaaagagtatggtatgactagaaatcatgtcaaagccatcctgatggacatgtttgctgcaggcacagacacgtcatccttggtcctggagttcgccatggctgagctgatgcgcaacccacagcagatggccaagctacaaggagaagtccggaagcacacaccagaggggcagaaaatggtggaggaagaggacctagccagcatgccctacctgagagctgtcgtgaaggagacgctgaggttgcgcgctcctgtcccgctgctcgtccctcacctctccatggcggactgcatcgtcaatggctaccatgtcccctctggcactcgggtcattgtcaacgcatgggcgcttggcagagacccagagtcatgggagaagccggaggagttcatgccggagaggttcgtcgacggtggcagcgctgctgccggcgtcgacttcaaagggaaccacttccagttcctgccgtttggagctggacgaaggatctgccctggcctcaactttgggattgctactgttgagatcatgctggcaaacctcatgtactgctttgactggcagctccccatgggcatggaggagaaggatgttgacatgacagaggtgtttggaatcacggtgcatcttaaggagaggctcatgcttgttcccagccttccttgtgctgatgcacctggaactggtcgtcagtcgtcactgctccatgcaagctcgtcgcgcacaaatgatttggagtaa

SEQ ID NO: 21287 - protein, 558 aa, Sorghum bicolor
  misc_feature: Ceres ANNOT ID no. 8703834
  misc_feature: Up-regulated in root tissues in response to methyl jasmonate treatment
  misc_feature: Up-regulated in shoot tissues in response to methyl jasmonate treatment
  misc_feature: Up-regulated in root tissues in response to salicylic acid treatment
  misc_feature: Up-regulated in shoot tissues in response to salicylic acid treatment
  misc_feature (74)..(531): SWISSPROT Homolog: EC 1.14.13.68 4-hydroxyphenylacetaldehyde oxime monooxygenase
  misc_feature (61)..(529): Pfam ID: p450 Pfam Description: Cytochrome P450
MCHLLDLAHQLSHPTSSSPLVVVLAKWLLLLVVPLLLLLHYYTSRRSSRRHGSDDDKQLLPPSPPGLPIIGHLHLVGELPHVSLRDLATKHAGGGLMLLRLGSVPTLVVTSPPAAEAIMRTHDHVFASRPTSTVSDDLLYGSSDIAFSPYGEHWRQARKLVTTHLLTVKKVNSYCRSRKEEVSLVMDKIREAATAGTAVDMSTMMNTFANDIVSRAVSGKFFRAEGRNKLFRELVEANTSLFGGFNLEDYFPVLARSLGFLSRRFLLNRAQETHKRWDELLETILSDHERRNSSLRRHDGGDFTDLLLSVQKEYGMTRNHVKAILMDMFAAGTDTSSLVLEFAMAELMRNPQQMAKLQGEVRKHTPEGQKMVEEEDLASMPYLRAVVKETLRLRAPVPLLVPHLSMADCIVNGYHVPSGTRVIVNAWALGRDPESWEKPEEFMPERFVDGGSAAAGVDFKGNHFQFLPFGAGRRICPGLNFGIATVEIMLANLMYCFDWQLPMGMEEKDVDMTEVFGITVHLKERLMLVPSLPCADAPGTGRQSSLLHASSSRTNDLE

SEQ ID NO: 21288 - DNA, 5070 bp, Sorghum bicolor
  misc_feature: Ceres ANNOT ID no. 8703852
  misc_feature: Up-regulated in shoot tissues in response to methyl jasmonate treatment
  misc_feature: Down-regulated in shoot tissues in response to aminocyclopropane carboxylic treatment
  misc_feature: Up-regulated in root tissues in response to methyl jasmonate treatment
  misc_feature: Up-regulated in root tissues in response to salicylic acid treatment
  misc_feature: Up-regulated in shoot tissues in response to salicylic acid treatment
  misc_feature: Encodes the peptide sequence at SEQ ID NO 21289
atgtatggagcccccatcctcatccttttccttttgcctgacacgaacagggaggatgcaccagaggctaatggttaccatcgcagtcattgtttcaaaaaagaccatcacagtccccatggtgcggagcagagtcaggctgcggatgccgataataagcatataaatcatctctccacagacgacaatgctccctccagcgcttcaggccacagacatggtcgcattagccgccatgcatccacgtcttctgttgatgaccgttctatcaagtccggtgacgattctgatggggctgagagtaccaatggcagaagcagtaatacagagatctcatttctagaaaatgataccatctggataccacctcaagcggcagataaggaggatgaggcccagagttttgctacaagcatcgcttatgatgacgacgacgacgattatagtgacgggataaagtggggccagtcaagtttcccatcccctggtaagcagcatgacaccggcactagcaatcatagggaggaacgagaaaaggcgatgctagaagctatgaatggccagctgaagatacttgtcagtcggtttctcgcatctgctggcattccttcttcgaacgaagagggtagcgatagctggcttgaaattgtcacctccctgtcatgggaagccgcactacttatcaaaccagatggtagcatgggaaaggaaatggaccctggctcttacatcaaagtcaaatgtgtagcatctggtactcgccggcaaagtgaggtgatcaaggggttagtcttcaagaagaacactgctcataagcacatgccaacaaattgccacaatcctaggcttctacttctcaaaggagtccttgggcattctgatgtcggtttgtcatcatttagttcaatggatcaggaaaaggacctgttggagagagctattggtaaaatgatggagatatgcagtcccaatgttgttctggtcgagaaaactgtttcacgaaacattcaagaacttcttctgaaagaaggtgtcactctaattcttgatatgaaactcaaccggctagagagaattgcacgctgtacaggctctcccataatatcgttttccgaagttttggataaaccgaagctgaagcaatgtgactactttcatatcgaaaaatttatcgaggagcacaacaacgccagtgagggtggaaagaggccatctaaaacattaatgttcttggaaggctttccacgtccacttggttgcacgatactgctaaaaggagcaaacagtgaagaattgaagaaagtcaaacaagtaatgcattttacggtctttgcagcatatcacttgatccttgaaacatctttctttgaagatcaaagggtttttctaaatgataaaagtaccccgaaagaaacttctgttactgctacagaagggacatcaccaactgcttatgatgttgctgctcttagtggtgctatccctagctttccttcacatgatgactctccagcacttagactgttccatgccacttctaatagctatgctgatgtgaacaaacctacatctccaagaaatatggattcattcagttcagtatccagcagctctgcaaatgaccttgaacaaggtgcaagtatcaggctcaataatactgagaggttaacattaccagtccaagggccactaaggaaattgtttgctgacatgttaagtcaccagaatatttacttacctgttacatcattgcaagaggcaaatgataataggaaggaagtcagggctgaatccggtcaagagactgttagtaatggtttccataggccaaagatagaagagcctgtggtttccattgaaaatggggagtccataaatgatgcccagaaacaagaaattactagagcaataatgccgggaagttcttctgtaagtgataaaagtggagaatcacctgttatggaagacaatgaggcacatacaacaagtatcgttatcaaagagaaatatgtcgacgacgatcaagctgatgatgcacttgattctcacagcatactgattttgatgtctagccagtgcacggaaaagcaggttatctgtgaacaaagccatttaacccgtataaaatactatgggagttttgatgtgtccttggggcgatatttgcaagacattctgcagaatcagaaactgagttgctcctcatgtggagagcctccagagtcccacatgtactcctacacgcaccgaaatggaaatttgaccgttttagtgaaacgtctggtgccccaacaccatttgcctggtgaatctgaaggaaaaatatggatgtggactaggtgctcaagatgtgatcacgaacatgggttatccaaaccaactccaagagtactaatatcagctgaagcacgcaacctctcatttgggaaattcctggaactcagtttttctagccactctgcagcaagaaggttatccatatgtggacatttggtcaacagggattgcttgcgcttttttggcttgggctctaaagttgctatgttccggtactcttcggttgaaatttacaccacctgcaaaccacaacctactctccagttcgtcaaccccatcagacaggattggtttgaaggacaaaggagaaatgttcatgctaaaggtatggtgcttttctctggggttgcaagatttctacaaaacttgaagaatgaacatcctgatgcaataaaattagcaatcaattgtggcctcgcactccctgttaaggacttcactgaactagaagagttgctgataaaagaaaaggcccagtttgagagttctgtgggcaaggccactgatcaaaatgggacaccgtcttcgtctgtgcatgaactattgaatataaattggtactatcaggaccttctacttgagctttacatttgggatcgccgtctacatcaattattctactgtaaatctgtccaattagaaagtgttgctaattacaagaatcctgctgatactgttgatgggatctgcggcgagaactctggtactgataagaaaatcagtgataaaactacgatagctttgggggtagccagtaccacggagtctgcaagtaataatcttgatcatcaatcaggtgatgctgcagcacccttgcttgatgaaagccaagaagctgggcactcggaacttccttgcaatggaggtagtaaagctgaagattcttccattgctcatggtcaaataaaggttgatggcacaatagaaactgcaaatgatccttgtttcgaaatatccaatgataaggaggtccaggtcaatgatacagtagcagatccaatacccatgaaacaggagccttgtagcactccccaacagtttaaatatccgtattgggatgaaagggaaaggtggatttggaattcaatttctgagtctcaattggcttacaggaatgacattcaaattggatatttggaaaaatttgaactcattaacaattatttgccacattatcttcctcccttgtttgaacaacatgatgaggcatactctccgcagtttgcagtaggtccaggtagtaatattttgtgcataatggaagatgagatatccagcataatagctcgtgctcttgccatatctgatgaacgccaccatttgatagatttaaaatttgagaatggaatggattattccaagggagagcatgttaaagcaatggagaaatcttatagttttctgtctgaaagttctttcagctcatccccatggtcatctacagattctgaagcaagcttgtcatctctgtcttcattttcatctgatgacttttctggttatgatagctcatctttattgtccccgatgcatccagaaatgactgtgaacgggaaagtgactctcaaaggcaaatattcagtaactgttgtatatgacaatcaattctttgcgcttcggaaaaagtgttgcccatccgagcttgagtatattacttccttaagccgttgcaagaagtggaatgctcaaggtggaaagagcaaggcctattttgcaaagacgatggatgacaggttcatcataaagcaaatcaagaaaacagagttcgagtcatttattaaatttgcccctgattactttaagcatgtttaccattctctggacactggaagccaaacttgccttgccaagatattaggaatctatcaggttaagcaaattaggcatggcaaagaggtaaagattgacttgatggtgatggaaaatcttctctttggccacaatatttcacgaatttatgacctcaaaggtgctactttttcgcggcgtgtcactgactcaaatgatcatgatactgtttacctggaccaaaattatgttgaggacatgggtttttccccaatctatattggtggaagaacaaaacatcttttgcagcgtgcaatctggaatgacacagctttcctcacttctgcgaatgtcatggactattctctacttgtgggagtggacaaagagaagcatgaacttgtgtttggcatcattgactatctgaggcaatatacttgggacaaacaactggagacatgggtgaagacttctctggtagtacccaagaatgtttcaccaactgtaatttcccccaaggaatacaaaaaaaggtttaggaagttcatggcgaagtacttcctgtctgttccagacacatggagtcctgataattcatctaagccatgcaaatcccttggtcagagcaatcacaagtcagtggaactccagaatggcaataacctgcttcagcacccaacagaaggtgcttggtatgcctggaccattgataaggaagagattggatttggtgggctgatgaagctcagcttttcccaccagaggcagagccctaacccaaagtatggaatatggattgccctgctgcttaccatgatatcgcttgcttttggccctgcaaggcagctcaatcaatttggcattgcaacctttgctggcagtggttctcttcatctgattgaggtccagaggatgattctggctcaaaagacgttcacaaagtga

SEQ ID NO: 21289 - protein, 1689 aa, Sorghum bicolor
  misc_feature: Ceres ANNOT ID no. 8703852
  misc_feature: Up-regulated in shoot tissues in response to methyl jasmonate treatment
  misc_feature: Down-regulated in shoot tissues in response to aminocyclopropane carboxylic treatment
  misc_feature: Up-regulated in root tissues in response to methyl jasmonate treatment
  misc_feature: Up-regulated in root tissues in response to salicylic acid treatment
  misc_feature: Up-regulated in shoot tissues in response to salicylic acid treatment
  misc_feature (1304)..(1570): SWISSPROT Homolog: EC 2.7.1.68 1-phosphatidylinositol-4-phosphate 5-kinase
  misc_feature (1331)..(1562): Pfam ID: PIP5K Pfam Description: Phosphatidylinositol-4-phosphate 5-Kinase
MYGAPILILFLLPDTNREDAPEANGYHRSHCFKKDHHSPHGAEQSQAADADNKHINHLSTDDNAPSSASGHRHGRISRHASTSSVDDRSIKSGDDSDGAESTNGRSSNTEISFLENDTIWIPPQAADKEDEAQSFATSIAYDDDDDDYSDGIKWGQSSFPSPGKQHDTGTSNHREEREKAMLEAMNGQLKILVSRFLASAGIPSSNEEGSDSWLEIVTSLSWEAALLIKPDGSMGKEMDPGSYIKVKCVASGTRRQSEVIKGLVFKKNTAHKHMPTNCHNPRLLLLKGVLGHSDVGLSSFSSMDQEKDLLERAIGKMMEICSPNVVLVEKTVSRNIQELLLKEGVTLILDMKLNRLERIARCTGSPIISFSEVLDKPKLKQCDYFHIEKFIEEHNNASEGGKRPSKTLMFLEGFPRPLGCTILLKGANSEELKKVKQVMHFTVFAAYHLILETSFFEDQRVFLNDKSTPKETSVTATEGTSPTAYDVAALSGAIPSFPSHDDSPALRLFHATSNSYADVNKPTSPRNMDSFSSVSSSSANDLEQGASIRLNNTERLTLPVQGPLRKLFADMLSHQNIYLPVTSLQEANDNRKEVRAESGQETVSNGFHRPKIEEPVVSIENGESINDAQKQEITRAIMPGSSSVSDKSGESPVMEDNEAHTTSIVIKEKYVDDDQADDALDSHSILILMSSQCTEKQVICEQSHLTRIKYYGSFDVSLGRYLQDILQNQKLSCSSCGEPPESHMYSYTHRNGNLTVLVKRLVPQHHLPGESEGKIWMWTRCSRCDHEHGLSKPTPRVLISAEARNLSFGKFLELSFSSHSAARRLSICGHLVNRDCLRFFGLGSKVAMFRYSSVEIYTTCKPQPTLQFVNPIRQDWFEGQRRNVHAKGMVLFSGVARFLQNLKNEHPDAIKLAINCGLALPVKDFTELEELLIKEKAQFESSVGKATDQNGTPSSSVHELLNINWYYQDLLLELYIWDRRLHQLFYCKSVQLESVANYKNPADTVDGICGENSGTDKKISDKTTIALGVASTTESASNNLDHQSGDAAAPLLDESQEAGHSELPCNGGSKAEDSSIAHGQIKVDGTIETANDPCFEISNDKEVQVNDTVADPIPMKQEPCSTPQQFKYPYWDERERWIWNSISESQLAYRNDIQIGYLEKFELINNYLPHYLPPLFEQHDEAYSPQFAVGPGSNILCIMEDEISSIIARALAISDERHHLIDLKFENGMDYSKGEHVKAMEKSYSFLSESSFSSSPWSSTDSEASLSSLSSFSSDDFSGYDSSSLLSPMHPEMTVNGKVTLKGKYSVTVVYDNQFFALRKKCCPSELEYITSLSRCKKWNAQGGKSKAYFAKTMDDRFIIKQIKKTEFESFIKFAPDYFKHVYHSLDTGSQTCLAKILGIYQVKQIRHGKEVKIDLMVMENLLFGHNISRIYDLKGATFSRRVTDSNDHDTVYLDQNYVEDMGFSPIYIGGRTKHLLQRAIWNDTAFLTSANVMDYSLLVGVDKEKHELVFGIIDYLRQYTWDKQLETWVKTSLVVPKNVSPTVISPKEYKKRFRKFMAKYFLSVPDTWSPDNSSKPCKSLGQSNHKSVELQNGNNLLQHPTEGAWYAWTIDKEEIGFGGLMKLSFSHQRQSPNPKYGIWIALLLTMISLAFGPARQLNQFGIATFAGSGSLHLIEVQRMILAQKTFTK

SEQ ID NO: 21290 - DNA, 2991 bp, Sorghum bicolor
  misc_feature: Ceres ANNOT ID no. 8703877
  misc_feature: Up-regulated in root tissues in response to methyl jasmonate treatment
  misc_feature: Up-regulated in shoot tissues in response to salicylic acid treatment
  misc_feature: Encodes the peptide sequence at SEQ ID NO 21291
atggcggccgcgggcatcgcagtcagcgtttccatgggggctctgaagcctgtcttggaaaagcttgccacgctcctgggcgacaagtacaagaagctcaagggtctacggaaggaggtgtccttcctcatggaagagttaagcgacatgaaagtcctccttgagaacatggacaatgctgaggatgaactcaattcgcaggccaagaaatggaggaaagatataattgatatgtcatatgatattgaagattgcattgacaacttcatggaccgtgttggggatgccgatgataaggtggggatcctcaagaaagcttctcactatctgagaactatcaaggatcggtaccgcatagccaatcagatcaatgagatcaagagtcgtgtgatggaagcaagcaaacgccgagataggtacaatctcaatgtgtgcacctctggttctaccacaatagtggctgttgatcctcgcctgactgcactttacacggattcaacaacccttgtgggcattggcactcaaaaggaagaacttgtcaaatgggtagaggatgaagagaaacaactaaaggtgatgtcaatagtaggatttggaggtttaggcaagaccacgcttgccaatgaggtatatcatgacgttgaagggcatttcaatagcaaggcatttgtgccagtttctcagaagccagacgtaccaaggctacttagcagtgtgtgttcaaaacttggggtgcttcaatcttctcatgcttgcgaagtccaagagctaatcgatactttgagagaatacctgtgtgataagaggtacctcattgtacttgatgatttgtgggaagtgaaacattgggatatcattagttgtgcttttccaaagaatagtcaacaaagcaggcttattgtgactacaagaattgaaggtgtggctcaggcatgttgcaaggaccatgggcgcattcattatatgaaaccactaagtgacgcggactcaagaaagttattctttagaaggatttttggcactgaagatacttgccctcctcagttcacagaagtttcatctgaaattctaaagaagtgcggtggtttgccacttgcaattgtcactatggctagctctttagcagaccaacccaaagagcactgggactacatacaacgttctatagtcactgaatctgcagcaaactccttggctgacatgatgcagatcttagacctgagctataagcaccttcctcatcatctaagagcatgctttttgtatctcggtatttatcctgaggactacgagattgaaagggatcagctgatttacttgtgggtggcagaacgtattgtgacgagcaagtctcctatgcaagatgtaaaggatgtagcagagagctgtttcaatgaacttgtcaataggaacatgattcaaccagaatcctattactacagagtacatgatatgatgctcgatctaatcataaagaggtgcagagaaggtaattttgtaagtgttgtgcacagtgcacaggtggtggtagaacggcaagacagggttcatcgtctgtcagtcagcttgagtgatgttccagatgatgactccatatttcagctggccactaattgctgccgatcacaagttcgttctcttgtcttccttggagcatcaaaatggatgcctccactgttagagcttaagtctcttcgggtgcttttccttcaatttccgaagcacctgaagacaatggacctcacaggtgttggccaattgtctcaactgagatacttaaaggttaatgggatattctattcagatacttctattgtgctaccaagtgaaattggaaggatgcgacatttggagaggctggaaataccttatacatacatttgcagcactccatcagatattgttgacttgccacgcttgtcacatctcatcttgccagaggatacaagtttgctagacgggattgggaagatgaaatctctgcgtacgctgaggtcatttttattagcagagagctcaccagaggatattaagggcctcagcgaactcaacaagctggaagacttgcggatgagttgccgcagaagcagaaacaaccgcgagcataggccgaaacgagccgatggtgatacgccgacagctatatggatggatgctctgattttttccctggagaaactaagtaacctcaaaagctttttcctgtcatctgaatttactgctgtcaaagccgatgccctgctcttgctttcacctcctttccaaaatctcgaggtgctctatctgcacggactgatcttctctagagttcctaggtggatcggaggtctccaaaagctttgtcggttgacactcggagcaaagcagatgacccaggaagatattaacatcattggaacactgccctatctcaccggcctccggctgcggatctcaggcatgccaacaggcacgatcgtgataggtgggaccacagggttcaacgctctcgagttttttgtgtacgactgtgatgttatgtcatatctggcatttgaggacggagctatgcccagcctccagaagcttggtttactactggatccacataaatgggacaaggttacacctcttggtctccaatgtctttcgaacctcaagaaaataactgtatggacggttgccaccagttatagcaacgacgcaggagcgggtgacaaagaatcagaggagatgtctgcggctgctttggtccgcaaggtgtttcaggaagcagccaacgcacatccgagtcacctagcatatacctttcacgaagggcttgataggtatgcaaaacttcttacagatttgtttgtacttacagccggcagaggaggcacaagagtagaaggtggatggaacacagtgcagaattattgggactctgttgccatcacgcgttcatgctgctgctatctctcctgtagcctctccactaatccttcaagtcataatgccatttcattttaa

SEQ ID NO: 21291 - protein, 996 aa, Sorghum bicolor
  misc_feature: Ceres ANNOT ID no. 8703877
  misc_feature: Up-regulated in root tissues in response to methyl jasmonate treatment
  misc_feature: Up-regulated in shoot tissues in response to salicylic acid treatment
  misc_feature (154)..(452): Pfam ID: NB-ARC Pfam Description: NB-ARC domain
MAAAGIAVSVSMGALKPVLEKLATLLGDKYKKLKGLRKEVSFLMEELSDMKVLLENMDNAEDELNSQAKKWRKDIIDMSYDIEDCIDNFMDRVGDADDKVGILKKASHYLRTIKDRYRIANQINEIKSRVMEASKRRDRYNLNVCTSGSTTIVAVDPRLTALYTDSTTLVGIGTQKEELVKWVEDEEKQLKVMSIVGFGGLGKTTLANEVYHDVEGHFNSKAFVPVSQKPDVPRLLSSVCSKLGVLQSSHACEVQELIDTLREYLCDKRYLIVLDDLWEVKHWDIISCAFPKNSQQSRLIVTTRIEGVAQACCKDHGRIHYMKPLSDADSRKLFFRRIFGTEDTCPPQFTEVSSEILKKCGGLPLAIVTMASSLADQPKEHWDYIQRSIVTESAANSLADMMQILDLSYKHLPHHLRACFLYLGIYPEDYEIERDQLIYLWVAERIVTSKSPMQDVKDVAESCFNELVNRNMIQPESYYYRVHDMMLDLIIKRCREGNFVSVVHSAQVVVERQDRVHRLSVSLSDVPDDDSIFQLATNCCRSQVRSLVFLGASKWMPPLLELKSLRVLFLQFPKHLKTMDLTGVGQLSQLRYLKVNGIFYSDTSIVLPSEIGRMRHLERLEIPYTYICSTPSDIVDLPRLSHLILPEDTSLLDGIGKMKSLRTLRSFLLAESSPEDIKGLSELNKLEDLRMSCRRSRNNREHRPKRADGDTPTAIWMDALIFSLEKLSNLKSFFLSSEFTAVKADALLLLSPPFQNLEVLYLHGLIFSRVPRWIGGLQKLCRLTLGAKQMTQEDINIIGTLPYLTGLRLRISGMPTGTIVIGGTTGFNALEFFVYDCDVMSYLAFEDGAMPSLQKLGLLLDPHKWDKVTPLGLQCLSNLKKITVWTVATSYSNDAGAGDKESEEMSAAALVRKVFQEAANAHPSHLAYTFHEGLDRYAKLLTDLFVLTAGRGGTRVEGGWNTVQNYWDSVAITRSCCCYLSCSLSTNPSSHNAISF

SEQ ID NO: 21292 - DNA, 2838 bp, Sorghum bicolor
  misc_feature: Ceres ANNOT ID no. 8703875
  misc_feature: Up-regulated in shoot tissues in response to salicylic acid treatment
  misc_feature: Encodes the peptide sequence at SEQ ID NO 21293
atggcggccgcgggcatcgcagtcagcgtttccatgggggctctgaagcctgtcttggaaaagcttgccacgctcctgggcgacaagtacaagaagctcaagggtattcggaaggaggtgtccttcctcatggaagagctaagcgacatgaaagtcctccttgagaacatggacaatgctgaggatgagctcaatccgcaggccaagaaatggaggaaagatataattgacatgtcatatgatattgaagattgcattgacaacttcatggaccgtgttggggacgccgatgacaaggtggggatcctcaagaaagcttctcactatctgagaactatcaacgatcggtaccgcatagccaatcagatcaatgagatcaagactcgtgtgattgaagcaagcaaacgccgagataggtacaatctcaatgtgtgcacctctggttctaccacaatagtggctgttgatcctcgcctgactgcactttacacggattcaacaacccttgtgggcattggcactcaaaaggaagaacttgtcaaatgggtagaggatgaagagaaacaactaaaggtgatgtcaatagtaggatttggaggtttaggcaagaccacgcttgccaatgaggtatatcatgacgttgaagggcatttcaatagcaaggcatttgtgccagtttctcagaagccagacatatcaaggctactcaatagcgtgtgttcaaaacttgggctgtcttcatattctcatgcttgcgaagtgcaagacctaattgacaatttgagagaatacctacatgataagaggtacctcattgtacttgatgatttgtgggaagtgaaacattgggatatcattagttgtgcttttccaaagaatagtcaacaaagcaggcttattgtgactacaagaattgaaggtgtggctcaggcatgttgcaaggaccatgggcgcattcattatatgaaaccactaagtgacgcggactcaagaaagttattctttagaaggatttttggcactgaagatacttgccctcctcagttcacagaagtttcatctgaaattctaaagaagtgcggtggtttgccacttgcaattgtcactatggctagctctttagcagaccaacccaaagagcactgggactacatacaacgttctatagtcactgaatctgcagcaaactccttggctgacatgatgcagatcttagacctgagctataagcaccttcctcatcatctaagagcatgctttttgtatctcggtatttatcctgaggactacgagattgaaagggatcagctgatttacttgtgggtggcagaacgtattgtgacgagcaagtctccaatgcaagatgtaaaggatgtagcagagagctgtttcaatgaacttgtcaataggaacatgattcaaccagaatcctattactacagagtacatgatatgatgctggatctaatcataaagaggtgcagagaagataattttgtaagtgttgtgcacagtgcacaggtggtggtagaacggcaagacagggttcatcgtttgtcagtcagcttgagtgatgttccagatgatgactccatatttcaggtggccactaattgctgccgatcacaagttcgttctcttgtcatccttgaagcatcaaaatggatgcctccactgttggagctaaagtctcttcgggtgcttttccttaaatttccgaagcacctgaagacaatggacctcacaggtgtttgccaattgtctcaactgagatacttaaaggttgatgataggatatactattcagagcgttcaattgtgctaccaagtgaaattgggaggatgcgacatttggagaggctggaaatacctaatatatgcatttgtagcattccatcagacattgttgacttgccacgcttgtcacatctcatcttgtcagatgatacaagtttgccggacgggattgggaaaatgaaatctctgcgtacgttgaggtcatttttattagcagagagctcaccagaggatattaagggcctcggccaactcaacaagctagaagacttggaggtgcggtgccacggagaaagatacaaccacaagcataggccgaaacgaatggatagtgatacgccgactgctatatggatggatgctctgattttttccctggagaaactaagtaacctcaaaaggttttgcctgtcatctgaatttactgctgtcggagccgatgccctgctcttgctttcaactcctttccaaaatctcaaggtgctctatctgcacggactgatcttctctagagttcctaggtggatcggaggtctccaaaagctttgtctgttgacactcggagcaaagcagatgacccaggaagatattaacatcattggaacactgccctatctcaccggcctctggctgcggatctcaggcatgccaacaggcacgatcgtgataggtgggaccacagggttcaacgctctcgagctttttgcgtacgactgtgatgttatgtcatatctggcatttgaggacggagctatgcccagcctccgggagctcgatttagtactggatccacataaatgggacaaggttacacctcttggtctccaatgtctttcgaacctcaagaaaataactgtatggacggttgccaccagttatagcaacgacgcaggagcgggtgacaaagaatcagaggagatgtctgcggctgcgttggtccgcaaggtgtttcagggagcagccgactcacatccgagtcacccagcatttgacgaagggaattttcatagtaagtttcgtttcgttctgtatatacaatga

SEQ ID NO: 21293 - protein, 945 aa, Sorghum bicolor
  misc_feature: Ceres ANNOT ID no. 8703875
  misc_feature: Up-regulated in shoot tissues in response to salicylic acid treatment
  misc_feature (154)..(452): Pfam ID: NB-ARC Pfam Description: NB-ARC domain
MAAAGIAVSVSMGALKPVLEKLATLLGDKYKKLKGIRKEVSFLMEELSDMKVLLENMDNAEDELNPQAKKWRKDIIDMSYDIEDCIDNFMDRVGDADDKVGILKKASHYLRTINDRYRIANQINEIKTRVIEASKRRDRYNLNVCTSGSTTIVAVDPRLTALYTDSTTLVGIGTQKEELVKWVEDEEKQLKVMSIVGFGGLGKTTLANEVYHDVEGHFNSKAFVPVSQKPDISRLLNSVCSKLGLSSYSHACEVQDLIDNLREYLHDKRYLIVLDDLWEVKHWDIISCAFPKNSQQSRLIVTTRIEGVAQACCKDHGRIHYMKPLSDADSRKLFFRRIFGTEDTCPPQFTEVSSEILKKCGGLPLAIVTMASSLADQPKEHWDYIQRSIVTESAANSLADMMQILDLSYKHLPHHLRACFLYLGIYPEDYEIERDQLIYLWVAERIVTSKSPMQDVKDVAESCFNELVNRNMIQPESYYYRVHDMMLDLIIKRCREDNFVSVVHSAQVVVERQDRVHRLSVSLSDVPDDDSIFQVATNCCRSQVRSLVILEASKWMPPLLELKSLRVLFLKFPKHLKTMDLTGVCQLSQLRYLKVDDRIYYSERSIVLPSEIGRMRHLERLEIPNICICSIPSDIVDLPRLSHLILSDDTSLPDGIGKMKSLRTLRSFLLAESSPEDIKGLGQLNKLEDLEVRCHGERYNHKHRPKRMDSDTPTAIWMDALIFSLEKLSNLKRFCLSSEFTAVGADALLLLSTPFQNLKVLYLHGLIFSRVPRWIGGLQKLCLLTLGAKQMTQEDINIIGTLPYLTGLWLRISGMPTGTIVIGGTTGFNALELFAYDCDVMSYLAFEDGAMPSLRELDLVLDPHKWDKVTPLGLQCLSNLKKITVWTVATSYSNDAGAGDKESEEMSAAALVRKVFQGAADSHPSHPAFDEGNFHSKFRFVLYIQ

SEQ ID NO: 21294 - DNA, 948 bp, Sorghum bicolor
  misc_feature: Ceres ANNOT ID no. 8703984
  misc_feature: Down-regulated in shoot tissues in response to salicylic acid treatment
  misc_feature: Encodes the peptide sequence at SEQ ID NO 21295
atggcgctccacgccgtctcccccgcggcggtctcctccccgctgcgcgccctctcgcgcagcctcccccagcgcccaggctgcggttgtttaccaaagcaatccctcgcagtttactcctccataaactttgcgagacttcgggctggaccagtggacttcggtggcaggcctctggttcttcgacactcggacaagagagcagttttgatgcatgctactattgaagaaatcgaagcggagaaatccctcattgaagaccaaaaagaaaagatggagaaggcaattgaaacagtccaaactaacttcaacactgtgaggacagggcgtgcaaacccagcgatgcttgaccgaattgaggttgagtactacggaactccagtgaacttgaagagcattgcgcagataagcactccagatgcaacttctcttcttatccaaccatatgacaagtcaagcctcaagcttattgagaaaacgatagttgctgcaaatcttggtgtgacaccaagcaatgacggagaagtgatacgagtgactgtcccacctttgacatctgatcgtagaaaggaattagcaaagacagtagctaaattatctgaagatggcaaggttgctataaggaacataagaagagatgcaatcaaagcttatgataaactacagaaggaaaagaagctttctgaggataatgtgaaagatttatcagctgatctacaaaaagtcacagatgagtacatgaaaaagatcgattccatccagaagcagaaggaacagatccacgctctcagggtgtgcgtatatttgcgcgtaggtgacagtggtttgccaagtgcggaaagatggagaagagatacgaggaactggagatatttttcctctttttgcccaaaaaacatagatgaggaaggaatcactcttggagatgctcttagtggccaaaattag

SEQ ID NO: 21295 - protein, 315 aa, Sorghum bicolor
  misc_feature: Ceres ANNOT ID no. 8703984
  misc_feature: Down-regulated in shoot tissues in response to salicylic acid treatment
  misc_feature (98)..(261): Pfam ID: RRF Pfam Description: Ribosome recycling factor
MALHAVSPAAVSSPLRALSRSLPQRPGCGCLPKQSLAVYSSINFARLRAGPVDFGGRPLVLRHSDKRAVLMHATIEEIEAEKSLIEDQKEKMEKAIETVQTNFNTVRTGRANPAMLDRIEVEYYGTPVNLKSIAQISTPDATSLLIQPYDKSSLKLIEKTIVAANLGVTPSNDGEVIRVTVPPLTSDRRKELAKTVAKLSEDGKVAIRNIRRDAIKAYDKLQKEKKLSEDNVKDLSADLQKVTDEYMKKIDSIQKQKEQIHALRVCVYLRVGDSGLPSAERWRRDTRNWRYFSSFCPKNIDEEGITLGDALSGQN

SEQ ID NO: 21296 - DNA, 2793 bp, Sorghum bicolor
  misc_feature: Ceres ANNOT ID no. 8704076
  misc_feature: Up-regulated in root tissues in response to methyl jasmonate treatment
  misc_feature: Encodes the peptide sequence at SEQ ID NO 21297
atgggctatctggactcaccacaatatgtgtgttttttatggcgtttcaccctccctgactggtgttgtgtctctgattttagaggaattaaggttttggaagttttggccagggctcaaagatgtcttatctccttgcccttgtgccactcggtatctaatgttttgtcccaagcaaattatgttagattactcaaaggacacagatatgtcatatgtaatgcatgcagcaatgatttgttctttcgacaaaaaggaacacggttttctaagcacttacgttctgggcaacactctttccttcactggtctgatacagcaagagagttgctggtctctgttcggtttgatggcccaggatggcaatggtcaggaagttttttccctgatcacctgggagatgctcaattgaaaatgcgcaatagtgcctcaggtttatcatatatggttcgagttgaagtgcaaaatgccgatctagacatatacaacaagagattttctggaaaaaataatgtcaatactggtacagtactgattctgctttctgatgacaagactggttttgtaccttacaggatcgacaatttttcaatggagaaactgcggatatatcaacagagatgtgaatctattgaaacaatcgtttatccctacacatcctgtcaatatgcttgggatgagccttgctatcctcatcgccttactgttgagattcctggagaacgaagtttgggtacattcaatctggacattctcaacgacgatgttcatgtgtcactaccatccacatctgagaaagctgaaaggcaattctgcatctcaatacatgcagaaggagcaattaaggtgctaagtgttcttgattcaaattaccacaatacggaaacaaaagaaaagaattttctgggatcaaaggaacctaaagttgctgatcacaaactggagcttgatatgaattttgctgaagttatcaaaatacagttaccattcatagggatatctttaataagttcttctccacagagtttagatcagcagagatttacagttcaaatacaatctatgcaaatcgataatcagttccctgatagcccacaccctgtcatgttatcatttgagggcagtcataagggaaaatccatgaacttttttaagagtaaagatactaagctgaaatcagcaaatgacattctttccaataccacagagcctgtgctgcagtttactgcagctaaatggagaaccagagatgtatcatttgtttcctaccaatatataaacataagtgtagcacctgttcgccttgaacttgaagaacgacttgtcttgagcatgattgaattttttagatctgtttcctctagaataaatattggacgcttcgagaaaagtcttgagctaagtattttaggtggtgctacggacatgttaagagaatatgaaaaaatctcaaagaatattacagacaagctcctggtgcaagacagtgaattgttgccttctgttgtcccagttggtgctccatggcaacagatacaccttttagccagaaagcagaaaaaggtgtacattgaattgtttcagttgactcctagaggtcttatggccctcttagatgttgaaggagtaccagtttatcttggagaaattactgcagaaaatcttatggccagctggcaatctgttcaggacattcttgtgaggcattatagcaggcaaatcctccatgaactttataaggttttgggttctgctggcgttataggcaatcctatgggttttgctaggaatgttgggtttggtttaaaggacttcatatctgcttcaagaaaagggaaattgcagagcccagttgaactattaaacggtatagcacaaggttcaaaaactcttattggaagtacggtttatgcagtcagcagcgccacttctcacttcagtaaaactgcttataagggccttgttgcttttacatatgatgagcaagcagcttcgaagatggaagaacgggaaagacagctaggtttgcatggggaaggagtactgaatggttttctagagggtctgactgggctccttcagtcaccgattaggggagctgagaaacatggtcttcctggggtcatctcaggtttagcaatggggacagctgggcttgtggcacggcctatggccagcattcttgaagccacaggcagaactgcccagagcataagaaaccgaagcaaccctcatgaatccaactacttgcgagtccgtttccccaggcctgttgccagagatcaccctttgttcccgtactcctgggaagaagccatcggtgtatcattgcttgcccaagctgagagtggtagactaaaggaggagacatttgtcatgtgcaagacactcaagggggctgggaagttccttgtgctaactgagaagctgcttctactagtctcaagcccatatttagtggatctaggatcacctcagtttgtcggtgttcctcctgacccacagtggtcaatcgacacagagatgcacctcaagagcgttgttcatctggacaggtctcaggaggtagtgaacattgttgggagcaatggacagacttcacctagggacaaaagaagtggcacgaggaacagggtcatgagctcggcctttgtccccctgtttcacctcagcatcgagctcccaaacgatgaggacgcagaagggacggtgcaggtcctacaggcactcatcgagaaggggaaggcaaggaggtgggacaagaacatcctacaccgaagcaacatcagttga

SEQ ID NO: 21297 - protein, 930 aa, Sorghum bicolor
  misc_feature: Ceres ANNOT ID no. 8704076
  misc_feature: Up-regulated in root tissues in response to methyl jasmonate treatment
MGYLDSPQYVCFLWRFTLPDWCCVSDFRGIKVLEVLARAQRCLISLPLCHSVSNVLSQANYVRLLKGHRYVICNACSNDLFFRQKGTRFSKHLRSGQHSFLHWSDTARELLVSVRFDGPGWQWSGSFFPDHLGDAQLKMRNSASGLSYMVRVEVQNADLDIYNKRFSGKNNVNTGTVLILLSDDKTGFVPYRIDNFSMEKLRIYQQRCESIETIVYPYTSCQYAWDEPCYPHRLTVEIPGERSLGTFNLDILNDDVHVSLPSTSEKAERQFCISIHAEGAIKVLSVLDSNYHNTETKEKNFLGSKEPKVADHKLELDMNFAEVIKIQLPFIGISLISSSPQSLDQQRFTVQIQSMQIDNQFPDSPHPVMLSFEGSHKGKSMNFFKSKDTKLKSANDILSNTTEPVLQFTAAKWRTRDVSFVSYQYINISVAPVRLELEERLVLSMIEFFRSVSSRINIGRFEKSLELSILGGATDMLREYEKISKNITDKLLVQDSELLPSVVPVGAPWQQIHLLARKQKKVYIELFQLTPRGLMALLDVEGVPVYLGEITAENLMASWQSVQDILVRHYSRQILHELYKVLGSAGVIGNPMGFARNVGFGLKDFISASRKGKLQSPVELLNGIAQGSKTLIGSTVYAVSSATSHFSKTAYKGLVAFTYDEQAASKMEERERQLGLHGEGVLNGFLEGLTGLLQSPIRGAEKHGLPGVISGLAMGTAGLVARPMASILEATGRTAQSIRNRSNPHESNYLRVRFPRPVARDHPLFPYSWEEAIGVSLLAQAESGRLKEETFVMCKTLKGAGKFLVLTEKLLLLVSSPYLVDLGSPQFVGVPPDPQWSIDTEMHLKSVVHLDRSQEVVNIVGSNGQTSPRDKRSGTRNRVMSSAFVPLFHLSIELPNDEDAEGTVQVLQALIEKGKARRWDKNILHRSNIS

SEQ ID NO: 21298 - DNA, 2622 bp, Sorghum bicolor
  misc_feature: Ceres ANNOT ID no. 8704135
  misc_feature: Up-regulated in shoot tissues in response to salicylic acid treatment
  misc_feature: Encodes the peptide sequence at SEQ ID NO 21299
atggataaaaatagaggagaacagagagaagaagctgctcaatctccagatgctaaccttcgaacagtagcagaaggcaacctcacgcagttccaggagcagaatcttcctaacttcctcctctccttatcaatagagctctcgaacgatgaaaaacctccggagtctagaaggcttgctggtattatccttaagaattctttggacgagaaggattctgcgaaaaaggagctactgactcagcaatgggtaagcgtggatccatctgtcaagttgaagatcaaggagtcgttgctggtgacactaggatcttcggtgcatgatgcgaggcatacctcttcacaagtcattgccaaggttgcatcaattgagataccacgtcgagaatggcaagaccttgttgccaaattactgggcaacatgacttctccaggtgcatctgctcctttgaaacaagcaacactagaggcattggggtatgtctgtgaggagatttctccactggacatggagcaggaccaagtgaatgctgttctgactgctgttgtccagggaatgaaccagacagagctcagccctgaagttcgtcttgctgcagttaaggccctatacaatgctcttgacattgccgtgagtaactttgcaaatgaaatggagaggaattatataatgaaggtggtttgtgagactgctgtgtctaaagaagtggagatcagacaggctgcatttgaatgccttgttgcaatagcatccacatattatccacacttagatccttacatgcaaacgatattcaacctgacagctaatgcagtgaaaggtgatgaggaaccagttgcgcttcaagctgttgagttctggagcgctatttgtgatgaagagattatgctccaagatgaatatgagggatctgaggatggcaactctactgcacacttttgctttattgaaaaggccctcccttcacttgtaccgatgctgctagaagctttgttgaagcaagaggaagatcaagatcaagatgataatgtttggaacatttctatgagtggtgggacgtgcctcggactcatttctaaaactgttggtgatgcagttgtccctcttgtgatgccatttgtcgaggccaacatcacaaagcctgattggcattgtcgcgaggcagctacttttgcatttggttctatccttgaaggcccctctgttgaaaaacttgctccactggtccaggctggtcttgatttcttgcttaacacaatgaatgatacaaatagccaggtaaaagatactactgcttggactcttgggagggtatttgagctcttacattctccagatggtgcaaacccaatcataaataattcaaaccttcctcgtatcatgtctgtgttgcttcagagtagtaaagatgctccaaatgtggctgagaaagtctgtggagctatttattttcttgcccaaggttatgaagatgcagagtcaatgtcttctatgctcacaccttatctacctaatatcattgctgctcttctttctgccgcggaccgtgctgataccacccatttcaggcttcgtgcttctgcttatgaagcactgaatgagattgtgagagtcagcaatatacctgaaacttcaggcatcataggccaattgttgcaggagatcatgagaagattaaaccttacatttgatctccatatactttcttctggtgacaaggagaagcaaagcgatcttcaggctttgctatgtggtgttctgcaggtcatcatccagaaactgagcagcacagatgcaaagtccataatttctcagactgctgatcagttgatgatgctgtttctgcgcgtctttgcctgccacaattctactgttcatgaagaagctatgcttgcaattggtgctcttgcatatgctactggtccagattttgttaaatacatgcctaacttcttcacatatctggaggctggcttgcagaattatgaagagtaccaagtgtgttccatctctgttggggtggttggtgatatttgtcgtgccttggaagataaaattttgccattctgtgatagcattatgactgttcttcttaaaaacctatcaagctctatgctcaatcggtctgtgaagcctccgatcttctcatgctttggagacattgctcttgctattggtgagaattttgagaaatacctaccatatgccattccgatgcttcaaggagctgcaggactccttggtactcttaatcagagtgatgatgatatggttgattatggcaaccagctcagacgcggcatttttgaggcatactctggtatactccagggcatcaagggcccaaaagctcagcagatgattccatatgcaacccatctactacagttcactgaagctgtcttcaaagataggagcagggatgatagtgtgacaaaggctgcagttgctgtccttggggatctcgcagacacgcttggcgagagctcaaaggatctgttcaagacccaactattccatattgagttcttgagggagtgccaagcccaagagttggatgatgaagttcgggatactgcacaatgggcccaggggatgataaacctggcggtggtttcttaa

SEQ ID NO: 21299 - protein, 873 aa, Sorghum bicolor
  misc_feature: Ceres ANNOT ID no. 8704135
  misc_feature: Up-regulated in shoot tissues in response to salicylic acid treatment
  misc_feature (24)..(104): Pfam ID: IBN_N Pfam Description: Importin-beta N-terminal domain
MDKNRGEQREEAAQSPDANLRTVAEGNLTQFQEQNLPNFLLSLSIELSNDEKPPESRRLAGIILKNSLDEKDSAKKELLTQQWVSVDPSVKLKIKESLLVTLGSSVHDARHTSSQVIAKVASIEIPRREWQDLVAKLLGNMTSPGASAPLKQATLEALGYVCEEISPLDMEQDQVNAVLTAVVQGMNQTELSPEVRLAAVKALYNALDIAVSNFANEMERNYIMKVVCETAVSKEVEIRQAAFECLVAIASTYYPHLDPYMQTIFNLTANAVKGDEEPVALQAVEFWSAICDEEIMLQDEYEGSEDGNSTAHFCFIEKALPSLVPMLLEALLKQEEDQDQDDNVWNISMSGGTCLGLISKTVGDAVVPLVMPFVEANITKPDWHCREAATFAFGSILEGPSVEKLAPLVQAGLDFLLNTMNDTNSQVKDTTAWTLGRVFELLHSPDGANPIINNSNLPRIMSVLLQSSKDAPNVAEKVCGAIYFLAQGYEDAESMSSMLTPYLPNIIAALLSAADRADTTHFRLRASAYEALNEIVRVSNIPETSGIIGQLLQEIMRRLNLTFDLHILSSGDKEKQSDLQALLCGVLQVIIQKLSSTDAKSIISQTADQLMMLFLRVFACHNSTVHEEAMLAIGALAYATGPDFVKYMPNFFTYLEAGLQNYEEYQVCSISVGVVGDICRALEDKILPFCDSIMTVLLKNLSSSMLNRSVKPPIFSCFGDIALAIGENFEKYLPYAIPMLQGAAGLLGTLNQSDDDMVDYGNQLRRGIFEAYSGILQGIKGPKAQQMIPYATHLLQFTEAVFKDRSRDDSVTKAAVAVLGDLADTLGESSKDLFKTQLFHIEFLRECQAQELDDEVRDTAQWAQGMINLAVVS

SEQ ID NO: 21300 - DNA, 2076 bp, Sorghum bicolor
  misc_feature: Ceres ANNOT ID no. 8704160
  misc_feature: Down-regulated in shoot tissues in response to aminocyclopropane carboxylic treatment
  misc_feature: Encodes the peptide sequence at SEQ ID NO 21301
atggtctatttaatccagcagtacgagcagcagatgctggagcagaagcgcgccgccgccgccgcagcagcggctgccgcggctgctggtggtggcgggaggggcggcggaggaggatgtgggggtgggggtggtgggcccaggcacgtgcgccggtcgcattccgggaagactatcaaggtgaagaaagatggagctggtggcaaagggacttggggcaaactaattgatactgatgcagaggcatgccttgaccgaaatgatccaaattatgacagtggcgaggagccatatgagttagttgaagcccctgtttcaaccccactagaagactacaagaaagctgttatcccattaattgaggaatatttcagcaatggtgatgtaaaattagctgcttctgatcttaaagaattgggttatgatgatttccaccgttactttgtcaagaagcttgtttccacagcaatggacaggcatgacaaggagaaagagatggcatcagtgcttctatcatatctttatggcaacgtggtcagttcaactcaaatcagactgggcttcgtgctgctattggaggctgttgatgacctggctgttgacatacctgatgtggttgatgtgctcgcacttttcgttgcacgtgcagttgttgatgacattctgccacctgctttcctcagcaaggcaaaagtgagtctctcaggatcgtcaaagggtatgcaggttgtacaaattgcagagaaaagctatctttcagcaccccaccatgcagagttaattgagcgacgatggggtggttcaactcacatcacagtagaagaggtgaagaagaggattgctgatcttctaaaggaatacatcagaaatggtgatacagctgaggcttgtaggtgcattagggagctggcagtgcccttttttcatcatgaggtggtgaagcgagctcttactcttggaatggagagtccagctgctgaagcacttattgccaaacttctgaaggaggcatctgaagaatgtttaataagctctagtcagatgatgaaaggattctatcgggttgctgagagtcttgatgatctcattcttgatataccgtctgcaaagtctgaattccagctgttggtatcaaaagccatttctgagggatggctagattcttcatatgtgaagtcaggtgtcaacggaagcgttgaagatgatgaacatgagaagctggcaaggtacaagagggaggctgtatctataatacacgaatactttctatctgatgatacaacagaggttattcgtagtgtcaaagagctcggttatccagaatataatccaatcttcatcaagaagctcataacaactgctatggaccgcaagaacagggagaaagagatgacatcagttcttctatcctcattaagcatggagctgttctcgtctgaagacatcgccaagggattcataatgctccttgaatctgcagaagacactgcacttgatatattggatgcctcagatgagttgggactgttcctagccagggctgtgattgatgatgttcttgcacctctaaacttggatgagattagcagcaagcttccaccaaactgcagcggggctgaaacattgaacatggcacgctcccttgtgtctgcccggcatgctggtgagaggcttctgaggtgctggggtggtggaaccggatgggctgtggaggatgcaaaggacaagataacaaagctcctggaagagtatgagagtggaggtgatttaggagaagcatgcaactgtatccgtgaactgggtatgtctttcttcaaccatgaagttgtcaagaaggcgctcgtgatggcaatggagaagaagaatgagaggaccctgagcctgctgcaggagtgctttggtgaagggatcataaccatcaaccagatgaccaaggggttctcaagggtcagggatggactcgacgacctggctctggacattcctgatgccagggagaagttcatttcctatgtggagcacgcaaagaagagtggatggctcctgcccgggtttggtgttgcatcttcagtttga

SEQ ID NO: 21301 - protein, 691 aa, Sorghum bicolor
  misc_feature: Ceres ANNOT ID no. 8704160
  misc_feature: Down-regulated in shoot tissues in response to aminocyclopropane carboxylic treatment
  misc_feature (276)..(387): Pfam ID: MA3 Pfam Description: MA3 domain
  misc_feature (573)..(682): Pfam ID: MA3 Pfam Description: MA3 domain
  misc_feature (112)..(223): Pfam ID: MA3 Pfam Description: MA3 domain
  misc_feature (410)..(521): Pfam ID: MA3 Pfam Description: MA3 domain
MVYLIQQYEQQMLEQKRAAAAAAAAAAAAGGGGRGGGGGCGGGGGGPRHVRRSHSGKTIKVKKDGAGGKGTWGKLIDTDAEACLDRNDPNYDSGEEPYELVEAPVSTPLEDYKKAVIPLIEEYFSNGDVKLAASDLKELGYDDFHRYFVKKLVSTAMDRHDKEKEMASVLLSYLYGNVVSSTQIRLGFVLLLEAVDDLAVDIPDVVDVLALFVARAVVDDILPPAFLSKAKVSLSGSSKGMQVVQIAEKSYLSAPHHAELIERRWGGSTHITVEEVKKRIADLLKEYIRNGDTAEACRCIRELAVPFFHHEVVKRALTLGMESPAAEALIAKLLKEASEECLISSSQMMKGFYRVAESLDDLILDIPSAKSEFQLLVSKAISEGWLDSSYVKSGVNGSVEDDEHEKLARYKREAVSIIHEYFLSDDTTEVIRSVKELGYPEYNPIFIKKLITTAMDRKNREKEMTSVLLSSLSMELFSSEDIAKGFIMLLESAEDTALDILDASDELGLFLARAVIDDVLAPLNLDEISSKLPPNCSGAETLNMARSLVSARHAGERLLRCWGGGTGWAVEDAKDKITKLLEEYESGGDLGEACNCIRELGMSFFNHEVVKKALVMAMEKKNERTLSLLQECFGEGIITINQMTKGFSRVRDGLDDLALDIPDAREKFISYVEHAKKSGWLLPGFGVASSV

SEQ ID NO: 21302 - DNA, 1014 bp, Sorghum bicolor
  misc_feature: Ceres ANNOT ID no. 8704198
  misc_feature: Down-regulated in shoot tissues in response to aminocyclopropane carboxylic treatment
  misc_feature: Up-regulated in root tissues in response to salicylic acid treatment
  misc_feature: Encodes the peptide sequence at SEQ ID NO 21303
atgggcaagattaagatcggaatcaacggtttcggaaggatcggcaggctcgtggccagggtcgccctccagagcgaggatgtcgagctcgtcgccgtcaacgaccccttcatcaccacggattacatgacctacatgttcaagtatgacaccgtgcacggccactggaagcacagtgaaatcaccctcaaggactccaagacccttctcttcggtgagaagccagtcaccgtctttggcatcaggaaccctgaggagatcccgtggggtgaggctggtgctgactatgtcgtggagtccactggtgtcttcactgacaaggacaaggctgctgcacatctgaagggtggtgccaagaaggttgttatctctgccccaagcaaagatgcacccatgtttgttgttggtgtcaatgaggacaagtacacctcggacattaacattgtttccaatgctagctgcaccacgaactgccttgctccccttgctaaggtcattcatgacaactttggtattattgagggcttgatgacaactgttcatgccatcactgccacccagaagactgttgatggaccctcagccaaggactggagaggtggcagggccgccagcttcaacatcattcccagcagcactggtgctgccaaggctgttggtaaggttcttcctgatttgaatggcaagctcactggtatgtccttccgggttcccacagtggatgtgtcagttgttgacctcactgtcagaatcgagaagggtgcctcctatgaggatatcaagaaagctatcaaggctgcttctgagggcccactcaagggtatcatgggctacgtggaggaggatttggtttccaccgacttcgttggtgacagcaggtcgagcatctttgatgccaaggccgggattgccctgaacgacaacttcatcaagctcgtctcgtggtacgacaacgagtggggctacagcaaccgcgtcgtcgacctgatccgccacatgttcaagacccagtag

SEQ ID NO: 21303 - protein, 337 aa, Sorghum bicolor
  misc_feature: Ceres ANNOT ID no. 8704198
  misc_feature: Down-regulated in shoot tissues in response to aminocyclopropane carboxylic treatment
  misc_feature: Up-regulated in root tissues in response to salicylic acid treatment
  misc_feature (1)..(337): SWISSPROT Homolog: EC 1.2.1.12 Glyceraldehyde-3-phosphate dehydrogenase (phosphorylating)
  misc_feature (159)..(316): Pfam ID: Gp_dh_C Pfam Description: Glyceraldehyde 3-phosphate dehydrogenase, C-terminal domain
  misc_feature (4)..(154): Pfam ID: Gp_dh_N Pfam Description: Glyceraldehyde 3-phosphate dehydrogenase, NAD binding domain
MGKIKIGINGFGRIGRLVARVALQSEDVELVAVNDPFITTDYMTYMFKYDTVHGHWKHSEITLKDSKTLLFGEKPVTVFGIRNPEEIPWGEAGADYVVESTGVFTDKDKAAAHLKGGAKKVVISAPSKDAPMFVVGVNEDKYTSDINIVSNASCTTNCLAPLAKVIHDNFGIIEGLMTTVHAITATQKTVDGPSAKDWRGGRAASFNIIPSSTGAAKAVGKVLPDLNGKLTGMSFRVPTVDVSVVDLTVRIEKGASYEDIKKAIKAASEGPLKGIMGYVEEDLVSTDFVGDSRSSIFDAKAGIALNDNFIKLVSWYDNEWGYSNRVVDLIRHMFKTQ

SEQ ID NO: 21304 - DNA, 2394 bp, Sorghum bicolor
  misc_feature: Ceres ANNOT ID no. 8704239
  misc_feature: Up-regulated in root tissues in response to methyl jasmonate treatment
  misc_feature: Up-regulated in shoot tissues in response to methyl jasmonate treatment
  misc_feature: Down-regulated in shoot tissues in response to salicylic acid treatment
  misc_feature: Encodes the peptide sequence at SEQ ID NO 21305
atgaaagaggaaatcatgtttgacaaccaaacaaagccatgcagatcaagggttgactccaaaagcaattcgagttctctgaaacctaagtttggatcctcatggggttcccaaattgtcaaaggttttacagcagacaagaaaaccaagaagacagcagcaattgcaagcaaaaaaccacctcttgcaaatgtcgaaaatgtcaatcagaccaaccaacagattccgtaccactctagggtgaaaagatcccttatcggggacttcccttgttcacctgctggtgctcaagtccacccccatgtctttgattgccacaatattaggtccccagcatcccatgatctttttcttgagttggatcatctcagggagcaactacgtgagtcgaaagaaagggaattagcattacagtcagagttgcggcaatgcagagaaaacccaaaagtttcagaacttgagaaggagcttgattctatgagggatgaagttgacaggcttgcacgactgaagacttcattagaagctgagaaaacaaacatatctgaacaattatcagctctatcttctatggtagaacatcatgaagaaaatgtaaggttagatggccatggcaaccggatacctagtgtaaatggggacaatacaccttcagaaaacttggagttcgaagttgttgaactacgccggttaaacaaagaactacagtttcagaaacgaaatcttgcaattaagctctcttcagctgaatccaaattggctggccttgagaagaatgcagagagtgatatagttgccaaggttcaagctgaggcatcgttgctgaggcacacaaatgcaaacctaagcaagcaagttgagggattgcaaatgagtcggctaacagaggttgaggagcttgcttatcttcggtggatcaattcatgtctacgccatgagctctgtaactcagatcaagcagctagagcaatgacggatatagattgcaatggtgtcatggcttttaatgagggtgatggtggtgaaggtgatgcaaaaaatgctgaggacagttctgatataaaattcagcattgcagaacgcatcaagcagtggtcccagaatgataagagttgccaagcatctaaaaaggaagcccttcttgatagggcgtggattgaagctgcagaagcacgaagcccgacacgtaggcattcacttggtggaccaaagggatgtgcacaagacttcaacatcattaaaagaaggcaatctgatacctttatcagccttctggatgcaacagatgagtcatttgcctgtaataaggatcctacaatcagggagaagcgtgaccttcttgtggacaagtatgattttggtcgatctgaaagttcaagatttgttctcagcaagccagaagtatgcaagtcacagtgtctggatgttgaaaagcgtgcattgcgcatccctaatcctccaccaagaccttctgtttccgtgtcaaattctggtccatcaaatggatcgactgtaaatccaccacgaccaccgccgccaccgcctcctccaaagttttcctcaaaaagtactggggtcatgaagagggcacctcaggtcgcagagctctaccattcacttatgagaagggacaccaaaaaggatacttccagtggtggaatctgtgaagcagctaactctgcgaatgtgcggagtagcatgattggtgaaatcgagaaccgctcgtcccatttgcaagctatcaaggcagatgttgaaactcagggtgaatttgtgaaatcattgattaaggaggtgactagtgcagcctacaaagatatcgaagatgtggttgcatttgtgaagtggctagatgatgaacttggcttcctagtggatgagagagcagtgttgaagcattttgattggcctgagaagaaggcagacactctacgagaggcagcttttggctaccaggacctgaagaagttggaatcggaagtttcaaactataaagatgatccacgtctaccctgtgaaatcgcgctgaagaaaatggttacactatctgaaaagactgagagaggtgtctacaatcttctaaggacaagagaggctatgatgaggcagtgcaaggagtttaatattccaaccgactggatgcttgataacaatcttattagcaagataaagtttgcatctgtgaaattagcgaagatgtacatgaaaagggttgcaatggagcttcaatacatgggccctctgaataaggatccagctctggagtacatgctgcttcaggctgtgagatttgccttcaggatgcatcagtttgctggaggtttcgacccggagaccatggatgcatttgaagagctgaggaaccttgttcacgtcagaaatagcacccaatag

SEQ ID NO: 21305 - protein, 797 aa, Sorghum bicolor
  misc_feature: Ceres ANNOT ID no. 8704239
  misc_feature: Up-regulated in root tissues in response to methyl jasmonate treatment
  misc_feature: Up-regulated in shoot tissues in response to methyl jasmonate treatment
  misc_feature: Down-regulated in shoot tissues in response to salicylic acid treatment
MKEEIMFDNQTKPCRSRVDSKSNSSSLKPKFGSSWGSQIVKGFTADKKTKKTAAIASKKPPLANVENVNQTNQQIPYHSRVKRSLIGDFPCSPAGAQVHPHVFDCHNIRSPASHDLFLELDHLREQLRESKERELALQSELRQCRENPKVSELEKELDSMRDEVDRLARLKTSLEAEKTNISEQLSALSSMVEHHEENVRLDGHGNRIPSVNGDNTPSENLEFEVVELRRLNKELQFQKRNLAIKLSSAESKLAGLEKNAESDIVAKVQAEASLLRHTNANLSKQVEGLQMSRLTEVEELAYLRWINSCLRHELCNSDQAARAMTDIDCNGVMAFNEGDGGEGDAKNAEDSSDIKFSIAERIKQWSQNDKSCQASKKEALLDRAWIEAAEARSPTRRHSLGGPKGCAQDFNIIKRRQSDTFISLLDATDESFACNKDPTIREKRDLLVDKYDFGRSESSRFVLSKPEVCKSQCLDVEKRALRIPNPPPRPSVSVSNSGPSNGSTVNPPRPPPPPPPPKFSSKSTGVMKRAPQVAELYHSLMRRDTKKDTSSGGICEAANSANVRSSMIGEIENRSSHLQAIKADVETQGEFVKSLIKEVTSAAYKDIEDVVAFVKWLDDELGFLVDERAVLKHFDWPEKKADTLREAAFGYQDLKKLESEVSNYKDDPRLPCEIALKKMVTLSEKTERGVYNLLRTREAMMRQCKEFNIPTDWMLDNNLISKIKFASVKLAKMYMKRVAMELQYMGPLNKDPALEYMLLQAVRFAFRMHQFAGGFDPETMDAFEELRNLVHVRNSTQ

SEQ ID NO: 21306 - DNA, 1569 bp, Sorghum bicolor
  misc_feature: Ceres ANNOT ID no. 8704245
  misc_feature: Up-regulated in shoot tissues in response to salicylic acid treatment
  misc_feature: Up-regulated in root tissues in response to salicylic acid treatment
  misc_feature: Encodes the peptide sequence at SEQ ID NO 21307
atggaggagttcgccctgtgcccaaatcctcatttcgtggtcatcccatggccagtcaccagccacatgattcccatggtggacatcgcctgcctcctcgccgcgcacggcgccccggtcaccatcatcaccccgccttcctgctcccagctcgtccacagccgcgtcgaccgcgcccgcgccgggcaagctgccggctcggcgggcatcggcatcacggtgaccgcgctcccgttcccttgcgccgaagccggcctgccggcgggctgcgagaggctggaccacgtcccctcggtcgacctcgtgcccaacttcttcgacgccaacgcgcagttcggcgacgccgtggcggaccactgccgccttctcatggcgacgccgacgccgacgcgccggccgagctgcatcgtcgccgggatgtgcaacacgtgggcgcacggcgtggcgcgtgagctcggcgtgccctgcttcatcttccatggcttcggcgcgttcgctctgctgtgctgcgagtatctcaacacgcacaagccgcacgagggcaagtcgctggacgaggccatcgacgtccccgtcctgccgccgcctctcgagctcaagttcgccaggaggcagctgccgctacagttcctgccttcgtgctccattccggagagccgccttcgagagctccgggagttcgagatggccgtggacggcatcgtcgtgaacagcttcgaggagctggaacacgactcggccgcgcgcctcgcggccgccacgggcaagaccgtgctcgccgtcggccccgtctcgctgtgcggcggcggcggcggcggcggcgcacgcgcacctcctagcctcctcgacgtccgggccgccaccgacagctcggtgaacgatgacgccagacggtgcatggcatggctagacgccaagaaagccgagtcgtcgtcgtcgtccgtgctgtacgtcagcttcggcagcgccggccgcatgccgccggagcagctgatggagctcgggctggcgctcgtgtcgtgctcctggcctgtcctctgggtcatcaagggcgcggacacgttgcccgacgacgtcgacgagtggctacagcacaacaccggcggcgacgacggccagtgtctcgcggtccgcgggtgggcgccgcaggtggccattctggagcacccggccgtcggcgggtttctgacgcactgcgggtggggctcgacgctggagagcgtcacggcgggcgtgcccatggccacctggccgttctccgccgagcagttcctgaacgagaaggtgatcgttggcgtgctcggcatcggagtgtctgtcggcgtgacgaagcccacggagggcgtgctgaccggcgccaaagacggcggcggcggcggcgctagggcgaaggcggatgtgggaatggagcaggtgaagcgagcgttggatatgctgatggatggaggagtggatggggaggcaaggaggacgaaagctagggagctcaaggccaaagcgaagtcggctttggagcatggaggatcgtcgtatatgaatctggagaagatgatacaatttgcagcttaa

SEQ ID NO: 21307 - protein, 522 aa, Sorghum bicolor
  misc_feature: Ceres ANNOT ID no. 8704245
  misc_feature: Up-regulated in shoot tissues in response to salicylic acid treatment
  misc_feature: Up-regulated in root tissues in response to salicylic acid treatment
  misc_feature (132)..(518): SWISSPROT Homolog: EC 2.4.1.238 Anthocyanin 3'-O-beta-glucosyltransferase
  misc_feature (13)..(499): Pfam ID: UDPGT Pfam Description: UDP-glucoronosyl and UDP-glucosyl transferase
MEEFALCPNPHFVVIPWPVTSHMIPMVDIACLLAAHGAPVTIITPPSCSQLVHSRVDRARAGQAAGSAGIGITVTALPFPCAEAGLPAGCERLDHVPSVDLVPNFFDANAQFGDAVADHCRLLMATPTPTRRPSCIVAGMCNTWAHGVARELGVPCFIFHGFGAFALLCCEYLNTHKPHEGKSLDEAIDVPVLPPPLELKFARRQLPLQFLPSCSIPESRLRELREFEMAVDGIVVNSFEELEHDSAARLAAATGKTVLAVGPVSLCGGGGGGGARAPPSLLDVRAATDSSVNDDARRCMAWLDAKKAESSSSSVLYVSFGSAGRMPPEQLMELGLALVSCSWPVLWVIKGADTLPDDVDEWLQHNTGGDDGQCLAVRGWAPQVAILEHPAVGGFLTHCGWGSTLESVTAGVPMATWPFSAEQFLNEKVIVGVLGIGVSVGVTKPTEGVLTGAKDGGGGGARAKADVGMEQVKRALDMLMDGGVDGEARRTKARELKAKAKSALEHGGSSYMNLEKMIQFAA

SEQ ID NO: 21308 - DNA, 960 bp, Sorghum bicolor
  misc_feature: Ceres ANNOT ID no. 8704266
  misc_feature: Down-regulated in shoot tissues in response to methyl jasmonate treatment
  misc_feature: Down-regulated in root tissues in response to methyl jasmonate treatment
  misc_feature: Down-regulated in shoot tissues in response to salicylic acid treatment
  misc_feature: Encodes the peptide sequence at SEQ ID NO 21309
atggcgatcaagcggaccaaggcggagaagaagatcgcgtacgacaagaagctctgcagcctgctcgatgagtacaccaaggtgctcatcgccctcgccgacaacgtcggctccaagcagctccaggacatccgccggggcctcaggggcgactcggtggtgctcatgggcaagaacacgctcatcaggcgctgcatcaaggcctacgccgagaagaccggcaaccacacctttgacccgctcatggacctcctcgtcggcaacgtcggcctcatcttcaccaagggagacctcaaggaagtgcgtgaggaggtcgccaagtacaaggttggggcccctgcccgtgttggtctggttgctccagttgatgttgttgtgccccctggcaacactgggctggatccctcccagacctctttcttccaggtgcttaacatccccaccaagattaacaagggtactgtggaaattatcacccctgtggagctgatcaagaagggtgacaaggtgggctcatccgagtctgccctgcttgccaagctgggtatccgtcccttctcatacggtcttcaggtcaccaatgtctatgaggatgggtctgtgttcagtcctgaggtgcttgacctttctgaggaggacctgattgagaagtttgccactggtgtctccatggttgcctctctgtccctggcaatctcatacccgacccttgctgctgtgccccacatgttcatcaatgggtacaagaatgttcttgctgttgctgtggagacggactactcgtacccacatgctgacaagatcaaggagtacctaaaggacccgagcaagtttgctgttgctgcccctgtcgccggtgcggactctggtgctgcagctgctcccaaggaggaagagaaggctccagagcctgaagaggagtcggacgaggaaatgggcttcagcctgttcgacgactag

SEQ ID NO: 21309 - protein, 319 aa, Sorghum bicolor
  misc_feature: Ceres ANNOT ID no. 8704266
  misc_feature: Down-regulated in shoot tissues in response to methyl jasmonate treatment
  misc_feature: Down-regulated in root tissues in response to methyl jasmonate treatment
  misc_feature: Down-regulated in shoot tissues in response to salicylic acid treatment
  misc_feature (3)..(318): SWISSPROT Homolog: EC 4.2.99.18 DNA-(apurinic or apyrimidinic site) lyase
  misc_feature (6)..(110): Pfam ID: Ribosomal_L10 Pfam Description: Ribosomal protein L10
  misc_feature (227)..(317): Pfam ID: Ribosomal_60s Pfam Description: 60s Acidic ribosomal protein
MAIKRTKAEKKIAYDKKLCSLLDEYTKVLIALADNVGSKQLQDIRRGLRGDSVVLMGKNTLIRRCIKAYAEKTGNHTFDPLMDLLVGNVGLIFTKGDLKEVREEVAKYKVGAPARVGLVAPVDVVVPPGNTGLDPSQTSFFQVLNIPTKINKGTVEIITPVELIKKGDKVGSSESALLAKLGIRPFSYGLQVTNVYEDGSVFSPEVLDLSEEDLIEKFATGVSMVASLSLAISYPTLAAVPHMFINGYKNVLAVAVETDYSYPHADKIKEYLKDPSKFAVAAPVAGADSGAAAAPKEEEKAPEPEEESDEEMGFSLFDD

SEQ ID NO: 21310 - DNA, 708 bp, Sorghum bicolor
  misc_feature: Ceres ANNOT ID no. 8704364
  misc_feature: Up-regulated in shoot tissues in response to salicylic acid treatment
  misc_feature: Encodes the peptide sequence at SEQ ID NO 21311
atgccgctctgggggtccgccgcgtccgcgccgccggcagccgagggcgacgccgcccgcgcaccatccgggtccgccggcggcagcggcggcggcggcggcggcgtcaaggtgatccggtcgctgctccccacccggcgccgcctccgcctcgacccgcccgccaagctttacttcccatatgaacccggcaagcaagtccggagtgctgtcaggatcaagaacatcagcaagtcccatgtagccttcaagttccaaacgactgcacccaagagttgcttcatgaggcctcctggcagcgtacttgctccaggggaaagcatcatagcaacagttttcaagtttgtggagcatccggagaacaatgagaagccattggacaagtgcaaggttaagttcaagattgtcagcctcaaagtcaaagggccggtggagtatgtccctgaattgtttgatgagcagaaagaccaggttgcagtcgagcaaattttgcgggtagtattcttggatgctgagcgcccaagcccacaaatggacaaactcaagcgccagcttgctgaagcagaagcagcgctagaggcacgcaagaaacctccagaggacaatagtccccgtattgttggtgaaggccttgtgattgacgaatggaaggaacgaagagagagataccttgctcgccagcagatcgaaggtgttgattcagtgtag

SEQ ID NO: 21311 - protein, 235 aa, Sorghum bicolor
  misc_feature: Ceres ANNOT ID no. 8704364
  misc_feature: Up-regulated in shoot tissues in response to salicylic acid treatment
  misc_feature (48)..(160): Pfam ID: Motile_Sperm Pfam Description: MSP (Major sperm protein) domain
MPLWGSAASAPPAAEGDAARAPSGSAGGSGGGGGGVKVIRSLLPTRRRLRLDPPAKLYFPYEPGKQVRSAVRIKNISKSHVAFKFQTTAPKSCFMRPPGSVLAPGESIIATVFKFVEHPENNEKPLDKCKVKFKIVSLKVKGPVEYVPELFDEQKDQVAVEQILRVVFLDAERPSPQMDKLKRQLAEAEAALEARKKPPEDNSPRIVGEGLVIDEWKERRERYLARQQIEGVDSV

SEQ ID NO: 21312 - DNA, 1146 bp, Sorghum bicolor
  misc_feature: Ceres ANNOT ID no. 8704449
  misc_feature: Down-regulated in root tissues in response to salicylic acid treatment
  misc_feature: Down-regulated in shoot tissues in response to salicylic acid treatment
  misc_feature: Encodes the peptide sequence at SEQ ID NO 21313
atggactccacgccggcacccgaggcggctcccggcgcctcctcttcctctgcagctgccgccgaggatctggcgggggccgtggcggcgatgagcctggacgagcggttcgatctgctgcgggggattggggaggagtgcatccaggaggacgagctcaggaacctgcttcagaagaagcccgtccccatctgctacgacggcttcgagccctctggacgcatgcacatcgctcagggcattgtgaaaaccatcaacgtgaacaagatgatcagggccgggtgcagggtgaaaatttggatcgccgactggtttgcgcagctcaacaacaagatgggaggtgacctgaagaaaatccagacggtggggcgctacatgatcgagatatggaaagcggctgggatgaacctcgacggggtcgagttcctgtggtcctccgaggagatcaacagccgcgcgcatgagtactggccaattgtgatggacattgcccggaaaaataacgtcaagaggataacgagatgctgccaaattatgggcagaagtgagtcagacgacttgactgctgcccagattttctacccttgcatgcaatgtgcagatatatttttcttgaaggctgacatatgccagttggggatggaccaacggaaggtcaatatgctagctagggagtactgcgatgacatcaaaaggaagaacaaaccgattattctttcacatcatatgctccctggttttaaagaaggccaggagaaaatgtcaaagagtgatccatcctcggctatctttatggaagatgatgaggcccaggttaatgtgaagataaagcaagctttttgccctcccaaaattgttgaggggaatccttgtttggagtacattaaatacattgttttcccttggtttggaaggtttgaggtcgtccgtaaggaaatcaatggtggtaacaagacatttacaagcatgggtgaactaatttctgattatgagacgggtgctttgcatcctgccgatgtcaaacctgcactagcaaaagcaataaatgaaattttgcagcctgttcgtgatcacttcaacaacaacaacgaagccaaagttctacttaacactgtcaagacgtgggagaatagatgtgtagtgtag

SEQ ID NO: 21313 - protein, 381 aa, Sorghum bicolor
  misc_feature: Ceres ANNOT ID no. 8704449
  misc_feature: Down-regulated in root tissues in response to salicylic acid treatment
  misc_feature: Down-regulated in shoot tissues in response to salicylic acid treatment
  misc_feature (34)..(376): SWISSPROT Homolog: EC 6.1.1.1 Tyrosine--tRNA ligase
  misc_feature (58)..(353): Pfam ID: tRNA-synt_1b Pfam Description: tRNA synthetases class I (W and Y)
MDSTPAPEAAPGASSSSAAAAEDLAGAVAAMSLDERFDLLRGIGEECIQEDELRNLLQKKPVPICYDGFEPSGRMHIAQGIVKTINVNKMIRAGCRVKIWIADWFAQLNNKMGGDLKKIQTVGRYMIEIWKAAGMNLDGVEFLWSSEEINSRAHEYWPIVMDIARKNNVKRITRCCQIMGRSESDDLTAAQIFYPCMQCADIFFLKADICQLGMDQRKVNMLAREYCDDIKRKNKPIILSHHMLPGFKEGQEKMSKSDPSSAIFMEDDEAQVNVKIKQAFCPPKIVEGNPCLEYIKYIVFPWFGRFEVVRKEINGGNKTFTSMGELISDYETGALHPADVKPALAKAINEILQPVRDHFNNNNEAKVLLNTVKTWENRCVV

SEQ ID NO: 21314 - DNA, 3171 bp, Sorghum bicolor
  misc_feature: Ceres ANNOT ID no. 8704729
  misc_feature: Up-regulated in root tissues in response to methyl jasmonate treatment
  misc_feature: Up-regulated in shoot tissues in response to methyl jasmonate treatment
  misc_feature: Encodes the peptide sequence at SEQ ID NO 21315
atggacaaacaacctgatgcgcggggggcggagaaggttgctgaggagaagcaacttgatgagaaagagttagagaggaagctgaaaaaagatcaaaaggcaaaagagaaagaagagaaaaaacttaaggcaaaacaaaaggaggtggctaggctccaggcacaagcaaactcagatggagcaaagaagaccgagaaaaaacaaaggaagaaagctgtcgaggatgaaaatccacaggatttcatagacccagacactcctaatgggcagaagaaattgctcgcatctcagatggccaagcaatacagcccaagtgcagttgagagatcatggtatgcctggtgggaatcatcaggatattttggggcagatcctgcaagcacaaaaccaccatttgttatagttctgccacctccaaatgtgactggagctcttcatatcggccatgcacttacagtggctatagaggatgctatgatacgctggcgtaggatgtcaggctacaatgctctgtgggtccctggagtggaccatgctggcattgctacacaggttgttgtagaaaagaagcttatgcgtgaaaggaagctgacaaggcatgacatagggcgtgaaaattttatttctgaagtactcaaatggaaagatcaatatggtggtaccatattgaatcaattgcgccggcttggggcttcacttgattggtcccgtgaggcttttacaatggatgagcaaagatcaaaagccgtaactgaagcttttgtcaggttgcacaaggagggcctgatatatagagattatcgccttgttaattgggattgcacacttcgaactgcaatttctgacattgaggttgatcatattgatcttaaagaagaaactatgttaaaggtccctggttatgccaatcctgtacagtttggtgtattgatatcttttgcctatcctcttgaggaaggacttggtgagattgttgtagcaaccaccagaatagaaacaatgctgggcgatacagcaatagctgttcaccccgaggatgaaaggtataagcatctgcatggaagatatgcagtccaccccttcaatggacgaaaactcaaaataatctgtgatgctgagttagttgatcccactttcggtactggggctgtcaagattactcctgcccatgatccaaatgactttgaggttggaaagcgtcataaccttgaattcatcaatatattcacagatgatggaaaaataaatagcaatggaggtgcacaattcgatggaatgcctagatttgccgctcgagttgctgttattgaggcactgaaggaaaaggggttgtataaggacacaaagaagaatgaaatgagtttgggcgtttgttcaagaactaatgatgtagtggaacctatgataaaaccacagtggtttgttaattgcagctccatggccaaggcaggccttgacgctgtaaggtcaaaaaagattgaaattattccccagcagtatgagcaagactggtacagatggcttgaaaatatacgtgattggtgtgtctcgagacaactttggtggggacatcgtatacctgcatggtatgtgacactagaagatgacctggataaaaaccttggttccaacaatgaccgctggatagttgcaagaaatgaaagcgatgcaaaccttgaggcacagaaaaagtatccaggaacaaaattacgtctagatcaagaccctgatgtgctggacacatggttttcatctggtcttttccccttaacagtacttggttggccgtctgataccgctgacctccgtgctttctaccctacatcggtactagaaactggacttgatattctcttcttttgggtagcaaggatggtgatgatgggaatgcaacttggtggtgatgtgccatttcagaaggtttatttacatcctatgattcgggatgcacatggccgaaagatgtcaaaatcacttggtaacgttgttgaccctcttgaggtgataaatggcatgtcactggatggtcttctgaaacgtttggaagaaggcaatctggatccaaatgaactaaatatcgcaagagatgggaagaagaaggatttccctgatggcatagcagaatgtggtaccgatgccctccgcttcgcactgatatcgtacacttcccagtctgacaggataaatcttgatatcaagagggtggttggatacagacaatggtgcaacaaattatggaatgccatccgttttgcgatgggcaaactgggtgatcattacattccgccagcaactgttgatgtgtctcttatgccaccaatctgcaagtggatactctcggtgcttaacaaagctgttgggaaaaccgttacttctttagaagcatacaaattgtctgatgcaacatctgctatatactcatggtggcagtatcagctatgtgatgtatttatagaagctatcaaaccttacttcttcaacgattctcaagagtttgaatcagcaagagctgcctccagagataccctgtggatttgcctggagactggtctacgcctgctccacccattcatgccctatgtaacagaagagctctggcagcgtcttccacagcccaaagattcttgcaggaaagattcaattatgatttcagagtatccatctcctgttgaggaatggagtaatggcggacttgaaaatgaaatggacattgtcttggatgctgtcaacaaaataaggtctctgaagccaccaacagattcaaacgaaagacggcctgcttttgcactttgccgagggcaagagattgctgccactatccaatgctatcaatctctaatcgtgtttctttcttccatatcacatctcaagatcctgacggagaacgatgaaactccagctgattctgcaactgctgttgtcaacaaagacttgtctgtgtaccttcagctccaaggagctttaaatgcagatgctgaacgtgaaaagctaaggaagaaaaaagacgaaattcaaaagctacaaaatgcactggcacaaaaaatggacgcctctggctatcgcgagaaggctccacagagcgtgcaggaagaggacatgagaaagctcaccgctttgttggaacaactagaggtcatcagtgaagctgagaagaaattagatgcaaactga

SEQ ID NO: 21315 - protein, 1056 aa, Sorghum bicolor
  misc_feature: Ceres ANNOT ID no. 8704729
  misc_feature: Up-regulated in root tissues in response to methyl jasmonate treatment
  misc_feature: Up-regulated in shoot tissues in response to methyl jasmonate treatment
  misc_feature (49)..(1055): SWISSPROT Homolog: EC 6.1.1.9 Valine--tRNA ligase
  misc_feature (110)..(731): Pfam ID: tRNA-synt_1 Pfam Description: tRNA synthetases class I (I, L, M and V)
  misc_feature (775)..(930): Pfam ID: Anticodon_1 Pfam Description: Anticodon-binding domain
MDKQPDARGAEKVAEEKQLDEKELERKLKKDQKAKEKEEKKLKAKQKEVARLQAQANSDGAKKTEKKQRKKAVEDENPQDFIDPDTPNGQKKLLASQMAKQYSPSAVERSWYAWWESSGYFGADPASTKPPFVIVLPPPNVTGALHIGHALTVAIEDAMIRWRRMSGYNALWVPGVDHAGIATQVVVEKKLMRERKLTRHDIGRENFISEVLKWKDQYGGTILNQLRRLGASLDWSREAFTMDEQRSKAVTEAFVRLHKEGLIYRDYRLVNWDCTLRTAISDIEVDHIDLKEETMLKVPGYANPVQFGVLISFAYPLEEGLGEIVVATTRIETMLGDTAIAVHPEDERYKHLHGRYAVHPFNGRKLKIICDAELVDPTFGTGAVKITPAHDPNDFEVGKRHNLEFINIFTDDGKINSNGGAQFDGMPRFAARVAVIEALKEKGLYKDTKKNEMSLGVCSRTNDVVEPMIKPQWFVNCSSMAKAGLDAVRSKKIEIIPQQYEQDWYRWLENIRDWCVSRQLWWGHRIPAWYVTLEDDLDKNLGSNNDRWIVARNESDANLEAQKKYPGTKLRLDQDPDVLDTWFSSGLFPLTVLGWPSDTADLRAFYPTSVLETGLDILFFWVARMVMMGMQLGGDVPFQKVYLHPMIRDAHGRKMSKSLGNVVDPLEVINGMSLDGLLKRLEEGNLDPNELNIARDGKKKDFPDGIAECGTDALRFALISYTSQSDRINLDIKRVVGYRQWCNKLWNAIRFAMGKLGDHYIPPATVDVSLMPPICKWILSVLNKAVGKTVTSLEAYKLSDATSAIYSWWQYQLCDVFIEAIKPYFFNDSQEFESARAASRDTLWICLETGLRLLHPFMPYVTEELWQRLPQPKDSCRKDSIMISEYPSPVEEWSNGGLENEMDIVLDAVNKIRSLKPPTDSNERRPAFALCRGQEIAATIQCYQSLIVFLSSISHLKILTENDETPADSATAVVNKDLSVYLQLQGALNADAEREKLRKKKDEIQKLQNALAQKMDASGYREKAPQSVQEEDMRKLTALLEQLEVISEAEKKLDAN

SEQ ID NO: 21316 - DNA, 2097 bp, Sorghum bicolor
  misc_feature: Ceres ANNOT ID no. 8704939
  misc_feature: Down-regulated in shoot tissues in response to methyl jasmonate treatment
  misc_feature: Encodes the peptide sequence at SEQ ID NO 21317
atgggcgtgccggcgttctaccggtggctggcggagaagtacccgatggtggtggtggacgtggtggaggaggagcccgtcgagatcgagggcgtccgggtccccgtcgacacctccaagcccaaccccaacggcctcgagttcgacaacctctacctcgacatgaacggcatcatacacccctgcttccaccccgaggataggccatccccaacaacatttgctgaggttttcaagtgcatgttcgattacatcgatagactcttcatcatggttcgccctaggaagcttatgtacatggctattgatggtgtggctccacgtgctaaaatgaaccaacaacgttctagacgattcagagctgcgaaagatgcagctgatgcggctgcagaggaagaacggttgcgtgaagagtttgagagggaaggaagaagacttcctgcaaaacagcaatcacagacttgtgactctaacgttattactccaggaactgagtttatggctgttctttcaattgctttacagtactacatccatcaaagactgaattatgatcctggatggaaaaaaattaaagttattctgtctgatgccaatgttcctggtgaaggggaacataaaataatgtcgtatattcgtggtcaacggaatctccccggatttaatccaaacacccgccattgcttgtatggcctggatgcagacctcataatgttagctttagcaactcatgaagtccacttttctatattgagagaggtagtttttacacctggacagcaggacaagtgcttcttatgtggtcaggtgggacatctagccgctaattgtgaaggaaaagcaaaaagaaaagctggcgaatatgatgagaaaggtgaagctattgttccaaagaaaccataccagtttttgaatatctggacccttcgggagtacttagaatatgagttcagaatgcctaatccgcctttccagattgattttgaacgcattgttgatgatttcatcttcatatgctttttcgttggcaatgattttcttccacatatgccaacactagagatcagggagggagctattaatctgttaatggctgtgtacaagaaagaatttccttcaatgggtggctatctaacagattcttgcacgcctgatctgaatagagttgaacacttcattcaagcagttggctcttatgaagataaaatatttcagaaaagggctcgtttgcatcagcgtcaatcagaaagaataaaacgggaaaaggcccaagcaaagcgtggggatgatctggatccccatgtcagagatgatcttattgtacctgttgcaaatttccgagggtctcgccttgcatctggagcagtaccttcaccatatgaacagaatggatctcgtagagaaaggaacagccaagctctgaaagctccaagagtatcatcatcaggttccagcattgctgctgctattgttgaagctgaaaaagatcttgaagcacaggagcttgaaaacaaagaaaatttgaagtctatgcttaaggatgctcttcgtgggaaatcagatgtcttcaattctgaaaatccagaggaggacaaggtaaagcttggagaaccaggatggagggataggtactatgaagacaagtttggggcaaggacacctgaacggatggaagaaattcgtagggatgttgctctcaaatatactgaaggattgtgttgggtgatgcactactactatgaaggggtctgctcatggcagtggttttatccttatcattatgctccttttgcttcggatttaaggagtttgagtcagctcaatataacttttgaacttgggttgccattcaagccatttgatcagctaatgggggttttccctgctgcaagtgctcatgcacttcctctaaagtatcggcaactgatgactgatccaaattcaccaatagttgatttttatccaactgattttgaagtagatatgaatgggaaaagattctcttggcaggggatagcaaaactgccctttatagatgaagaccggttgctggctgagattaaaaaagttgagcatactttgacggtatggaaatga

SEQ ID NO: 21317 - protein, 698 aa, Sorghum bicolor
  misc_feature: Ceres ANNOT ID no. 8704939
  misc_feature: Down-regulated in shoot tissues in response to methyl jasmonate treatment
  misc_feature (1)..(255): Pfam ID: XRN_N Pfam Description: XRN 5'-3' exonuclease N-terminus
  misc_feature (262)..(279): Pfam ID: zf-CCHC Pfam Description: Zinc knuckle
MGVPAFYRWLAEKYPMVVVDVVEEEPVEIEGVRVPVDTSKPNPNGLEFDNLYLDMNGIIHPCFHPEDRPSPTTFAEVFKCMFDYIDRLFIMVRPRKLMYMAIDGVAPRAKMNQQRSRRFRAAKDAADAAAEEERLREEFEREGRRLPAKQQSQTCDSNVITPGTEFMAVLSIALQYYIHQRLNYDPGWKKIKVILSDANVPGEGEHKIMSYIRGQRNLPGFNPNTRHCLYGLDADLIMLALATHEVHFSILREVVFTPGQQDKCFLCGQVGHLAANCEGKAKRKAGEYDEKGEAIVPKKPYQFLNIWTLREYLEYEFRMPNPPFQIDFERIVDDFIFICFFVGNDFLPHMPTLEIREGAINLLMAVYKKEFPSMGGYLTDSCTPDLNRVEHFIQAVGSYEDKIFQKRARLHQRQSERIKREKAQAKRGDDLDPHVRDDLIVPVANFRGSRLASGAVPSPYEQNGSRRERNSQALKAPRVSSSGSSIAAAIVEAEKDLEAQELENKENLKSMLKDALRGKSDVFNSENPEEDKVKLGEPGWRDRYYEDKFGARTPERMEEIRRDVALKYTEGLCWVMHYYYEGVCSWQWFYPYHYAPFASDLRSLSQLNITFELGLPFKPFDQLMGVFPAASAHALPLKYRQLMTDPNSPIVDFYPTDFEVDMNGKRFSWQGIAKLPFIDEDRLLAEIKKVEHTLTVWK

SEQ ID NO: 21318 - DNA, 1164 bp, Sorghum bicolor
  misc_feature: Ceres ANNOT ID no. 8704954
  misc_feature: Up-regulated in shoot tissues in response to salicylic acid treatment
  misc_feature: Encodes the peptide sequence at SEQ ID NO 21319
atgataccttccgtgaggctctctcctggtcctgcagccttctcaggctccagcctacgctcaaaattaccgtcaattccatccatctctagtcttaaaccctccaaatatgtggtctcctcgctgaaaccactctacctagcaccgctagatggtccacgcactgcagagcttaagtctcggagacagccactcgagttccgttgcgctgcttctgctgccgatgacaaggagtcaaagactaaggcggtgccagttcagtcagaaggcgcgcagaggctaaagatttccatctatttcgcgacctggtgggcgcttaatgtgatatttaacatttataacaagaaggttctcaatgctttcccttacccttggctcacctccacactctccctcgcctgtggctctgcgatgatgcttttctcttgggccacccgccttgttgaggcccccaagactgatctagacttctggaaagtccttttcccggtcgctgtggcacatacaattggccatgttgctgcgacagtgagcatgtctaaggtggcagtgtcatttacacacataattaaaagcgcagaacctgcattcagtgttttggtgtcaagattcatccttggggagacgtttccagtcccagtctatctttctctccttcctatcattggtggttgtgctctagctgctgtcacagagctgaactttaatatggttggatttatgggtgccatgatatccaaccttgcattcgttttccgcaacatcttctcgaagaggggcatgaaggggaagtctgtcagtggcatgaattactatgcttgcctgtcaataatgtccctggtcatactgactccatttgctatagctatggaaggccctcaaatgtgggctgctggttggcaaaaggctcttgcagaagttggacccaatgttatctggtggattgctgcacaaagcgtgttctaccacttatataaccaggtgtcctacatgtctctcgatcagatttctccattgacgtttagcattggcaatacaatgaagcgtatatcagtgattgtttcatcgatcattatcttccacacacctgtacgccctgtcaatgcactgggagctgccattgccatccttggcacattcctgtactctcaggcaaaggcgtga

SEQ ID NO: 21319 - protein, 387 aa, Sorghum bicolor
  misc_feature: Ceres ANNOT ID no. 8704954
  misc_feature: Up-regulated in shoot tissues in response to salicylic acid treatment
  misc_feature (239)..(384): Pfam ID: TPT Pfam Description: Triose-phosphate Transporter family
MIPSVRLSPGPAAFSGSSLRSKLPSIPSISSLKPSKYVVSSLKPLYLAPLDGPRTAELKSRRQPLEFRCAASAADDKESKTKAVPVQSEGAQRLKISIYFATWWALNVIFNIYNKKVLNAFPYPWLTSTLSLACGSAMMLFSWATRLVEAPKTDLDFWKVLFPVAVAHTIGHVAATVSMSKVAVSFTHIIKSAEPAFSVLVSRFILGETFPVPVYLSLLPIIGGCALAAVTELNFNMVGFMGAMISNLAFVFRNIFSKRGMKGKSVSGMNYYACLSIMSLVILTPFAIAMEGPQMWAAGWQKALAEVGPNVIWWIAAQSVFYHLYNQVSYMSLDQISPLTFSIGNTMKRISVIVSSIIIFHTPVRPVNALGAAIAILGTFLYSQAKA

SEQ ID NO: 21320 - DNA, 1809 bp, Sorghum bicolor
  misc_feature: Ceres ANNOT ID no. 8705058
  misc_feature: Down-regulated in shoot tissues in response to salicylic acid treatment
  misc_feature: Encodes the peptide sequence at SEQ ID NO 21321
atggagtcggcggcgattgggtcgcagtccccgctctccttcccctccagcctctgcaaagcaaaagtgtcctctggtttaccaatatacaatgtgaagatcaagagcaatcacaggcttgaggtggtttgccgtgggatgttagctacaagaaagtttatgcaaaggaaaaagaaagaagaagttttcaaggatgctgctgatgaggccgagcagatgaattggaggagaatgatgagagagatagaggaggcaggatcagctgtacccattctgaagactcagcggagcgggaaagggccacttccaagagatgttatccttgggactctcgtgcggttcaaacaactgaaaaaatggaatattgtcagtgagattcttgaatggctcagaacacagcattggtgggacttcagtgagatggacttcttgatgcttgtgacagcttatggaaagttgggggattttagcagggcagaaagggtcctaaagtacatgaacaagaaaggttaccagcctagcgtcatatcacaaactggtctgatggaggcatatggaagagggaagcagtaccgtaaggctgaagcagtattccgtaggatgcaaacatcaggccctgaaccatcacctgtgacatatcaaatcatcttgaaatctttagttgagggtgacaaatataaggaagctgaagctatatttgaggacctccttaatgaaaaaagaacttcttttaagccagaccagaagatgtttcatatgatgatttatatgtacaagaaagctggtgactatgcccaggcacggaagctatttgcacagatgtcggagagaaaaattccactatctacagtcacttttaatagtttgatgtcatttgagacagactacaaggaagtttcaagtatttatgatcagatgcaaagagctggaatgaaaccagatgttgtgagctattccctgctcatcaaagcttatgggaaagccagaagggaagaagaagcattggcggtttttgaagagatgcttgatgctggagtcaggccgacacgcaaatcatataacattttgcttgatgcatttgcaatatctggattggtagacgaggctaatacagttttcaaggcaatgagaagacacagggttgagcctgatctttgctcttatacaactatggtcttagcttatgtaaatgcatctgacatgaatggagcagagaaattctttcgtaggattaaagatgatggtctgaagcccaatgttgtggtttatggtactctgatgaaaggctattcaaagttaaataatgttgagaaagttatgcgggtgtatgagagaatgcggatccagggtgttgaacccaaccagactatatatactactatcatggatgcacatggcaggaactcagattttggaaatgctgtcatttggttcaaagaaatggaagctcgtggatacccaccagaccagaaagcaaaaaatatcctactttcacttgccaacacaccagaagaacaacaagaagcgaatgaattggtaggtaatggtgcaattcagctggaagtgaaacctgataatgaagaggtggatgatgatgggcatgaagttatacatactgatgctggaagtcaccgtttgcttgacgacacacaaacaagaaaccacgtaaatggtaggatcagagctggtaattatacttttgatgaggatgataacgatgatgacgacgatgattatgaggaagaggatgatgaagagttcaattttgtttctttcaaagataagagagaactaaattttgcaagttga

SEQ ID NO: 21321 - protein, 602 aa, Sorghum bicolor
  misc_feature: Ceres ANNOT ID no. 8705058
  misc_feature: Down-regulated in shoot tissues in response to salicylic acid treatment
  misc_feature (316)..(350): Pfam ID: PPR Pfam Description: PPR repeat
  misc_feature (421)..(455): Pfam ID: PPR Pfam Description: PPR repeat
  misc_feature (351)..(385): Pfam ID: PPR Pfam Description: PPR repeat
  misc_feature (386)..(420): Pfam ID: PPR Pfam Description: PPR repeat
  misc_feature (456)..(490): Pfam ID: PPR Pfam Description: PPR repeat
  misc_feature (141)..(175): Pfam ID: PPR Pfam Description: PPR repeat
MESAAIGSQSPLSFPSSLCKAKVSSGLPIYNVKIKSNHRLEVVCRGMLATRKFMQRKKKEEVFKDAADEAEQMNWRRMMREIEEAGSAVPILKTQRSGKGPLPRDVILGTLVRFKQLKKWNIVSEILEWLRTQHWWDFSEMDFLMLVTAYGKLGDFSRAERVLKYMNKKGYQPSVISQTGLMEAYGRGKQYRKAEAVFRRMQTSGPEPSPVTYQIILKSLVEGDKYKEAEAIFEDLLNEKRTSFKPDQKMFHMMIYMYKKAGDYAQARKLFAQMSERKIPLSTVTFNSLMSFETDYKEVSSIYDQMQRAGMKPDVVSYSLLIKAYGKARREEEALAVFEEMLDAGVRPTRKSYNILLDAFAISGLVDEANTVFKAMRRHRVEPDLCSYTTMVLAYVNASDMNGAEKFFRRIKDDGLKPNVVVYGTLMKGYSKLNNVEKVMRVYERMRIQGVEPNQTIYTTIMDAHGRNSDFGNAVIWFKEMEARGYPPDQKAKNILLSLANTPEEQQEANELVGNGAIQLEVKPDNEEVDDDGHEVIHTDAGSHRLLDDTQTRNHVNGRIRAGNYTFDEDDNDDDDDDYEEEDDEEFNFVSFKDKRELNFAS

SEQ ID NO: 21322 - DNA, 1890 bp, Sorghum bicolor
  misc_feature: Ceres ANNOT ID no. 8705095
  misc_feature: Up-regulated in root tissues in response to methyl jasmonate treatment
  misc_feature: Up-regulated in shoot tissues in response to methyl jasmonate treatment
  misc_feature: Up-regulated in root tissues in response to salicylic acid treatment
  misc_feature: Encodes the peptide sequence at SEQ ID NO 21323
atgaggcagcacactggtaaacgtccccgccaacacagggaatatgaaagagaagaaaggaaggaccaacacaagaggccatttccccatgctcaggaaagctctaataatgatggattggttctttaccgtatactctgtccagacagtttgattggtagtgtcataggaaagaatggcaatgtgataaatgctatccggcaacagacaagtgccaaagtcaaggttgttgacccgtaccctggtgcagacaaaagggttatcttggtatattgctacgtcaagcatagagaccttgatgctgaggttgatgacaatgagcctgtttgtgcagctcaagatgcattacttagggtgcacaatgcaattgttgatacattacataggaatcgtagagactctgataagaagaatacagaggaagctaacattcttgtgccagctagtcaggcgtcaaatgttataggaaaatctggtgctgtcatcaaacatcttcggtcaacatcaagagcattcattaaagtgagcccaaaagatccaagtgacgctacacattcatgtgctatgagttttgataattttgttcagataactggtggtgctgaagctgttaaaaaagcactatttggagtatcaaccatcatctacaagcacccatcaaaagagaacattcctcttgaaacttccattcctgagcctactccaagcattataatcccttctgaacttcctgtctatccagctagtaacttttactcggccccagatgctgctataccttctgtacatccaagcctgtctatcttagggtcaacacatcatgttcctgaacttgctctacctgccgatgatcatggtcgactgcctatttatccatctattcttccagttattcctacttatagtgccccaaaatgttcaggagaacttgaatttcgtgttttatgccctagtggcaaaattggcttggttattggtagaggtggggctaccataaagaatataaggcaagaaagtggtgcaaggatagatgttgatgatgcaaagaatgacagggaggaaagtatcattaccattacatccactgaggccatcgatgatgttaaatctgccgctgtggaagctgttttgctgcttcaagccaagatcaatgattatgaggatgatagaatgaatcttcgccttcttgtcccaaataaggttataggctgtcttattggcaggggtggttcaatagtcaatgacatgaggaagaagactaaggcaaacatcctcatttcgaagggcgataagccccggagagcatcttccagtgacgaacttgttgaggtatctggagaagcagacaagctgcgtgatgctcttgttcagataattttgagacttagggaagatgttctgaaagagagtgttgaaagccaaaattctgacagggatggcaagctaactgttgccacctctgattccttatatggaagcagtctttctttgcctgcattattacctcacaacccacaaattgcccccttgagctatgatagaagaggtgaatctgagagagctctggaagtattccctcgtaccagttcatatgggtatagctccatgcaggtcactgatgatggctacggtggacttccatcatatacatcaaaggcatatgaagaacatctaccacgtgacgaaatgactatccctgctagtggtctgtcaaaagtaatgggaaaacgtggcacaaatttggacaacattagaaagatttctggagctcacattgaaattattgaatcaaaatcctctcgtcatgaccatattgcttacatatctggaacctctgaacagaggcagtcagctgagaatttgatcaaagctttcataatgtctacctag

SEQ ID NO: 21323 - protein, 629 aa, Sorghum bicolor
  misc_feature: Ceres ANNOT ID no. 8705095
  misc_feature: Up-regulated in root tissues in response to methyl jasmonate treatment
  misc_feature: Up-regulated in shoot tissues in response to methyl jasmonate treatment
  misc_feature: Up-regulated in root tissues in response to salicylic acid treatment
  misc_feature (311)..(372): Pfam ID: KH_1 Pfam Description: KH domain
  misc_feature (392)..(458): Pfam ID: KH_1 Pfam Description: KH domain
  misc_feature (141)..(211): Pfam ID: KH_1 Pfam Description: KH domain
  misc_feature (560)..(622): Pfam ID: KH_1 Pfam Description: KH domain
  misc_feature (42)..(94): Pfam ID: KH_1 Pfam Description: KH domain
MRQHTGKRPRQHREYEREERKDQHKRPFPHAQESSNNDGLVLYRILCPDSLIGSVIGKNGNVINAIRQQTSAKVKVVDPYPGADKRVILVYCYVKHRDLDAEVDDNEPVCAAQDALLRVHNAIVDTLHRNRRDSDKKNTEEANILVPASQASNVIGKSGAVIKHLRSTSRAFIKVSPKDPSDATHSCAMSFDNFVQITGGAEAVKKALFGVSTIIYKHPSKENIPLETSIPEPTPSIIIPSELPVYPASNFYSAPDAAIPSVHPSLSILGSTHHVPELALPADDHGRLPIYPSILPVIPTYSAPKCSGELEFRVLCPSGKIGLVIGRGGATIKNIRQESGARIDVDDAKNDREESIITITSTEAIDDVKSAAVEAVLLLQAKINDYEDDRMNLRLLVPNKVIGCLIGRGGSIVNDMRKKTKANILISKGDKPRRASSSDELVEVSGEADKLRDALVQIILRLREDVLKESVESQNSDRDGKLTVATSDSLYGSSLSLPALLPHNPQIAPLSYDRRGESERALEVFPRTSSYGYSSMQVTDDGYGGLPSYTSKAYEEHLPRDEMTIPASGLSKVMGKRGTNLDNIRKISGAHIEIIESKSSRHDHIAYISGTSEQRQSAENLIKAFIMST

SEQ ID NO: 21324 - DNA, 1122 bp, Sorghum bicolor
  misc_feature: Ceres ANNOT ID no. 8705212
  misc_feature: Down-regulated in root tissues in response to aminocyclopropane carboxylic treatment
  misc_feature: Up-regulated in shoot tissues in response to methyl jasmonate treatment
  misc_feature: Down-regulated in shoot tissues in response to salicylic acid treatment
  misc_feature: Encodes the peptide sequence at SEQ ID NO 21325
atggctctcatcagcgaggagagcaaggacttgctccaagcccaagccgagctctacaaccaggtcttcagctatatgaagtcagtggcacttgccgttgccttggatctccgcattgccgatgcgatccaccaccacggtggcgccgccaccatcttccagatagccggagagattggtgtcaacccatgtaagattcccagacttcgtcgcctaatgcgcgctctcaccgtcgcaggaatcttcaccatccagccatcagatgaacaaactgtaaaagcatcgtcagccgggcatgaacctgctgctgtctacaagctgacaacagcctcccgcatcctcattagcaagagctcgccgagcttgttccctacgctgagccagcaactcaactccttccgcgactcggtgttgagcatggggctcagcacctggttccggcatgatgaacagcctggcccatgccctttcaccctgaagcaaggcataaccttttgggagaagtccgagcgcgaccatgcagccaacgtgtcgttcaacaactccatggccgcacacagccgcttcctgatgcagattgtcttgaaggagctcagtaacatcttccatggaatgggttcgctggtagatgtcggtggcggggctgggggagcctccatctccatagcggcggcgttcccgtgtatgaaaaagtgtagtgtgctggacctccctcatgttgtcgccaaggctccctctgctgcttctgttagcaacaacgtgcagtttgttgcgggtgacatgtttcggagcattccaccggcaaatgctgtcttcctcaagtggattttgcatgactggggcgatgatgagtgtatcaagatattgaagaattgtaagcaagctatcccttcaagagatgccggaggcaaggcaataatcattgatattgtggttggatctaagccatcagacaccaagcttctagagacgcaagtactgtgtgatctgaatatgatgaaaattggtggggctgaaagagatgagcaagagtggaagaaactattcctcgaagctggatttaaggactacaatattatgccggttctgggcctctggtcgatcattgaagtatatccatga

SEQ ID NO: 21325 - protein, 373 aa, Sorghum bicolor
  misc_feature: Ceres ANNOT ID no. 8705212
  misc_feature: Down-regulated in root tissues in response to aminocyclopropane carboxylic treatment
  misc_feature: Up-regulated in shoot tissues in response to methyl jasmonate treatment
  misc_feature: Down-regulated in shoot tissues in response to salicylic acid treatment
  misc_feature (105)..(373): SWISSPROT Homolog: EC 2.1.1.150 Isoflavone 7-O-methyltransferase
  misc_feature (100)..(350): Pfam ID: Methyltransf_2 Pfam Description: O-methyltransferase
  misc_feature (29)..(77): Pfam ID: Dimerisation Pfam Description: Dimerisation domain
MALISEESKDLLQAQAELYNQVFSYMKSVALAVALDLRIADAIHHHGGAATIFQIAGEIGVNPCKIPRLRRLMRALTVAGIFTIQPSDEQTVKASSAGHEPAAVYKLTTASRILISKSSPSLFPTLSQQLNSFRDSVLSMGLSTWFRHDEQPGPCPFTLKQGITFWEKSERDHAANVSFNNSMAAHSRFLMQIVLKELSNIFHGMGSLVDVGGGAGGASISIAAAFPCMKKCSVLDLPHVVAKAPSAASVSNNVQFVAGDMFRSIPPANAVFLKWILHDWGDDECIKILKNCKQAIPSRDAGGKAIIIDIVVGSKPSDTKLLETQVLCDLNMMKIGGAERDEQEWKKLFLEAGFKDYNIMPVLGLWSIIEVYP

SEQ ID NO: 21326 - DNA, 2709 bp, Sorghum bicolor
  misc_feature: Ceres ANNOT ID no. 8705336
  misc_feature: Up-regulated in shoot tissues in response to methyl jasmonate treatment
  misc_feature: Up-regulated in shoot tissues in response to salicylic acid treatment
  misc_feature: Encodes the peptide sequence at SEQ ID NO 21327
atggctgcggcggcggtgatggtgagctcggcgggctccctgctggcgatgctgcaagagccggcgccggagctcaagctgcacgcgctctccagcctcaactccctcgtccacgccttctgtgagagtttgtatgaagacgaggagtttgtccagaggcaacttgcagcactagttgcctctaaggtgtttttctacttgggcgagctaaatgatgctctctcgtatgcacttggcgctggacccttgtttgatgtatcagatgactctgattacgctcaaacactgttaggtgaggaactgtgcattcttgatggaaaatatcaacaggccatgggtatgtctgttgagtgccggagactggataaactggagggagcaatttctcgatgtgataaccttcatggagctctttcatattgcatcaatctgtctcaccaatatgttagtcaccgcgaatatcgattggaggatgatgctctgcttgcataccaaactgctttcgatcttgctgaaaatgaaaatcaggctttcctcctgaatgtgcggaatcaccttgatgcattgagttcacatacttctgcccatgtggacactgacagtggatcagctgtaccaagtaatcaaactaatgctgctacagaaccatctggggatggccagatgagagatgacataaacatgccaaatggcagtgctaccactgtggatccaaatgcagcaacacgtgctgataggctgacaaaaattaagggcatactgtcaggagagacatctattcagttgacattgcagttcctatacagccataataggtctgatcttcaaattttgaagactataaagcaagctgtggaaatgaggaacagtgtctgtcacagcgcaacaatatgctccaatgcaatcatgcatgcagggacaacagttgataccttcctcagagaaaacttggaatggctaggtagggcaaccaactgggccaagttcagtgcaactgctggactaggtgtcattcatagaggccatcttcaacaaggccgcgcattgatggccccctacctgcctcagaatggtgctggtggcagtggtagcccatactcggaaggaggtgccctctatgctcttggtttgattcatgccaaccatggtgaaggaatcaaagattttcttcgtgagagtctccgcaacgccacttctgaggtggtccagcatggtgcttgtctgggactcgggcttgcagcattaggtacatcagatgaggaaatatgcgaggacatcaagaatattttgtacacggatagtgctgtggctggtgaagcagctggtattggcatgggtttgctcatggttggcacggccagtgagaaggccacagagatgcttgcctatgctcatgatacacaacacgagaaaattatcaggggcttgtcacttggaattgcattgacagtgtatggcagggaagaagaagctgacaccttgattgaacaaatgactagagatcaagatcccatacttcgttatggtggtatgtatgcattggctctagcatacagagggactgcaaataacaaagctatccaccagcttctgcattttgctgtgtcggacgtgagtgacgatgtgcggaggactgcagtgttggctcttggctttgtcctgtacaacgagcctgaacagacacccagaattgtgtccctactatcagaatcatacaatccacatgtccgttatggtgcagcactagctgttggaatctcctgtgccggaacaggattaagtgaagccatctccttactggagcctctgacatcagacgtcgtcgactttgtacgccagggtgctctcattgcgatggcaatggtgatgatccagaccaatgaatcttacgattcacgtgtcggagcattcaggcgccagttggaaaagataatccttgacaagcatgaggataccatgagcaaaatgggtgccattctggcttctggcattctcgatgccggtggcaggaatgtcaccatcaagctcaagtcgaggtcaaagcatgacaggctcactgctgttgtcggactagctgttttcacccagttctggtactggtacccgctcacctacttcataagccttgccttctctccaacggccctcattggcctcaactctgacctgaaagtgccaaagtttgagttcttgtcgaacgccaagccatcactgtttgattaccccaagccagtgactcagcagactgcgaccgcctcagtcaaggtaccggcagccatcttgtcgacgtatgccaagtctaagtctagggcaaagaaggaagcagagagcaaggccaaggagaaagcagaggactcttccaatgcttctacttcaatgcaggtggacggcgctgctgctgcagagaagaaggcccctgaaccggagcctacgttccagattctgacgaacccagcccgggtcgttccagcccaggagaagttcataaaattcctggaagacagcaggtacaagccggtgaaggctgccccctcaggattcgtcctcctccaggacctcaagcccacggaggctgaggagctcgccctaactgacgcgccgtcaaccgctgccacgaccaatgccccggcatccagtgccagcgagccagccgccatggctgtcgacgatgagccccagccgcccccggctttcgagtacaccgaatag

SEQ ID NO: 21327 - protein, 902 aa, Sorghum bicolor
  misc_feature: Ceres ANNOT ID no. 8705336
  misc_feature: Up-regulated in shoot tissues in response to methyl jasmonate treatment
  misc_feature: Up-regulated in shoot tissues in response to salicylic acid treatment
  misc_feature (405)..(439): Pfam ID: PC_rep Pfam Description: Proteasome/cyclosome repeat
  misc_feature (579)..(613): Pfam ID: PC_rep Pfam Description: Proteasome/cyclosome repeat
  misc_feature (370)..(403): Pfam ID: PC_rep Pfam Description: Proteasome/cyclosome repeat
  misc_feature (440)..(473): Pfam ID: PC_rep Pfam Description: Proteasome/cyclosome repeat
MAAAAVMVSSAGSLLAMLQEPAPELKLHALSSLNSLVHAFCESLYEDEEFVQRQLAALVASKVFFYLGELNDALSYALGAGPLFDVSDDSDYAQTLLGEELCILDGKYQQAMGMSVECRRLDKLEGAISRCDNLHGALSYCINLSHQYVSHREYRLEDDALLAYQTAFDLAENENQAFLLNVRNHLDALSSHTSAHVDTDSGSAVPSNQTNAATEPSGDGQMRDDINMPNGSATTVDPNAATRADRLTKIKGILSGETSIQLTLQFLYSHNRSDLQILKTIKQAVEMRNSVCHSATICSNAIMHAGTTVDTFLRENLEWLGRATNWAKFSATAGLGVIHRGHLQQGRALMAPYLPQNGAGGSGSPYSEGGALYALGLIHANHGEGIKDFLRESLRNATSEVVQHGACLGLGLAALGTSDEEICEDIKNILYTDSAVAGEAAGIGMGLLMVGTASEKATEMLAYAHDTQHEKIIRGLSLGIALTVYGREEEADTLIEQMTRDQDPILRYGGMYALALAYRGTANNKAIHQLLHFAVSDVSDDVRRTAVLALGFVLYNEPEQTPRIVSLLSESYNPHVRYGAALAVGISCAGTGLSEAISLLEPLTSDVVDFVRQGALIAMAMVMIQTNESYDSRVGAFRRQLEKIILDKHEDTMSKMGAILASGILDAGGRNVTIKLKSRSKHDRLTAVVGLAVFTQFWYWYPLTYFISLAFSPTALIGLNSDLKVPKFEFLSNAKPSLFDYPKPVTQQTATASVKVPAAILSTYAKSKSRAKKEAESKAKEKAEDSSNASTSMQVDGAAAAEKKAPEPEPTFQILTNPARVVPAQEKFIKFLEDSRYKPVKAAPSGFVLLQDLKPTEAEELALTDAPSTAATTNAPASSASEPAAMAVDDEPQPPPAFEYTE

SEQ ID NO: 21328 - DNA, 2121 bp, Sorghum bicolor
  misc_feature: Ceres ANNOT ID no. 8705837
  misc_feature: Up-regulated in shoot tissues in response to methyl jasmonate treatment
  misc_feature: Up-regulated in root tissues in response to methyl jasmonate treatment
  misc_feature: Up-regulated in shoot tissues in response to salicylic acid treatment
  misc_feature: Up-regulated in root tissues in response to salicylic acid treatment
  misc_feature: Encodes the peptide sequence at SEQ ID NO 21329
atggactcggcgacgacgtcgggggcgatggagctggtggcggcgctgctgcggggccgggtgccgccggagctgatgggcggggacggcgccgagggccgggcgctcgtcgccacgctcgccgccgccgtgctcggcgccgcgctcttcgtgctctggaggcgcgccgccgccgggaagaagcgcaagcgggaggccgccgccgccgccgtcgctgaggccacggaggtcaaggccagggccgctaagggcggcgaagacgagaaggcggccgacgacggcaggaagaaggtcaccgtcttcttcggcacgcagaccggcaccgccgaggggttcgccaaggcgcttgctgaggaggcgaaggcaagatatgacaaggcaatcttcaaagttgtggacttggatgattatgcagcagaggatgaggaatatgaggagaagttgaagaaggagaagctagcattgttcttcgtggcaacgtatggagatggtgagccgaccgacaatgctgctaggttctacaaatggttcactgagggaaatgagaggggtgtctggttaaatgactttgagtatgctgtctttggtctgggcaatcgacagtatgagcatttcaacaaggttgccaaggtggtagatgagatcctaacagaacaaggtggaaagcgccttgttccagttggtcttggagacgatgaccaatgcattgaggatgacttcaatgcatggaaagaagctctctggccagagttggatcgattacttcgggatgaaaatgatgcctctacaggcactacatacacagctgctattcctgaataccgggttgaattcatcaaacctgaggaggcagctcatttggagagaaacttcagccttgcaaatggccatgcagtccatgatgcccagcatccttgccaggctaatgtggctgtgcggcgggagctccacacccctgcttctgatcgttcatgcacccatttggagttcgacattgctggaactggtctcacgtatgagactggggaccatgttggtgtatacaccgagaactgccctgaggttgtagaggaggcagagaggttgttgggctactcgccagacacatttttcaccatccatgcagacaaagaggatggtactccactaagtggcagttctcttgctcctccattcccctccccaatcacagtgaggaatgcacttgctagatatgctgaccttctaaattcaccgaagaagacttctctggttgcattagctacttatgcttcagatccggctgaggctgaccgcctgagattcttggcctctgccgctgggaaggatgagtatgctcaatgggttgtggcaagtcagaggagcctgttggaagtcatggcagagttcccttcggcaaagcctccactaggtgtcttctttgcagctgttgcccctcgtcttcaaccaagatattattctatttcatcttcacctagtatggcagcaaccaggattcatgtcacatgtgcgctcgtgcacgaaacaacacccgctggaagggtacataagggagtctgctcaacttggattaagaatgctgttccatcagaagagagcaaggattgcagctgggctccgatatttgtgaggcaatcaaacttcaaactacccgctgatccttcagtgccaatcatcatgattggccctgggaccggtcttgcacctttccgcggcttcttgcaggagagactagctcaaaaagaatctggagctgagcttggtccatccgtgttcttcttcggatgcagaaatagcaagatggacttcatctatgaggatgagctgaacaatttccttgagcaaggagcactgtctgagctggttcttgccttctcgcgtcagggccctactaaggaatatgtgcaacacaaaatggcacagaaagcatctgaaatctgggacatgatatcccaaggtgcttacatctatgtctgtggtgatgccaaaggcatggccagagatgtacatagagttctccacaccattgttcaggagcagggctccctcgacagttctaaggccgagagctttgtgaagaatctccaaatggagggcagatatctgagggatgtgtggtaa

SEQ ID NO: 21329 - protein, 706 aa, Sorghum bicolor
  misc_feature: Ceres ANNOT ID no. 8705837
  misc_feature: Up-regulated in shoot tissues in response to methyl jasmonate treatment
  misc_feature: Up-regulated in root tissues in response to methyl jasmonate treatment
  misc_feature: Up-regulated in shoot tissues in response to salicylic acid treatment
  misc_feature: Up-regulated in root tissues in response to salicylic acid treatment
  misc_feature (92)..(706): SWISSPROT Homolog: EC 1.6.2.4 NADPH--hemoprotein reductase
  misc_feature (298)..(523): Pfam ID: FAD_binding_1 Pfam Description: FAD binding domain
  misc_feature (100)..(243): Pfam ID: Flavodoxin_1 Pfam Description: Flavodoxin
  misc_feature (559)..(671): Pfam ID: NAD_binding_1 Pfam Description: Oxidoreductase NAD-binding domain
MDSATTSGAMELVAALLRGRVPPELMGGDGAEGRALVATLAAAVLGAALFVLWRRAAAGKKRKREAAAAAVAEATEVKARAAKGGEDEKAADDGRKKVTVFFGTQTGTAEGFAKALAEEAKARYDKAIFKVVDLDDYAAEDEEYEEKLKKEKLALFFVATYGDGEPTDNAARFYKWFTEGNERGVWLNDFEYAVFGLGNRQYEHFNKVAKVVDEILTEQGGKRLVPVGLGDDDQCIEDDFNAWKEALWPELDRLLRDENDASTGTTYTAAIPEYRVEFIKPEEAAHLERNFSLANGHAVHDAQHPCQANVAVRRELHTPASDRSCTHLEFDIAGTGLTYETGDHVGVYTENCPEVVEEAERLLGYSPDTFFTIHADKEDGTPLSGSSLAPPFPSPITVRNALARYADLLNSPKKTSLVALATYASDPAEADRLRFLASAAGKDEYAQWVVASQRSLLEVMAEFPSAKPPLGVFFAAVAPRLQPRYYSISSSPSMAATRIHVTCALVHETTPAGRVHKGVCSTWIKNAVPSEESKDCSWAPIFVRQSNFKLPADPSVPIIMIGPGTGLAPFRGFLQERLAQKESGAELGPSVFFFGCRNSKMDFIYEDELNNFLEQGALSELVLAFSRQGPTKEYVQHKMAQKASEIWDMISQGAYIYVCGDAKGMARDVHRVLHTIVQEQGSLDSSKAESFVKNLQMEGRYLRDVW

SEQ ID NO: 21330 - DNA, 1914 bp, Sorghum bicolor
  misc_feature: Ceres ANNOT ID no. 8705897
  misc_feature: Down-regulated in root tissues in response to salicylic acid treatment
  misc_feature: Encodes the peptide sequence at SEQ ID NO 21331
atggcgtgcctcgcgatctccctgcagccggtgaacggcccggacatcctactgcaaacgcggtcctggttccccgtctcccgcgccctcgccgccgtctccgcctttcgcctcgcgcgcctccacctcgcgcgcggcaagcagcagtcctcctcatcctccgcctcctcggcctcgctcgacgccatcggcgacgacccgctcgccgccgcgtcggggcagctcgttgtcggcgtcgagtcacagtaccgcgtggtgtaccgcctcgtcaactccatctacgtgctgggggtcaccaccgctggctccgaccatgccgcccccgctgtcaacgccttcgccgtcgccgacgctgtcaaccaggccgtctccgtcgtcgtcgcagcctgccgtggcgtcgacgtcacccccgagaaggtgcaccgcaagtaccccgaggtctatctcgccctcgacctcgtcctccacggcgttggctccgtccgcctctcccagatcctcgccaccatccatggcgacaacctcgcgcgcatggtcaactcctcccctgacgccgaagcccgggcccgcggcgcggatccctggcccgccgtcgagcacctcgctcaggaccgccacgctgcgagggagggcttctcgggcgcctctttcgagcttccccaggagacgctcgcggctggtgacgaattctcgtctaacatcgcccctgcgaccactgttgctactggtgatgagccaccacctgaggaggcagcacctgtggagaaggatccttttgcagccagtgacctgattaacaacaagccggaggaggcattggtgggtggattcaagaagaacaaggagactgcccttgtggttgctgatcctgcagctgcgctagctggattggaggtcacgactttaccgccagctgaggcgactaagccgacatttattggagttgaagggtttgagggtgattatggtggcattgagtttggcaatgatgaggcgtcacttgctgaggcatttgaagggctcaatgcgccatttggtggtgggctggatgcttctgagtttgttacaacaacgaagaaggatcacaaggacagggccgtcactggtcttgagctgctagtatcaagtgggaagccaccgaatgcagctgctggtactccattggaaaatctgttggtgaccaagcgcacagaaatgactgctcctgagttgtttattgctgaggagatcaatgcagaattcaaggagtctattcttgtgcgtgttggcttgaagggtacaatcttcctgcgtaccttgccgctgaataaggcagcgggcaaggagacagagttctcatttcgtcttgagggcacatcaggaatgaagagggctgcattgcagagtaatgtgttgagcaacctacagaatggactgttccatgtcaggactgtgtcgaaagaggagcccattcccctcatgaagtacagcttcctaccaaagcactcgcctctccctttgaggatgcgcctagtgaagcgccacagtgggacgttactctcagtgatgatacagtacgcatccaatccaatgctaccccagcctctgagcaatgttacattcattgttaagcttcctgtggatcccactctgctcaatgtttcacccaaggctgtgctaaaccgggcagagagggagcttagatggcatatttcagaaattcccctgaaaggtccagccggaaggctcagggcacggatgcctgttgaccaagactccaaagatggtgagctagaggttgttgggatggtgaagtttgcttaccaaggtccattcacattgtctggcattaaactacgcccagccactgatggcattgcccaatttaatgaagttggccataccttctccagtgggagttacctgtgcatctga

SEQ ID NO: 21331 - protein, 637 aa, Sorghum bicolor
  misc_feature: Ceres ANNOT ID no. 8705897
  misc_feature: Down-regulated in root tissues in response to salicylic acid treatment
MACLAISLQPVNGPDILLQTRSWFPVSRALAAVSAFRLARLHLARGKQQSSSSSASSASLDAIGDDPLAAASGQLVVGVESQYRVVYRLVNSIYVLGVTTAGSDHAAPAVNAFAVADAVNQAVSVVVAACRGVDVTPEKVHRKYPEVYLALDLVLHGVGSVRLSQILATIHGDNLARMVNSSPDAEARARGADPWPAVEHLAQDRHAAREGFSGASFELPQETLAAGDEFSSNIAPATTVATGDEPPPEEAAPVEKDPFAASDLINNKPEEALVGGFKKNKETALVVADPAAALAGLEVTTLPPAEATKPTFIGVEGFEGDYGGIEFGNDEASLAEAFEGLNAPFGGGLDASEFVTTTKKDHKDRAVTGLELLVSSGKPPNAAAGTPLENLLVTKRTEMTAPELFIAEEINAEFKESILVRVGLKGTIFLRTLPLNKAAGKETEFSFRLEGTSGMKRAALQSNVLSNLQNGLFHVRTVSKEEPIPLMKYSFLPKHSPLPLRMRLVKRHSGTLLSVMIQYASNPMLPQPLSNVTFIVKLPVDPTLLNVSPKAVLNRAERELRWHISEIPLKGPAGRLRARMPVDQDSKDGELEVVGMVKFAYQGPFTLSGIKLRPATDGIAQFNEVGHTFSSGSYLCI

SEQ ID NO: 21332 - DNA, 1371 bp, Sorghum bicolor
  misc_feature: Ceres ANNOT ID no. 8711777
  misc_feature: Up-regulated in root tissues in response to salicylic acid treatment
  misc_feature: Encodes the peptide sequence at SEQ ID NO 21333
atggcagaccagatatttcgcaaagtcgaaggtataataactaatgtccctgtcaaaatcaacgaccattttattccaacagatttccaagtcattgacatgggagaagatgagtatgatccacccatcatcctttggaagactgttcctcagcaccgtaaagccatcatgtacattggaataggagaagtccacatgcacttcccctctgagaaggtttgtcttgaggagaccgtagcaccaaatcagggggttatcaggaaatatggaggaaaggcccacacatccgcacgacgaagcacagaggcatcccacccttccgcgtggtgtgctccgttcctctttacgccgtttcctctcccgactctctcctcgccgtgcgccggcgtccgacgcgtaggagtaggaggaacaaaggccgaggcggcgggcgcggctgcggctgcagaggcgatgggtgatcatgaggcgcgcggtgacgacttcgagaagaaggcggagaagaagctctcgggctggggcctcttcagctccaagtacgaggacgccgccgacctcttcgacaaggctgcgaactccttcaagctcgccaagaactggagcagagctgcatcagtgtacatcaagattgctaactgtcatttgaagggagatagcaagcatgaggctgcctcagcgtacgtcgaggcagcaaattgctacaaaaagttctcacctcaggaagctgctcaagcgctaaaccagtctgttaatcttttcttggaaattggtaggttgaacatggctgcaagatacagcaaggacattggtgagatatatcagcaagaacaagatttagagaaggctacagattacctggaaagggcagctgacctttttgacagtgagggacagtcatctcaatcaaacaccatcaaacagaaagtagcagaaattgctgctcagttggaacagtacccaaaagcaactgagatatttgaagcgattgctcgtcagtcaatcaacaataatcttcttaagtatagtgtcaggggaattctccttaatgctggcatctgccaactatgtagaggtgatcctgttgccatcacaaattctctggagcgataccaggaaattgatccaactttctctgggacacgtgaatacaagcttttagctgatcttgctgcgtctatggatgaaggcgatgttgccaaatttactgatgccataaaagaatttgatagcatgacacgtctggttgtagctagaggtagagatgggggcgccagggtgtgcctggcgcctcgcagcaggggggtgagattagagatagcaggagatgagaggttagagataatcacttcattgcttgattcattcaactga

SEQ ID NO: 21333 - protein, 456 aa, Sorghum bicolor
  misc_feature: Ceres ANNOT ID no. 8711777
  misc_feature: Up-regulated in root tissues in response to salicylic acid treatment
MADQIFRKVEGIITNVPVKINDHFIPTDFQVIDMGEDEYDPPIILWKTVPQHRKAIMYIGIGEVHMHFPSEKVCLEETVAPNQGVIRKYGGKAHTSARRSTEASHPSAWCAPFLFTPFPLPTLSSPCAGVRRVGVGGTKAEAAGAAAAAEAMGDHEARGDDFEKKAEKKLSGWGLFSSKYEDAADLFDKAANSFKLAKNWSRAASVYIKIANCHLKGDSKHEAASAYVEAANCYKKFSPQEAAQALNQSVNLFLEIGRLNMAARYSKDIGEIYQQEQDLEKATDYLERAADLFDSEGQSSQSNTIKQKVAEIAAQLEQYPKATEIFEAIARQSINNNLLKYSVRGILLNAGICQLCRGDPVAITNSLERYQEIDPTFSGTREYKLLADLAASMDEGDVAKFTDAIKEFDSMTRLVVARGRDGGARVCLAPRSRGVRLEIAGDERLEIITSLLDSFN

SEQ ID NO: 21334 - DNA, 1386 bp, Sorghum bicolor
  misc_feature: Ceres ANNOT ID no. 8712885
  misc_feature: Down-regulated in shoot tissues in response to salicylic acid treatment
  misc_feature: Encodes the peptide sequence at SEQ ID NO 21335
atggctctgatccaacgactcttattcatcctcgtgccgttagcgggccaagccaaaaatcgtgccgtgccgcgtgctggcccatgggccaaatgccaggcccaggcacgggcacggagacgggccgtgccaggcacgggcacgggatacttcgttgtggtggtaattcttgggctaatcatgcgtgctgctatgatgatcatctcagtacttgaaagtgagactagcctgttcccaaagaaaaataaaatgatcttgccaagatcagtagcgaagcttctgcaccatcgtctcagttccgagtttgcaggcctgcaggataagagcaccctgctgcaaccaaggcaaaacgagaccatcaagtacaaggtgtttgctggtacatggaatgtgggtggcgttgcgccgccagatgatctggacctcaaggattggttggacaccacggcaggctcctgcgacatctatgttcttgggttccaagaaatcgtgccactgaatgcgaggaacgtgcttggtcctaagaagagatcggcggccatgaagtgggactccctcatagctgacgcactgaacaacacgagaagacgaagacaacaaggaggaagaggaggagccatgtcaggatgcagagaagcggcgcactcagaacggcgccaagaccaggacgtgttcaggcgcgtcacgagcaagcagatggtcggcatcttcgtctcggtctgggcgaggagcgccctccgccagcacgtccgccgccaccttgccgtctcctgcgtcggtgccggcgtcctcggcctgctgggcaacaagggggcggtgaccgtccggttcgtgctgcaaggaaccagcttctgcttcgtctgctgccatctggcctccggcagcgacgacggcgacgtgctgctcaggaacgccgacgtgggagccatcctctcgcggacaaggttccacggccgtggcagcgcggaggcggaggcggaggcgtcgcaggagctgaccctgcccaagaagattcttcaccatgaccgcgtggtgttgctcggcgatctcaactaccgggtcgccatggacgacgaggacgaggcacggcagctggtgacggccaggaaatggagcatgctgctggagaacgacgagctgctgctggagctctccaagggccggcgattcgacggctggcacgagggactcgtcaccttcgccccgacatacaagtaccaccgcaactccgacaagttgtactggtgtgaccgtatcctctggcgcgggaaggggatgatgcagacacggtacgagagctgcggcggctaccgcctctctgaccaccggccagtgagggcggtgtttcacttccacgccgtgtgcgaggtcgctaaacatgtatag

SEQ ID NO: 21335 - protein, 461 aa, Sorghum bicolor
  misc_feature: Ceres ANNOT ID no. 8712885
  misc_feature: Down-regulated in shoot tissues in response to salicylic acid treatment
  misc_feature (228)..(449): SWISSPROT Homolog: EC 3.1.3.56 Inositol-polyphosphate 5-phosphatase
  misc_feature (124)..(449): Pfam ID: Exo_endo_phos Pfam Description: Endonuclease/Exonuclease/phosphatase family
MALIQRLLFILVPLAGQAKNRAVPRAGPWAKCQAQARARRRAVPGTGTGYFVVVVILGLIMRAAMMIISVLESETSLFPKKNKMILPRSVAKLLHHRLSSEFAGLQDKSTLLQPRQNETIKYKVFAGTWNVGGVAPPDDLDLKDWLDTTAGSCDIYVLGFQEIVPLNARNVLGPKKRSAAMKWDSLIADALNNTRRRRQQGGRGGAMSGCREAAHSERRQDQDVFRRVTSKQMVGIFVSVWARSALRQHVRRHLAVSCVGAGVLGLLGNKGAVTVRFVLQGTSFCFVCCHLASGSDDGDVLLRNADVGAILSRTRFHGRGSAEAEAEASQELTLPKKILHHDRVVLLGDLNYRVAMDDEDEARQLVTARKWSMLLENDELLLELSKGRRFDGWHEGLVTFAPTYKYHRNSDKLYWCDRILWRGKGMMQTRYESCGGYRLSDHRPVRAVFHFHAVCEVAKHV

SEQ ID NO: 21336 - DNA, 1287 bp, Sorghum bicolor
  misc_feature: Ceres ANNOT ID no. 8712954
  misc_feature: Up-regulated in root tissues in response to methyl jasmonate treatment
  misc_feature: Down-regulated in shoot tissues in response to salicylic acid treatment
  misc_feature: Encodes the peptide sequence at SEQ ID NO 21337
atggagagggatttcctgggcgtgattgacagggcggcggggaagggcggcggcgatgtggtggtggtggaggacagccgaacggagctagcagaggcggcgcagtggcagtttccggccaagtccggcagcggcgcaccggcgttcatgtccttcaggacggcgaggggggaggagggctctgaggagttctccatctccgggttccggccggctggagacgccttggacggcatcaagaagcagacctccttgcctgctgtgatctcccagcaccagcagcagcagaggcagttcgggctcagcagcagccaggtcacggcacagcagtatcctgccgcggcgcacggcggccagcgcttgcaggggatggattacagcgcggcggcgcttcatcatctccctggtggatccaggctagtgcagccgctgtcggtgcgccaccctgcgccgttcaatcaggccaacctgatggtcaggtcgcagagcttccacaatggcaccggtgtcccctcgaggaatcagcagcctttcaccatgagcaacgggtttggtggctctacagttggcgtgtatggcgcaaggaatccacgaaatcagacctcaacgcagctgacgatattctacaacggttcggtgaatgtttttgataacgtcccggtagagaaggctaaggaactcatgatgttagccagcagggcatctattcctagcccaccaattgcctcccacaaactggattcacctatttctgcccctgcaaaggtcaacgtgcctgaggttttccctgctagacagattgttattcagaaaccggagccttgtgtgcctcatgtaacaagcacttcaagtccaatccccatcgtgccacaagttgtgactctctccaggagcacatctcactgtactacagaggcctgcggttcaaaacctgctgttcaatcgccagttattgctcctatcacccaggcaacctcatctcagccgttggcaactacaagtgctgcagctgttacgccaagagctgtccctcaagcccgaaaagcatctcttgcccgattcttggagaaacgaaaggagagagtgactagtgttgagccatacccgacatcaaagagtccgctagagggcagtgacaccgtaggcaatgctagtgctccaaccaaatcttcattcacagacatcgccccagcaagcaactatggcacagagcctgtgcgccttggccagcccaggaacatcagcttcagcagcgaagtgtgtcccagcacaaaattgcagatctga

SEQ ID NO: 21337 - protein, 428 aa, Sorghum bicolor
  misc_feature: Ceres ANNOT ID no. 8712954
  misc_feature: Up-regulated in root tissues in response to methyl jasmonate treatment
  misc_feature: Down-regulated in shoot tissues in response to salicylic acid treatment
MERDFLGVIDRAAGKGGGDVVVVEDSRTELAEAAQWQFPAKSGSGAPAFMSFRTARGEEGSEEFSISGFRPAGDALDGIKKQTSLPAVISQHQQQQRQFGLSSSQVTAQQYPAAAHGGQRLQGMDYSAAALHHLPGGSRLVQPLSVRHPAPFNQANLMVRSQSFHNGTGVPSRNQQPFTMSNGFGGSTVGVYGARNPRNQTSTQLTIFYNGSVNVFDNVPVEKAKELMMLASRASIPSPPIASHKLDSPISAPAKVNVPEVFPARQIVIQKPEPCVPHVTSTSSPIPIVPQVVTLSRSTSHCTTEACGSKPAVQSPVIAPITQATSSQPLATTSAAAVTPRAVPQARKASLARFLEKRKERVTSVEPYPTSKSPLEGSDTVGNASAPTKSSFTDIAPASNYGTEPVRLGQPRNISFSSEVCPSTKLQI

SEQ ID NO: 21338 - DNA, 2148 bp, Sorghum bicolor
  misc_feature: Ceres ANNOT ID no. 8713065
  misc_feature: Up-regulated in shoot tissues in response to salicylic acid treatment
  misc_feature: Up-regulated in root tissues in response to salicylic acid treatment
  misc_feature: Encodes the peptide sequence at SEQ ID NO 21339
atggacgaggcagcgacggcggccctggcggcggcgagggcgcggtggacgcagtgggaggaggttgtggtgtccaacgaccgcggcagtcgcctcgtgcactactacctccgcggcaacggcgaggcgaaggagctggcggtggtggggcgggagcggagcccgcgtcacatgtcgtacgccgtgcaggggcggttcctccgcgcgctggcggccgccgcgggggcggtcgccgtcgcgccgtcgccgtcgcggtcgcccctggcggctgctggggcggacggcggcgccccgaggaggtggcggtccaggcgggaggtcgtggactggctgtcctccctcgtttccggggcggctggagacactgatgctttacttcaatgtcctgctgtgtctagccttatttggctacaagaggcaccgtgtctagccatatttggcaagaagaggtgttgccttcctcgtatttttccatttggctgttggagggagccgcggctgcgaaacacaggttatagttatggttcctcctcaatggctaataggtgcaatgtggattcatatgatgacaatgttacggctttgaaggatgtttcttctagggaagcttcaaatgatttcacatggttgggagctccttggcattgccaacaacgtctgaagcactacaaatctttctgccgtagaggaattactatctcggtgcatagttttgtatacatcatgagtgaagagatgaagagacttgttgcttatgtggaagatctctacgaggatacaaattcatgcaacatggtcaaggtacaatggttcgacaaagttgatgaggttggtgtttcgttgcccatggatttcgatgacagagagattttcttttctctgggccgtcaagatctcaatgtagaatgcattgatgggttggctgcagtcctgagtgcccagcactacgagaagttcaagagtgataccagatgcagcttgtggcaaccttatttttgctgtcggcagattgataatggtgaagtcaagccttttgatgtcacacagctgcaaggctactggagccaggaaatacttaggaccatgttcaatgcaacttcctctctgaaggtgcgtttcaaggtccctaaatcgggacccagttcagatggagggttgaagaggaagcgtgatgcattcaacaatgatgctaatccacagaaggtcatttgttctgatgcttctacttctagattttatggtggtgagaacatcaaacacttgtgtcctggttgccatgtggaagtactatctcaagatagtggtataaggggatgttggtttagatgtttgattctgaagaggcataaagataaaatcaaggtgcggtacctagaccttcaggatgctgatgagactggaaacttggaggagtgggttatgctaacaagagttgctaaacctgatcaactgggtatacgtttccatggaaggccaatgattcgtccgcagcacgtggaagaaagcaaggcctcttgctttgatgttggagccattgttgatgcatggtggcatggtggctggtgggagggaattgtgttgtgccagggaggcagagggcgtctacaagtatattttccaggagaaaagcgaattgctgaatttggtgacgatgagctgaggtattcccttgagtgggttgataacaaatggaatcctttgaagggaagaaaagatatctcaagcaagctgacctccactgcagactgtggaagtggatatttgattgggaaacaagatcagctcgattttgatgtgcctccaaaaccagaacctcaacagggacttcgatatgacaagaggggtattgagaaaccttcagtctgcactatctcacgagatcagaaacgtgtcctcgccgacctgactaatgatctgaagttagataatttgaggtggaggccaagaaagaggagtagaagatttgggtcaagaaagcagtcggacactagcagcggaagcagcagtggggacatggacttgtccagccccagtggaagctttggtcaacctaatctagtgcccgacgaggaggcatgcaagagcagtggagagcagccttttatgggtgtgcctgtgcaggttccaaatcttgtgatgtccaggtga

SEQ ID NO: 21339 - protein, 715 aa, Sorghum bicolor
  misc_feature: Ceres ANNOT ID no. 8713065
  misc_feature: Up-regulated in shoot tissues in response to salicylic acid treatment
  misc_feature: Up-regulated in root tissues in response to salicylic acid treatment
  misc_feature (421)..(502): Pfam ID: Agenet Pfam Description: Agenet domain
  misc_feature (231)..(349): Pfam ID: BAH Pfam Description: BAH domain
MDEAATAALAAARARWTQWEEVVVSNDRGSRLVHYYLRGNGEAKELAVVGRERSPRHMSYAVQGRFLRALAAAAGAVAVAPSPSRSPLAAAGADGGAPRRWRSRREVVDWLSSLVSGAAGDTDALLQCPAVSSLIWLQEAPCLAIFGKKRCCLPRIFPFGCWREPRLRNTGYSYGSSSMANRCNVDSYDDNVTALKDVSSREASNDFTWLGAPWHCQQRLKHYKSFCRRGITISVHSFVYIMSEEMKRLVAYVEDLYEDTNSCNMVKVQWFDKVDEVGVSLPMDFDDREIFFSLGRQDLNVECIDGLAAVLSAQHYEKFKSDTRCSLWQPYFCCRQIDNGEVKPFDVTQLQGYWSQEILRTMFNATSSLKVRFKVPKSGPSSDGGLKRKRDAFNNDANPQKVICSDASTSRFYGGENIKHLCPGCHVEVLSQDSGIRGCWFRCLILKRHKDKIKVRYLDLQDADETGNLEEWVMLTRVAKPDQLGIRFHGRPMIRPQHVEESKASCFDVGAIVDAWWHGGWWEGIVLCQGGRGRLQVYFPGEKRIAEFGDDELRYSLEWVDNKWNPLKGRKDISSKLTSTADCGSGYLIGKQDQLDFDVPPKPEPQQGLRYDKRGIEKPSVCTISRDQKRVLADLTNDLKLDNLRWRPRKRSRRFGSRKQSDTSSGSSSGDMDLSSPSGSFGQPNLVPDEEACKSSGEQPFMGVPVQVPNLVMSR

SEQ ID NO: 21340 - DNA, 2154 bp, Sorghum bicolor
  misc_feature: Ceres ANNOT ID no. 8713439
  misc_feature: Up-regulated in root tissues in response to salicylic acid treatment
  misc_feature: Encodes the peptide sequence at SEQ ID NO 21341
atgtccgtgccggcgatagccgtgtacaccagcccgccgggcgccgccgtccacgcgccgccggagcacgagtccagctcgcgcggctcggcgccgtgcgcggccgcggcgtccccgtcggcggcgccgagctcccaccgccacgcgggcggcctgtcctgcctgttctcgtccccgtccgcggccccgcggtcgacggcgcacgaggagctcggcgcgctctggcacgacagatccgacgagccgcccatcgttgtcgtcgccgggggcttcggcggcgggggctactcgtacccccagtcgtcgtcgtcgccgtcgccgttcaagctgcgggaccacctccaccgcagcccggtgtcgctgttccacagccctgccgcctcctctccggcgtccaggagcccgtcggtttcctggctcgccggccgcgagcgcgaccggctcttctccagcttcgtgcgcaacgcgcttggctcctgcattgacttcgcgccggtcaccagcttgccgctgggtgtgcgccccgcggccactggtgtcgacgccgccgagctggccttcgagcttgacgaaagcctctctgaggcggagccgtgctgcgaacctgatgctcgtgaactcctcgcccgcgtccaggctcgccactgcatcttccgcgacgagcttgtcgtcaaggccttcttcgaggccgaacgggcacaccgtggccagaagcgggctagtggtgatccgtacttgcagcattgcgtggagactgcggttcatctggctaatattggtgcaaatgcaaccgttgtgtctgccggccttctccatgacacaattgatgattcgttcatggactatgatcatatcttcaggatgtttggtgctggtgttgccgatcttgttgaaggggtttcgaagttaagccatttgagcaaacttgctcgggacaacaatactgcaagtaggactgttgaagctgatcgcctgcatacaatgtttcttgcaatggctgatgcacgagctgttcttataaagttagcagatcgtctgcacaacatgaagacgatagaagctttgcctttggttaaacaacaaaggtttgctaaagagactatggaaatatttgtgccattggccaaccgattaggaattgctagctggaaagaccagttggagaatatttgcttcaaacacttaaacccagaggagcacaaggagctttcttctaaacttgtgatgtcttttgatgaagcacttcttacatctacgcttgataacttggataaaggcctcagagatgaaggcatttcatatcacagtctttctggaaggcacaagagtctgtacagtatatactccaagatgataaagaagaacttaacaatggatgatgtccatgacatccatggtctacggctagtggttgacacagaggaagattgttatcgagcacttgacatagtgcacaagctgtggccccgagtcactggaagatttaaagactatatttctcatccgaagctgaatgggtatcggtcattgcacactgtcatcatctgtgagggtgtccatccatttgaaatccagatccgaacaaaggaaatgcatctacaggctgaatatggatttgctgcgcactggaggtacaaagaaggtggctgcaggcactcctttgttctccaaatggtggaatgggcaaggtgggtgctcacatggcaatgcgaggcaatgagcaaagagcgtccctcatctttgagcagctctgttggcatgaggccaccatgcccttttccgctgcattcggaagattgcccctattcttacagccggcagtgcaaccatgaaggtcctatatttgtgatcatgcttgaacatgacaagatgtctgtccaagagctcccggcaaactcgactgtagttgatctaatggagcgagtcggggccaacagtccgagatggagcccttacagcttcccactgaaagaggagctgcgaccgagggttaaccacaagcccataagcgacccaaataggaagctcagcatgggcgacgtggtagagctgacgcctgcgctccctcacaagtcgctgagcgagtaccgggaggagatccagcggatgtacgagcggggagggtttgcgctcgccaccacccctagaagctga

SEQ ID NO: 21341 - protein, 717 aa, Sorghum bicolor
  misc_feature: Ceres ANNOT ID no. 8713439
  misc_feature: Up-regulated in root tissues in response to salicylic acid treatment
  misc_feature (168)..(572): SWISSPROT Homolog: EC 2.7.6.5 GTP diphosphokinase
  misc_feature (439)..(549): Pfam ID: RelA_SpoT Pfam Description: Region found in RelA / SpoT proteins
  misc_feature (245)..(349): Pfam ID: HD Pfam Description: HD domain
MSVPAIAVYTSPPGAAVHAPPEHESSSRGSAPCAAAASPSAAPSSHRHAGGLSCLFSSPSAAPRSTAHEELGALWHDRSDEPPIVVVAGGFGGGGYSYPQSSSSPSPFKLRDHLHRSPVSLFHSPAASSPASRSPSVSWLAGRERDRLFSSFVRNALGSCIDFAPVTSLPLGVRPAATGVDAAELAFELDESLSEAEPCCEPDARELLARVQARHCIFRDELVVKAFFEAERAHRGQKRASGDPYLQHCVETAVHLANIGANATVVSAGLLHDTIDDSFMDYDHIFRMFGAGVADLVEGVSKLSHLSKLARDNNTASRTVEADRLHTMFLAMADARAVLIKLADRLHNMKTIEALPLVKQQRFAKETMEIFVPLANRLGIASWKDQLENICFKHLNPEEHKELSSKLVMSFDEALLTSTLDNLDKGLRDEGISYHSLSGRHKSLYSIYSKMIKKNLTMDDVHDIHGLRLVVDTEEDCYRALDIVHKLWPRVTGRFKDYISHPKLNGYRSLHTVIICEGVHPFEIQIRTKEMHLQAEYGFAAHWRYKEGGCRHSFVLQMVEWARWVLTWQCEAMSKERPSSLSSSVGMRPPCPFPLHSEDCPYSYSRQCNHEGPIFVIMLEHDKMSVQELPANSTVVDLMERVGANSPRWSPYSFPLKEELRPRVNHKPISDPNRKLSMGDVVELTPALPHKSLSEYREEIQRMYERGGFALATTPRS

SEQ ID NO: 21342 - DNA, 1101 bp, Sorghum bicolor
  misc_feature: Ceres ANNOT ID no. 8713705
  misc_feature: Up-regulated in shoot tissues in response to salicylic acid treatment
  misc_feature: Encodes the peptide sequence at SEQ ID NO 21343
atggctcgctgccgccgccacctcctcctccttgctctctttctcgccttggctgctgctgctccggggcaggcgcagagtcatggcgaagcctccgccgtcttcatcgacgccgcgtcgcaccgctacctgcgggaccagcaagccgacggccaggacgcttcaatgtcgttaaatgaagtttctgcggctgtttctgtcttgcttggttttgcagcgccaacctccctaccagcgatttcatcgtcgaagttgaacaaagtgcttcttcccaatccatttgatagaccgcgtgctgttttccttatgcaaattgctgggaccgatgcctcagcccctagcttcgtatctgaaggcagcaacattttcaagaccaggattgaaggtgcaaacagcgctgatacagggctttcagatacagatgatttaattgtcattcattcagatgaatctctagatctttctcgatcagattatcttgataatgaactttccagcttggcaaactggttggagggatcttatcagaagtctagcagcaaactagtcattcccttggagagtggaaacagtctcactttgctacttgataaggaagcagacatggaatttgtgtccagcttggcttcccttcttaagactatcgagagggcgatccaggttcacgaagatttctcaggtgtcatgaaccccgcagagctactagaatgccacttcacaggaataaaggctctggagaatgaatatggttccactgaaattgttaagcaggcaactgaagtagttcagagagctgtcaccaaatcattccagtccctacatgaagcatacaaagggaaaattgttgggctggtaatatccacaaaggaggcttcatcatccttaggatccataattgacgcaccttcttcactgcacatttcaagacgactagaagaagcaagcaagactaaagaagcctctgtggcacttgttcgaaagagtttggcatggattacagggatcatcctgcttgtttcaactctcataggggtttgcttgcttatgaacatgccacttaccagggacaccctcttgtactcgaacgtcaagattgattag

SEQ ID NO: 21343 - protein, 366 aa, Sorghum bicolor
  misc_feature: Ceres ANNOT ID no. 8713705
  misc_feature: Up-regulated in shoot tissues in response to salicylic acid treatment
MARCRRHLLLLALFLALAAAAPGQAQSHGEASAVFIDAASHRYLRDQQADGQDASMSLNEVSAAVSVLLGFAAPTSLPAISSSKLNKVLLPNPFDRPRAVFLMQIAGTDASAPSFVSEGSNIFKTRIEGANSADTGLSDTDDLIVIHSDESLDLSRSDYLDNELSSLANWLEGSYQKSSSKLVIPLESGNSLTLLLDKEADMEFVSSLASLLKTIERAIQVHEDFSGVMNPAELLECHFTGIKALENEYGSTEIVKQATEVVQRAVTKSFQSLHEAYKGKIVGLVISTKEASSSLGSIIDAPSSLHISRRLEEASKTKEASVALVRKSLAWITGIILLVSTLIGVCLLMNMPLTRDTLLYSNVKID

SEQ ID NO: 21344 - DNA, 3846 bp, Sorghum bicolor
  misc_feature: Ceres ANNOT ID no. 8713732
  misc_feature: Up-regulated in shoot tissues in response to methyl jasmonate treatment
  misc_feature: Up-regulated in root tissues in response to methyl jasmonate treatment
  misc_feature: Encodes the peptide sequence at SEQ ID NO 21345
atggaaagtcagacaaagacccaacagaacgctggaagtgctcaagtgattccaaatcaaaaccctcctggtccagcacctggccttcctccacaaggtagtaatccagcacagtcatcagctatcccattgatgtctcagcaacagacacggcagccaaatgcttctacatctgttcaaggttctcttcccagccagacatcgacgctgcagaacctgtctggcctgccacaaaataccatgaacaatggtttagcacaaggtactccacaagatatgtatgctgcacaaagacaaatggcaggtaggcagcagcagcagcaacaacaacaacaagcacataatcagttaatttatcaacagcagaaattgttgatgagccagaaattgcagcagaattcacttatgcaaccgcatattcagcagcagcaaactttgttgcagtcaacacagatgcaatcttcacagcagtccatgatgcaaatgtcatctggccttcagcctgggcagaccaccattccacaaactcagtccatggcgatgcagtcagctacacagagcggtattcaacagaatccattgaattcagtacaacaatctgtgcaatcattactccagcagcctacacaatctgtagtgaggcagcagcaacatccacagtccatgcaccagcagccttctctgcagcaaactcaaccaactcaacagcccaacattcctttgcaacagcagccacaacaattaatgggccagcagtcaaatttacagcaaaatcagttaatgaatcaacagagtggtgctgtggagatgcaacagcaacaaaggctaccagttcagtcaaataatcttttgaatatgcagcaaacacagcagatgatgaaccagcaatctatgcccttgcaccagccccaacaattggcaaaccagggaaacatgtcaagtctacatcaacagcagcagcaaaatcagcagcagcagcagcagcagcttcttggaactgcgccaaatgtccgtatgcatatgttacagcagcaaaagccaattcagcaaccacagcagcaacagcatgctcagcagacatcgatgggtttgatgcaacctcagtctcagcagaaccagcttcagcaacctcaacaacatatgatgtcgcagttccagtctcagcctaatcaagtgcagcaacaattgggaatgcaacaaaggctccaaacttcagctggcatgctcttgcaacaaaataatattgatcaacaaaagcaatacgttcaggcacagaggggcctccaagaagcacccagtacaatggcagtgactggagaaacggagctgctaccaggaggtcagtgcctgatctgcagccgctggagctcgccgctcgattcgcatagtgccagagggtggcttgagtttggttccttgatggcggctcaagcaagtggaggtggacgtgtaacagttggttcacccgtcaatagtctcagttttgacaaccttgctttctatgcagcatctgtggattccactgctcaaactggtcatccaggaggtgatttgcaagaggagttatatcaaatgattaagagtttaaaggaccagtactttgcggaattgaatgatttgtacaataagatatccatgaagatacaacatattgacaaccacatgcctgctcaaaagtcagcagagcagtatgaaaagatgaagggctttaaactaatgttggagcgcacattgcatttcctgcaagttaacaagaacagcattcagccagcttttagggaaaaaatccctgtttacgagaggcaaattctcagtatcctaagttcacaaagaaggaagcctgtgcaggcacctggacagcaaatatttcagcaatctggtgggcaagctcctagctctaacatttcacagcaacatcagacttcccaaggtttgcagcagcatgatagtcatactaatcagatgcctcaagcaagtataccaagtatgaacacaggagtacagacctctggagcacctggcattcagcatgtacctgcgcctcaagcaacaaactttggtgttccaacaacacagcaaaatgtcacaaatgcaccgcaggctggttctaatctggagaatgctcagggaaatagttttaatcctgtgcagcatggttcaatgggtactgcgttgcaacagggaagcactggtcccatgcagggtgcattaaatgcacagcagcagtccagtagtaacatgatatccaacaatgcaatgagtacaatgcagactaataccaatgccatgcaagcaaatgcgaactcattgcagcagctaaagcagcaacatcaggagcatcagatgatgcaaagtcagcaaatgaagcagcgtcagcagatgatgcatcagatacagcaaaagcaaatgcttcaacagcagctcccaatacagcaactacagaaacaacagcagcaagggcagatgccggttccacagcttcattctggaaatgatgtgaatgagctaaaggttaggcaaggagctgcaatcaaatctggaatgtatcaacagctgagccagcgtaactattatcatcagcagataaaacagggtggtgtctttccaatttcttctccgcaaaaccttcaagcatcgtccccacaaatttcacaccattctcctcaggttgatcagcacagtctgttgcaatctcaagtgaagaccgggacaccattgcattcagctaactcaccatttgtcccatctccatcccctcctgttgccccatcaccgatgccagtggattcagataaaccactctccaacttatcttcgctcactagtgcggggcaagcacatcagcaaacatcccttgcacctcagacacaatctatagccgttaacacaccaggtatatcagcgtcacccttgcttgcagaattcacaagtgctgatggaagtcaggttaacctaccaactcaagttccaaccaaatcagcagcagaaaggcctctggatcgcttgcttaaagcattgcgaacaacacagcgcgagtcccttagtgctgctgttagcgatattggatctgtcgtgagtatgattgacaggattgctggatcagcgcctggtaatggttctagagctgctgtgggtgaagatcttgtcgctatgacaaagtgccgcttgcaagcccggaacttcataactcatgacgggagtggtgcatcaaagaaaatgaaacgggacactagtgctatgcctcttaatgtgtcatcggctggaagcgtgaatgatagcttgaagcaatcatatactgttggcactccagagctacaatcaactgcaacgtcacgtgtcaagtggcaaagggctgaggtaaaccatgctctgatggaggagattcaggagataaaccagcagcttatagatacagagctccatgtctctgaggatgatgccgagtccttcactgcatctgaggggggtgaagggacagtcattagatgcacattcactgctgttgctgttagccccagcttgaaatccatgtttgcttcagcgcagatgagtccgattttgccgttgaggctgcttgttcctgctagctacccaaaatgctctccggtgctcctagacaagtttcctgatgaacaatgcaggaactcagacgacctgtctacgaaggccaagtcaaagttcagtgtgttgctccggggtctagcagagcccatgtcactgcgagaaatcgcaagaacatgggatgcttgcgcccgcaaagtgatcgcagagtatgcccagcaaactggaggaggcagtttcagctcgagctatggttgctgggaaagctgcgtaggcgcttcataa

SEQ ID NO: 21345 - protein, 1281 aa, Sorghum bicolor
  misc_feature: Ceres ANNOT ID no. 8713732
  misc_feature: Up-regulated in shoot tissues in response to methyl jasmonate treatment
  misc_feature: Up-regulated in root tissues in response to methyl jasmonate treatment
MESQTKTQQNAGSAQVIPNQNPPGPAPGLPPQGSNPAQSSAIPLMSQQQTRQPNASTSVQGSLPSQTSTLQNLSGLPQNTMNNGLAQGTPQDMYAAQRQMAGRQQQQQQQQQAHNQLIYQQQKLLMSQKLQQNSLMQPHIQQQQTLLQSTQMQSSQQSMMQMSSGLQPGQTTIPQTQSMAMQSATQSGIQQNPLNSVQQSVQSLLQQPTQSVVRQQQHPQSMHQQPSLQQTQPTQQPNIPLQQQPQQLMGQQSNLQQNQLMNQQSGAVEMQQQQRLPVQSNNLLNMQQTQQMMNQQSMPLHQPQQLANQGNMSSLHQQQQQNQQQQQQQLLGTAPNVRMHMLQQQKPIQQPQQQQHAQQTSMGLMQPQSQQNQLQQPQQHMMSQFQSQPNQVQQQLGMQQRLQTSAGMLLQQNNIDQQKQYVQAQRGLQEAPSTMAVTGETELLPGGQCLICSRWSSPLDSHSARGWLEFGSLMAAQASGGGRVTVGSPVNSLSFDNLAFYAASVDSTAQTGHPGGDLQEELYQMIKSLKDQYFAELNDLYNKISMKIQHIDNHMPAQKSAEQYEKMKGFKLMLERTLHFLQVNKNSIQPAFREKIPVYERQILSILSSQRRKPVQAPGQQIFQQSGGQAPSSNISQQHQTSQGLQQHDSHTNQMPQASIPSMNTGVQTSGAPGIQHVPAPQATNFGVPTTQQNVTNAPQAGSNLENAQGNSFNPVQHGSMGTALQQGSTGPMQGALNAQQQSSSNMISNNAMSTMQTNTNAMQANANSLQQLKQQHQEHQMMQSQQMKQRQQMMHQIQQKQMLQQQLPIQQLQKQQQQGQMPVPQLHSGNDVNELKVRQGAAIKSGMYQQLSQRNYYHQQIKQGGVFPISSPQNLQASSPQISHHSPQVDQHSLLQSQVKTGTPLHSANSPFVPSPSPPVAPSPMPVDSDKPLSNLSSLTSAGQAHQQTSLAPQTQSIAVNTPGISASPLLAEFTSADGSQVNLPTQVPTKSAAERPLDRLLKALRTTQRESLSAAVSDIGSVVSMIDRIAGSAPGNGSRAAVGEDLVAMTKCRLQARNFITHDGSGASKKMKRDTSAMPLNVSSAGSVNDSLKQSYTVGTPELQSTATSRVKWQRAEVNHALMEEIQEINQQLIDTELHVSEDDAESFTASEGGEGTVIRCTFTAVAVSPSLKSMFASAQMSPILPLRLLVPASYPKCSPVLLDKFPDEQCRNSDDLSTKAKSKFSVLLRGLAEPMSLREIARTWDACARKVIAEYAQQTGGGSFSSSYGCWESCVGAS

SEQ ID NO: 21346 - DNA, 2052 bp, Sorghum bicolor
  misc_feature: Ceres ANNOT ID no. 8713755
  misc_feature: Up-regulated in shoot tissues in response to salicylic acid treatment
  misc_feature: Encodes the peptide sequence at SEQ ID NO 21347
atggcggcgtttatggatagcccaagacggaaaggcctgcatgcctctgcgaaaggcaaaaaggcccgtatgggcccgtcacagaggagaggcccagtagtccaacaagaaaagggaaagcccagtagtccaactagaaaaaggacactgacaagtgtcaggaggacatcaagagtagagttgaggttccccttcttccccctgtcgtctgcttcacattcccacaatcccggccgccgcggcatcaccctccccatcctcctcctcaccatggtgtcggacgccagcaagaagaaggccgcgcagaagaaggcggccgccgcagccaagaggggagccaaggtcccggccccttcctcatcctcctcctcctctgccgccgctaaggccgtcgatgccgtcgccgcgctcaagctctccgatcgcacctgcaccggcgtcctcgcctcccacccgctctcccgagatatccacatagagtctctttcattaacgtttcatggccatgaccttattgtagattctgagttggagctcaactatgggaggcgttatggtttgctcggcctaaatggctgtgggaaatctactctgctcaccgcgataggctgcagggaactccctatacctgaacacatggacatataccatctcacccatgagatcgaggcttcagacatgtctgcgctacaagctgttgttagttgtgacgaagaaagagtgaagttggaaaaggaagcggagattttggctgcacaggatgatggtggtggtgatgctttggatcgtgtatatgagcgtctagaagcgattgatgcatcaaccgctgaaaagcgcgctgctgagatattatatggtttaggttttaacaagcaaatgcaagctaagaaaactcgagatttttctggaggttggcgtatgagaattgctttggctagagcactgttcatgaatccaacaatccttttgcttgatgagcctacaaatcatcttgatcttgaggcatgtgtctggttggaagagatgctaaagaaatttgaccgtatacttgttgtcatatctcactcccaggactttctgaatggtgtgtgcactaacatcatccatatgcagaataagaagctcaagttatatactgggaactatgaccagtacgttcagacccgttctgagcttgaagagaatcagatgaagcagttcaagtgggagcaggagcagattgcatcaatgaaagagtacattgcacggtttggccatggatctgcaaagcttgcacgtcaggcccagagcaaggagaaaactcttgcaaagatggagcgtggtgggctcactgagaaggttgttagggataaaatactggtcttccgcttcacaaatgttggcaaacttccaccaccagtgcttcagtttgttgaggtcacgtttgggtacacaccggataatctcttgtacaagaagctcgactttggtgttgacctggactctaggattgcactggttggtcccaatggggcagggaagagcactctcctgaagctgatgacaggtgagctggctccattggacggtatggtgaggcggcacaatcacctgcgcatcgcacagttccatcagcacctggcagagaagctggacctggacatctcggccctgcaatacatgatgaaggaataccctgggaacgaagaagagaggatgagagccgcagtcggtaagtttgggctgtcagggaaggctcaggtgatgccaatgaggaacctgtcggacgggcagaggagccgtgtcatctttgcgtggctggcatacaggcagccgcagctactgctgctggatgagccaacaaaccatctcgatatcgagaccatcgactccctagcggaggcgctgaacgagtgggacggcggtctggtactggtgagccatgacttcaggctgatcaaccaggtcgctcatgagatctgggtttgtgagaatcaggcagtgactaggtgggaaggcgatatcatggatttcaaggaacatttgaggagcaaggctggtctatctgattaa

SEQ ID NO: 21347 - protein, 683 aa, Sorghum bicolor
  misc_feature: Ceres ANNOT ID no. 8713755
  misc_feature: Up-regulated in shoot tissues in response to salicylic acid treatment
  misc_feature (193)..(447): SWISSPROT Homolog: EC 3.6.3.44 Xenobiotic-transporting ATPase
  misc_feature (466)..(641): SWISSPROT Homolog: EC 3.6.3.41 Heme-transporting ATPase
  misc_feature (494)..(659): Pfam ID: ABC_tran Pfam Description: ABC transporter
  misc_feature (182)..(373): Pfam ID: ABC_tran Pfam Description: ABC transporter
MAAFMDSPRRKGLHASAKGKKARMGPSQRRGPVVQQEKGKPSSPTRKRTLTSVRRTSRVELRFPFFPLSSASHSHNPGRRGITLPILLLTMVSDASKKKAAQKKAAAAAKRGAKVPAPSSSSSSSAAAKAVDAVAALKLSDRTCTGVLASHPLSRDIHIESLSLTFHGHDLIVDSELELNYGRRYGLLGLNGCGKSTLLTAIGCRELPIPEHMDIYHLTHEIEASDMSALQAVVSCDEERVKLEKEAEILAAQDDGGGDALDRVYERLEAIDASTAEKRAAEILYGLGFNKQMQAKKTRDFSGGWRMRIALARALFMNPTILLLDEPTNHLDLEACVWLEEMLKKFDRILVVISHSQDFLNGVCTNIIHMQNKKLKLYTGNYDQYVQTRSELEENQMKQFKWEQEQIASMKEYIARFGHGSAKLARQAQSKEKTLAKMERGGLTEKVVRDKILVFRFTNVGKLPPPVLQFVEVTFGYTPDNLLYKKLDFGVDLDSRIALVGPNGAGKSTLLKLMTGELAPLDGMVRRHNHLRIAQFHQHLAEKLDLDISALQYMMKEYPGNEEERMRAAVGKFGLSGKAQVMPMRNLSDGQRSRVIFAWLAYRQPQLLLLDEPTNHLDIETIDSLAEALNEWDGGLVLVSHDFRLINQVAHEIWVCENQAVTRWEGDIMDFKEHLRSKAGLSD

SEQ ID NO: 21348 - DNA, 726 bp, Sorghum bicolor
  misc_feature: Ceres ANNOT ID no. 8713838
  misc_feature: Up-regulated in shoot tissues in response to methyl jasmonate treatment
  misc_feature: Up-regulated in shoot tissues in response to salicylic acid treatment
  misc_feature: Up-regulated in root tissues in response to salicylic acid treatment
  misc_feature: Encodes the peptide sequence at SEQ ID NO 21349
atgaacagcagcaagcaggcgctgatttacagcttcgtggccaagggctccgttgtgctggcggagcacacggccttctccggcaacttcagcaccgtcgccgtccagtgcctccagaagcttccccccaacagcaccagatccacctactcctgcgacggccacaccttcaacttcctcgtcgaccgcggcttcgtgttcctagttgtcgctgatgaggctgctgggaggagcgtcccgttcgtcttcttagagagggttagggaagacttcatgcagcggtatgggtccagtattgacgaggaagggcagcacccactcgctgatgatgccgatgaggacgactttctgtttgaggaccgcttcagcatcgcctacaaccttgatcgcgaatttggcccgaggttgaaggatcatatgcagtattgtgttaatcatccagaggaaattaacaagctctccaaggtgaaagcccacctatcggatgtcaaagggatcatgatggacaacattgagaagatattggatcgtggtgagaagattgagcttttggtgggtaagacagagaccttacagtcacaggctgacagcttccacaggcatggcagagagttgaggcgaaagatgtggcttcagaacctgaggtttaagctgatggtgggtggcggcatcttggctctgattctcatcctttggctgatggtctgcaggggattcaaatgttag

SEQ ID NO: 21349 - protein, 241 aa, Sorghum bicolor
  misc_feature: Ceres ANNOT ID no. 8713838
  misc_feature: Up-regulated in shoot tissues in response to methyl jasmonate treatment
  misc_feature: Up-regulated in shoot tissues in response to salicylic acid treatment
  misc_feature: Up-regulated in root tissues in response to salicylic acid treatment
  misc_feature (149)..(237): Pfam ID: Synaptobrevin Pfam Description: Synaptobrevin
MNSSKQALIYSFVAKGSVVLAEHTAFSGNFSTVAVQCLQKLPPNSTRSTYSCDGHTFNFLVDRGFVFLVVADEAAGRSVPFVFLERVREDFMQRYGSSIDEEGQHPLADDADEDDFLFEDRFSIAYNLDREFGPRLKDHMQYCVNHPEEINKLSKVKAHLSDVKGIMMDNIEKILDRGEKIELLVGKTETLQSQADSFHRHGRELRRKMWLQNLRFKLMVGGGILALILILWLMVCRGFKC

SEQ ID NO: 21350 - DNA, 1203 bp, Sorghum bicolor
  misc_feature: Ceres ANNOT ID no. 8713827
  misc_feature: Up-regulated in root tissues in response to methyl jasmonate treatment
  misc_feature: Up-regulated in shoot tissues in response to methyl jasmonate treatment
  misc_feature: Encodes the peptide sequence at SEQ ID NO 21351
atgggttgccatatatctttgccttctttgacatataacttagcactatattgtgtgtctaaaggctaccttctgtattcagattggatggaatccttgtggaaattgacctacttgctcgagccggcatcgcttgctctaattgccacagccatttctgtggcctatgcatcagcatcgcgtgctctggactatggcaaagagatggagagaaacttggatttttcagaggcttccattacattggatcggtcacaggctctaatgattccccttgcaagctcatgcagtctgttgctaatgttctacttgttctcgtctgtctcacatctcgtgactgcttttactgctgtggcctcagcaatggcattgttcttttgcctgtctccacacatcacctatctcaagacacagtacaatctaatggacccattcgtgtccaggtgttgttcaaagccgtttacacggttgcaaggtttgctgatgctcttctgcatagccacagtcttagcctggttggtttcagggcattggttgctaaataacctactggggatttccatatgtgtagcatttgtcagccatgtgaggcttcccaacataaagatctgtgcgctgcttcttgcctgcttatttgtgtatgatattttctgggtgttcttctcagaaaggttttttggagcaaatgtcatggtctctgttgccactcagaaggcatctaatcctgttcacacagtagcaaataagctcagcctgcccgggttgcagttgattacaaagaagctggagcttccagtcaagcttgtatttcccaggaatttgttgggtggtattgttccaggaagcaatcctggtgactacatgatgcttggccttggagacatggccattccagggatgcttctagctctggtactcttttttgataaccggaagttcaaggatgtgaatgttccatcagatgtgtctcccccaaaacggcggaagtatgtgtggtatgctctaacagggtatggtattggcttggtagctgcactagctgctgggatcttgtctcagtctccccaaccagccttactgtacctggtgccatcgacactggggcctgtcatgtacttgtcatggttacggaatgagctgtgggagctatgggaagggtctgggacgattctaaacgagaaagctcgtttgctggaggtctga

SEQ ID NO: 21351 - protein, 400 aa, Sorghum bicolor
  misc_feature: Ceres ANNOT ID no. 8713827
  misc_feature: Up-regulated in root tissues in response to methyl jasmonate treatment
  misc_feature: Up-regulated in shoot tissues in response to methyl jasmonate treatment
  misc_feature (74)..(388): Pfam ID: Peptidase_A22B Pfam Description: Signal peptide peptidase
MGCHISLPSLTYNLALYCVSKGYLLYSDWMESLWKLTYLLEPASLALIATAISVAYASASRALDYGKEMERNLDFSEASITLDRSQALMIPLASSCSLLLMFYLFSSVSHLVTAFTAVASAMALFFCLSPHITYLKTQYNLMDPFVSRCCSKPFTRLQGLLMLFCIATVLAWLVSGHWLLNNLLGISICVAFVSHVRLPNIKICALLLACLFVYDIFWVFFSERFFGANVMVSVATQKASNPVHTVANKLSLPGLQLITKKLELPVKLVFPRNLLGGIVPGSNPGDYMMLGLGDMAIPGMLLALVLFFDNRKFKDVNVPSDVSPPKRRKYVWYALTGYGIGLVAALAAGILSQSPQPALLYLVPSTLGPVMYLSWLRNELWELWEGSGTILNEKARLLEV

SEQ ID NO: 21352 - DNA, 1698 bp, Sorghum bicolor
  misc_feature: Ceres ANNOT ID no. 8713896
  misc_feature: Up-regulated in root tissues in response to aminocyclopropane carboxylic treatment
  misc_feature: Encodes the peptide sequence at SEQ ID NO 21353
atggtggggttgatgatgaactttagaaacaatgcggatgagaagcttgtctgtgctcttagcagcagaaccaccgatgagaaaggatctccaaggaaattgtacataattgatgcccggccaagagcaaatgctttagcaaatggggcaaagggtgggggctcagaatcatcttctaactaccccagatctgaggttctttttttaggaatacaaaacatccacacaatgagagatagtctttctcgccttagggactatgtggatgctcatggctcaatttcatcaaatggaagcccttcagctgtatctgttgttggagatcggaggaatcgtggatcaacctggggtggaggcaatctaaatagcatgacatcattttcttcaacactgggggaatggctaaaccatatccagaatattctggtcggtgcttcatggattgctgcacaaatttcagaagaagcagcgtcagttcttgtacattgcagtgatggatgggaccgtacaacccagttggttgcacttgcttgtttattgcttgatccctattatcgaactttcagtggattccaggctcttgttgaaaaggattggttagcatttggtcatccatttgcagagagaatgggagttccaacagtagctgagaatgtggggtcacagtatgagctactaaggcaaccttccctcggaaatttaagcagttctccaagtaggaacactttagggccatcaggaccatcctctaatccttcagttcaatctcagacatcaaacaactcttcaccgatattgttacagtggctcgattgtatctcgcagttgttacgtctgtacccatctgcatttcagttctcatcaaaattcctagttgattttatggattgtgtgctatcgtgtcgctttgggaacttcttgtgcaatagtgaacgggaaagggagcaatctggtgtcacaaactcctgtcgttgcatgtggtcatatttggctaatctaagagcttctggcggcagcttccatgagcactataatccattctatgatccagtaaagcacaatggtgcactattgccccctgctgcagcacttgccccaacactctggccccagttttatttgaggtggacatgccccattgagtcacaaggtggtgatcttgaatcccaatggcatgctatgaataaaaaatatgcagatgcaatgaaggcaaaggatattgctgagtggagggcaaaagatatcaaattgaaattggaatctatgaaacaagacttgcaaagggagaaacgtgctagtagtacagctttagccacagctcaaagtgctcaaagggagaatgctgccattaagaaggcgatagaatctataggatgcacaattaaattctcgacaagcgaagacgaggacaaaactgaagtgctgtcgtgttcattacgaagaggcgcagatggtagagctcagcaagatgaaaatggtgacttctctgtatcaatctctgcaattgaggacagcctggtctcggatgcaccaggggaccatttttgcgaatcactctgccccttccgcacaagagaagggtgcagatggccagatgctccgtgtgcacagcttggaagtcagtttgtcggtttgaaggcaaattttgatgcttttgaccggttgtctatacaggactgctattttggaccagagtag

SEQ ID NO: 21353 - protein, 565 aa, Sorghum bicolor
  misc_feature: Ceres ANNOT ID no. 8713896
  misc_feature: Up-regulated in root tissues in response to aminocyclopropane carboxylic treatment
  misc_feature (124)..(211): SWISSPROT Homolog: EC 3.1.3.48 Protein-tyrosine-phosphatase
  misc_feature (1)..(69): Pfam ID: Myotub-related Pfam Description: Myotubularin-related
MVGLMMNFRNNADEKLVCALSSRTTDEKGSPRKLYIIDARPRANALANGAKGGGSESSSNYPRSEVLFLGIQNIHTMRDSLSRLRDYVDAHGSISSNGSPSAVSVVGDRRNRGSTWGGGNLNSMTSFSSTLGEWLNHIQNILVGASWIAAQISEEAASVLVHCSDGWDRTTQLVALACLLLDPYYRTFSGFQALVEKDWLAFGHPFAERMGVPTVAENVGSQYELLRQPSLGNLSSSPSRNTLGPSGPSSNPSVQSQTSNNSSPILLQWLDCISQLLRLYPSAFQFSSKFLVDFMDCVLSCRFGNFLCNSEREREQSGVTNSCRCMWSYLANLRASGGSFHEHYNPFYDPVKHNGALLPPAAALAPTLWPQFYLRWTCPIESQGGDLESQWHAMNKKYADAMKAKDIAEWRAKDIKLKLESMKQDLQREKRASSTALATAQSAQRENAAIKKAIESIGCTIKFSTSEDEDKTEVLSCSLRRGADGRAQQDENGDFSVSISAIEDSLVSDAPGDHFCESLCPFRTREGCRWPDAPCAQLGSQFVGLKANFDAFDRLSIQDCYFGPE

SEQ ID NO: 21354 - DNA, 3306 bp, Sorghum bicolor
  misc_feature: Ceres ANNOT ID no. 8713898
  misc_feature: Up-regulated in shoot tissues in response to salicylic acid treatment
  misc_feature: Up-regulated in root tissues in response to salicylic acid treatment
  misc_feature: Encodes the peptide sequence at SEQ ID NO 21355
atggaggtggaggttcgcgtggtgggcggcgcccggagctgcttcgccgcgctcccgctccacctcatccacgccctggagcgcacctccgccaccggcgacctcccgcccgtcctcgcgctcgaacttcgcggccccgccggcgcgcgctggtccctcgcctggtccggcgccgcgtcccgatcccgcgccatcgaggttgcacaagagttagcagaatgcatctcgctgcctgacagaactacagcacagttgagcgtagctcgctctctggccaaagctgactcggtcagtattgaaccctacagtgaggatgactgggagatactggagagccgtgctgatttggctgaagaaacaatcttgaagcagttcgttgttgtgtcatcttttcccgagaagacagttgttcaacttgtaccaggcactgaagttgctgttgcacccaaaaaacgaaaagagaagccttctcaggatctgcaaaagcaaagtgcactgaatgaaccagtcaaaacaaaggcactcctgcgtgttcaagcagctgataggaagtatgcacatacattcaaatataaaggtgttgagataggtgtggttgtcagctatgctgtgctaattcatcctgatacagctgcaagtatttcggttggcaatctccaattagtcactgtttcacctaaatcatcaaagaaaggactagctccaaaaggcaaagaagttggacaaaaaaagggaattccagtaactaaagaaagggcccatgaagccattgtttatatcttactttcagactctgttgcaaaagggcatgttatgcttccctactctattcgtcacttcataagtgctgatgtacattcatgggtatatattaagacatattctgccaacatcaaggaggatgaacctctagtgacaatatctcctttacagttcaagatgcgtgtgaaagatgcccatggtagcagtaaattagtcagtcaagaagcagacacttcgaggataaccaggattccttcagaaaatggtgatttcttccagaaagctcgttacagtgaaagtgaaaatcttcaaggtgcagatattgagagcatttctgaatcagtgtcaaagcagaaattttttattaagcattggcttattggacaccttaaagaaatgggcttgcatgctagccataccgagatgaattcaatagttttgccaaccaatattttgcttcatttagaagtgacagataaagaaggaatcaaaggagttgaatttttatacctactagcacttacttcggaaaattctagtttcaacaattcacaacttaatgttgagactgtttggagtgttccaaccggcaattccgatgatcttgaactgcatttcgggaagttggagctgggtgagcctgtatcttttgattccctagtggacagtggttccagtgatggtttcaagctgacccgatcttctttaggttggatggagaatgcaatgtcagatgtgacaaaaaggttatctgtgctcttatcagcaactagcctaaggttatttaataggataaagttcccctttcctggacatgttcttgtctatggacctcgattttgtttggctttattcctgtttcagggttctggcaaaaccgctttgaccagggcttctgcaaaatactttgaagaccataaagatatcttggcacacatagtatacatagattgttccaaacttgcacttggcaaggctaaggagacaaggcaagagattgaagacagaatatctgaagcactgcttcattcaccttcgatcatcatatttgacgatctggacagtgtaatttcagtctcttcagatcctcaagtgtctcaatcgtccagttcttctgattctcttgtgagatatttaactgacattatggatgagtacaaggataagattcgaaatacatgcgggtatggacctatggcatttatggcttcggttcaatcacttcagagtcttcctcaagacttaacctcttctgggagatttgatttccatattgagcttcctgctcttgcagtcgctgagcgcaaagccctattgcaacatcaagttgaggagcatgagttactgtgttctgaggaagttctatcagagatagcatcaaaatgtgaaggttatgatgcatatgacttggaaattttggttgatagggctgtgcatgctgctgcttatcgctttcttctgccttctaatgcttctcacaactctctgaaacaaactttgctgatggaagatttctctgaagcaatgcatggcttccttccagtcgccatgcgtgatcttaggaaatatgctcctgatgataaagatggtggttgggaggatgttggagggctaaatgaagcagtaactatcattaaagagactcttgaactgccatcaaaatacccaaatatctttaccaaggcacctgtgcggttgcggtcgaacattctcctgtatggaccacctggatgtggtaaaactcacattgtgagagctgcagctgctgcttgttctttgcgattcatttcagtcaagggtccagagctattgaataagtatattggttcatctgagcaatctgttcgcgacttttttgcaaaggccgttgcagcagcaccttgcctattattctttgatgaatttgactccattgcaccccagcgaggaacccatagtgctggagtttctgatcgtgtagttaatcagtttttgacggaactcgatggtgtggagaccttgactggagtatttgtatttgcagctacgagcaagccacagctaattgatgctgcgcttttgcggcctggaaggtttgatcgtctagtcttttgtgatttccctcggtgggacgaacgtttagaaattctgaaggtgcattctaggacggtttcactggcaagtgatgccagtctcgaagatgttgcttctctaactgaaggatttactggtgctgatctcgctgctattctaacggatgctggactagcagcagttcatgaacttttggacaaccaggagaatggtgtcccagaaagtgaaccgtgcatcagcaaagaacttctcatgtctgtcactaggaaggctcgaccttccacaccagcagatgagaagaggcgatacgatagggagtttggtgaattcgtgtcatccaggaagtctatttcgacgaaggtgcccatcattctcattttgaattcctcaacagtcaaaaccatgatgtttttatttaaaagttctagtatcatgttagtgtttttgctacatgatgagattcttggataa

SEQ ID NO: 21355 - protein, 1101 aa, Sorghum bicolor
  misc_feature: Ceres ANNOT ID no. 8713898
  misc_feature: Up-regulated in shoot tissues in response to salicylic acid treatment
  misc_feature: Up-regulated in root tissues in response to salicylic acid treatment
  misc_feature (786)..(1058): SWISSPROT Homolog: EC 3.6.4.3 Microtubule-severing ATPase
  misc_feature (823)..(1007): Pfam ID: AAA Pfam Description: ATPase family associated with various cellular activities (AAA)
  misc_feature (526)..(737): Pfam ID: AAA Pfam Description: ATPase family associated with various cellular activities (AAA)
  misc_feature (94)..(149): Pfam ID: PEX-1N Pfam Description: Peroxisome biogenesis factor 1, N-terminal
MEVEVRVVGGARSCFAALPLHLIHALERTSATGDLPPVLALELRGPAGARWSLAWSGAASRSRAIEVAQELAECISLPDRTTAQLSVARSLAKADSVSIEPYSEDDWEILESRADLAEETILKQFVVVSSFPEKTVVQLVPGTEVAVAPKKRKEKPSQDLQKQSALNEPVKTKALLRVQAADRKYAHTFKYKGVEIGVVVSYAVLIHPDTAASISVGNLQLVTVSPKSSKKGLAPKGKEVGQKKGIPVTKERAHEAIVYILLSDSVAKGHVMLPYSIRHFISADVHSWVYIKTYSANIKEDEPLVTISPLQFKMRVKDAHGSSKLVSQEADTSRITRIPSENGDFFQKARYSESENLQGADIESISESVSKQKFFIKHWLIGHLKEMGLHASHTEMNSIVLPTNILLHLEVTDKEGIKGVEFLYLLALTSENSSFNNSQLNVETVWSVPTGNSDDLELHFGKLELGEPVSFDSLVDSGSSDGFKLTRSSLGWMENAMSDVTKRLSVLLSATSLRLFNRIKFPFPGHVLVYGPRFCLALFLFQGSGKTALTRASAKYFEDHKDILAHIVYIDCSKLALGKAKETRQEIEDRISEALLHSPSIIIFDDLDSVISVSSDPQVSQSSSSSDSLVRYLTDIMDEYKDKIRNTCGYGPMAFMASVQSLQSLPQDLTSSGRFDFHIELPALAVAERKALLQHQVEEHELLCSEEVLSEIASKCEGYDAYDLEILVDRAVHAAAYRFLLPSNASHNSLKQTLLMEDFSEAMHGFLPVAMRDLRKYAPDDKDGGWEDVGGLNEAVTIIKETLELPSKYPNIFTKAPVRLRSNILLYGPPGCGKTHIVRAAAAACSLRFISVKGPELLNKYIGSSEQSVRDFFAKAVAAAPCLLFFDEFDSIAPQRGTHSAGVSDRVVNQFLTELDGVETLTGVFVFAATSKPQLIDAALLRPGRFDRLVFCDFPRWDERLEILKVHSRTVSLASDASLEDVASLTEGFTGADLAAILTDAGLAAVHELLDNQENGVPESEPCISKELLMSVTRKARPSTPADEKRRYDREFGEFVSSRKSISTKVPIILILNSSTVKTMMFLFKSSSIMLVFLLHDEILG

SEQ ID NO: 21356 - DNA, 1830 bp, Sorghum bicolor
  misc_feature: Ceres ANNOT ID no. 8713901
  misc_feature: Down-regulated in shoot tissues in response to salicylic acid treatment
  misc_feature: Encodes the peptide sequence at SEQ ID NO 21357
atggataagcaggagccagtagccaatgtcgaacaaaagataggtctctctgagaagcctaaggagcagcctgttgccagtaaggatgagaaagcagctgtaccaccaatttcagttgattcaaatgctatcgatctaccaagtgaaggccaaacccaagctggcacatccaacatggatgggggccataatggtgcacacaacttctatgcttctcaggcacagccattctattaccaaggctccggatatgaaaacactccacaagaatgggacacatatcctccctacatgagtgtcgaaggattggaagtgggcccaccagttgtatacaatgaggacccctcattgatgttccatggtggctatggttatgacccatatgctcattattctcctattgcaacacctgtaccgactgctgttagtggagatggtcagctctactcccctcagcagttctccttctcggctccttactaccagcagtcagtaccacctggcatgccatatttaagctctcctactccaatatcacagggtgatacaaatacaatgatgccgattgacccaacacaaggagcttttatcgctgataccctgagtccaaacagcttcctgtttggcccaagacctgaatggttcagatcttcagaaggaactgggtcatttccatcacctgcagcttcacctcaaccttctagtggtgttccagggacctatggccaaagcaactttccaatggcttcaggaatggcatcgcctcaccagaagcccttctatggtttgggatccacagctgactcctacggaaggggtttttctcatggtggaatgttcccacaggccagcaattatggaggatccttcaccagctttggctttaatggtagaagttcgatctcgatcgagaaagggcgtaggaggggaaggggtaatgcacttatttgcagctgcaatggcccacttgactttcttaatgagcaaagtcggggtccacgtgctactaagcctaagaagcaaccagaggttgacagtaaggatgagaagcctaccacaggagttggtcgtgagtcatacaacaagcctgactttgttacagagtacatgaatgccaggtttttcatcataaaatcatacagtgaagataatgtgcacaagagtgtaaaatatggtgtttgggctagcaccacaaatggaaacaagaaactggacttagcatatcgtgaagctaaggagaaggaagagcactgtcccatttttctgttattttcggtgaatgccagtgcacaattctgtggtgttgctgagatgattggaccagtggactttgagaaaagtgtggattactggcagcaagataagtggactggtcaattccctgtgaagtggcacatagtgaaggatgtccccaataatcttttccggcatataattcttgaaaacaacgacaataaacctgtaacaaacagccgagatacacaggaggtgaaactagagcaaggactggagatgctgaagatctttaagaaccatgatgatgatgcatcaatccttgatgactttgacttttatgaggagcgtgagaaagcactgcaggaaaataaggcacgcctgcatcagcaacatctacccagttctattgttgttgagcccaagaaacccttgactgtacccactgacctcgtgagccatatcaccaagagttttgctcaggctgtgcggcttggtgaggccaagactgtaagccctttggctgagaaagtttctggcggtgattcgtctattcctgtgaagcctgttgaagttaagcagagtggtttatcttag

SEQ ID NO: 21357 - protein, 609 aa, Sorghum bicolor
  misc_feature: Ceres ANNOT ID no. 8713901
  misc_feature: Down-regulated in shoot tissues in response to salicylic acid treatment
  misc_feature (422)..(512): Pfam ID: YTH Pfam Description: YT521-B-like family
MDKQEPVANVEQKIGLSEKPKEQPVASKDEKAAVPPISVDSNAIDLPSEGQTQAGTSNMDGGHNGAHNFYASQAQPFYYQGSGYENTPQEWDTYPPYMSVEGLEVGPPVVYNEDPSLMFHGGYGYDPYAHYSPIATPVPTAVSGDGQLYSPQQFSFSAPYYQQSVPPGMPYLSSPTPISQGDTNTMMPIDPTQGAFIADTLSPNSFLFGPRPEWFRSSEGTGSFPSPAASPQPSSGVPGTYGQSNFPMASGMASPHQKPFYGLGSTADSYGRGFSHGGMFPQASNYGGSFTSFGFNGRSSISIEKGRRRGRGNALICSCNGPLDFLNEQSRGPRATKPKKQPEVDSKDEKPTTGVGRESYNKPDFVTEYMNARFFIIKSYSEDNVHKSVKYGVWASTTNGNKKLDLAYREAKEKEEHCPIFLLFSVNASAQFCGVAEMIGPVDFEKSVDYWQQDKWTGQFPVKWHIVKDVPNNLFRHIILENNDNKPVTNSRDTQEVKLEQGLEMLKIFKNHDDDASILDDFDFYEEREKALQENKARLHQQHLPSSIVVEPKKPLTVPTDLVSHITKSFAQAVRLGEAKTVSPLAEKVSGGDSSIPVKPVEVKQSGLS

SEQ ID NO: 21358 - DNA, 4224 bp, Sorghum bicolor
  misc_feature: Ceres ANNOT ID no. 8714047
  misc_feature: Up-regulated in root tissues in response to salicylic acid treatment
  misc_feature: Up-regulated in shoot tissues in response to salicylic acid treatment
  misc_feature: Encodes the peptide sequence at SEQ ID NO 21359
atggctgagtcactgcttctcccctgggtgcaaggcttggtcggcaaggcggccgacgcgctggtccagaacatcaccagcatgtggggcgtcgatacctatcgccggaagctggagcgacagctggtgtacgtgcggtccttactagccgacgccgaggagaaagccgaggcgaagactgaggccggccgcgccgtcaaggcgtggatgaagaagctcaaggctgccgggtacgaggccgacgacgtcctcgacgacttccgctacgaggctctgcgccgggaggcccaggccggggagtcaacggcacgcaaggtactgtatttctcgcgggatcgacttgtattccatcataaggcgagcagggatctcaaggacatactcgacaagattgacgagctggtggcggagatgaacccttttggtctgctgcagcgcgcggaggcgccacgaaatctgtatcggcaaacatactctgcaatggatgagtctatggagatctttggcagagacgatgacaaggaggtgctggttaagttgttgctggatcagaaaggtctgcatcgtgtgcaggtgctgcccatcattggaatgggtggtttgggcaagaccactctagccaagatggtgttcaacgacagcagggtccagaagcactttgacttgaagatgtggcactgtgtgtctgagaactttgaagctacagctgtcgttagatctgtcattgaggtggctacaaatgaaagatgttacctggctaacaacattgagctgctaagaaaaaaactgcaggaagtcatcgggcttttgtctatggagatctttggcagagacgatgacaaggaggtgctggttaagttgttgctggatcagaaaggtctgcatcgtgtgcaggtgctgcccatcattggaatgggtggtttgggcaagaccactctagccaagatggtgttcaacgacagcagggtccagaagcactttgacttgaagatgtggcactgtgtgtctgagaactttgaagctacagctgtcgttagatctgtcattgaggtggctacaaatgaaagatgttacctggctaacaacattgagctgctaagaaaaaaactgcaggaagtcatcgggcagaaaaggttcctgctggttcttgatgatgtgtggaatgaagagcaaagcaagtgggaagacgacctgaagcctttactgtgttcgtctaatggtggatcaggaagcatgatagttgtcacaagtcgaagtcaacaggtggcctctataatgggtacccttgcaccccatgagctaaaatgcctgggtgaagatgattcatggacattgttctcaaataaagcattcagtaatggactacaagagcaatcagagttttccacagttggcagacgcattgtcaacaagtgcaagggactgcctcttgctctcaaggcaatgggaggcttgatgagctcaaaaccaagagtccagcaatgggaggacattgccaaaagcaatttgggtggggccgaagatgaagtgttgtccatactaaaattgagctacaggaacttgtcatctgaaatgaagcaatgctttgcattttgtgcagttttccctaaggactatgtgattgagaaggatatgttgacccaactatggctggcaaatgttttttttcatgaagtagaaggtgcaacgaaaaaattgttggcacagaaagccgaatttgttttcaacgaattagtttggagatcttttcttgaagatgtgaaagagagacgatttttttatggtcgaaggcacaatccaattggatgtaaaatgcatgatttagtgcatgacctagcaaaagatgtcacagatgaatgtgcatttgcaacagagctgactcagagcaaagcatcgataaaagatgtatatcatatgcaaatttcaagagatgaatccaaagaaattagtggactactgaaaggcacatcacctctccgtactttattaactcaatcaaagtacagtgatcttaaggagttaaaactgatgtcattaagagctttgtgctgtgaagatccttatattatcgacaaccagcttataaatgcagcacatttacgatatcttgatctttctttctcagacattgttggattaccagattcattatgcatgttatataatttacagtcgttgaggcttaataattgtcaaaggctacaatttttgcctgaaggtatggcagctttgaggaacctcgagcatctttatcttttcagatgtgagagtttaaaacggatgccaccaaaacttagcctactgcataaccttcgcatactgacaacatatattgtggacactgaagatggttgtggaatcgaagagctcaaagacctacatcagcttggaaacagattggagctgtacaatttgtgtaaagtaaagactgggtcagaggccaacatccatgagaaacagaatctaagtgaattgttgttgcactgggggcgcaatctatcttacgaccgtgcaagtgaggaagccagtaatgcggaacaagtactagaatcacttgcacctcctggtgagctcaaagttttggagctacatcggtatggtggctcagcaatctcacaatggatgagagaccctagaatgttcaggtgcctcaagaaactccacatttcctgctgtcaaagatgtaaggagctaccaatggtatggttgtcatcctctcttgaggagttgtttttatccagcatgaacagcatgaccacattatgtaagaacgttgatgaagaaggtgcagggtacaataaccatctgcaaattttcccaaagttgaacaagatggagctacaggatttgccggagttggagagatgggcagaaaacagtgcaggagagcctagcaggtcggtagtgtttcccctgctcaaagtgttaagagtcgaggattgtcctaaactcactagtcttccggagtgtccatttctcacacatctatattgccacacttcctggttgagaagtgctgccccttcctcgctgagaactgttgccacttcgactgtgagcatgccattgggcttctggccatctttagtgcacctggaagtgggtgtgctatcagacatggtcattcctctacagaaccagcaaggccaaagccaaagacccctagacaccctgcgaagtttgaaagtacaccatgacgagggctttgtatccatatttaaccattccaaattgcagctcgggcttaaggattgcattctcttcttggaacggatggaattcaactcatgctccaatattgtctgctggcctgtggaggaactccgatgcttgccctgccttcgatctctgtattttttgcattgcagcaagctggaggggaaaggctcatcgtatgaagaaatccttccactgccccagcttgaaacgttgcagatagcttcttgtgacagcttgttggagattccaatgttgcctccctcccttgaagaattggggattgacatgtgtggaagtttgctggcgcttccttcaaaccttggaagtctggtcaagcttagggatctatatttgtttcgctgctatggactgaaagcactacctaatggaactgaaggcctcacttctcttgagcagttgacgatcaatgagtgtccagggatagagaaatttcctcatggtctgctccagcggctcccagctctcaaatacctacacatagagggctgccccgacctgcagagatgttgcagagaaggtggtgagtactttgactcggtgtctccaattccgaggaagaccattctatcagtagaatccgagctacagaagcccgcaggtgtacagtgcgccgtctgctttctgaacccttacgtacacaagaggtatttatgctcccacatgtacatcacctcgattccgttatcctgttcaatcgttctgacatcaatctggtgcacaacttcgttctgcttacgtatgtacaatagaactgaactatgtttatccgaatgcatactcactgtcttcttgtctgctatacttcagtatttggctatattagactatctccaacaatggtcacctaaattacaagacctatttgtcctttgggtagcgctacagcagtgtgtgatgattgtcctcgtaacagtgaacaagaagcgtcactttgaccggagagcaagaccctttataccatatgtcctcttttgtttaccatag

SEQ ID NO: 21359 - protein, 1407 aa, Sorghum bicolor
  misc_feature: Ceres ANNOT ID no. 8714047
  misc_feature: Up-regulated in root tissues in response to salicylic acid treatment
  misc_feature: Up-regulated in shoot tissues in response to salicylic acid treatment
  misc_feature (258)..(561): Pfam ID: NB-ARC Pfam Description: NB-ARC domain
MAESLLLPWVQGLVGKAADALVQNITSMWGVDTYRRKLERQLVYVRSLLADAEEKAEAKTEAGRAVKAWMKKLKAAGYEADDVLDDFRYEALRREAQAGESTARKVLYFSRDRLVFHHKASRDLKDILDKIDELVAEMNPFGLLQRAEAPRNLYRQTYSAMDESMEIFGRDDDKEVLVKLLLDQKGLHRVQVLPIIGMGGLGKTTLAKMVFNDSRVQKHFDLKMWHCVSENFEATAVVRSVIEVATNERCYLANNIELLRKKLQEVIGLLSMEIFGRDDDKEVLVKLLLDQKGLHRVQVLPIIGMGGLGKTTLAKMVFNDSRVQKHFDLKMWHCVSENFEATAVVRSVIEVATNERCYLANNIELLRKKLQEVIGQKRFLLVLDDVWNEEQSKWEDDLKPLLCSSNGGSGSMIVVTSRSQQVASIMGTLAPHELKCLGEDDSWTLFSNKAFSNGLQEQSEFSTVGRRIVNKCKGLPLALKAMGGLMSSKPRVQQWEDIAKSNLGGAEDEVLSILKLSYRNLSSEMKQCFAFCAVFPKDYVIEKDMLTQLWLANVFFHEVEGATKKLLAQKAEFVFNELVWRSFLEDVKERRFFYGRRHNPIGCKMHDLVHDLAKDVTDECAFATELTQSKASIKDVYHMQISRDESKEISGLLKGTSPLRTLLTQSKYSDLKELKLMSLRALCCEDPYIIDNQLINAAHLRYLDLSFSDIVGLPDSLCMLYNLQSLRLNNCQRLQFLPEGMAALRNLEHLYLFRCESLKRMPPKLSLLHNLRILTTYIVDTEDGCGIEELKDLHQLGNRLELYNLCKVKTGSEANIHEKQNLSELLLHWGRNLSYDRASEEASNAEQVLESLAPPGELKVLELHRYGGSAISQWMRDPRMFRCLKKLHISCCQRCKELPMVWLSSSLEELFLSSMNSMTTLCKNVDEEGAGYNNHLQIFPKLNKMELQDLPELERWAENSAGEPSRSVVFPLLKVLRVEDCPKLTSLPECPFLTHLYCHTSWLRSAAPSSLRTVATSTVSMPLGFWPSLVHLEVGVLSDMVIPLQNQQGQSQRPLDTLRSLKVHHDEGFVSIFNHSKLQLGLKDCILFLERMEFNSCSNIVCWPVEELRCLPCLRSLYFLHCSKLEGKGSSYEEILPLPQLETLQIASCDSLLEIPMLPPSLEELGIDMCGSLLALPSNLGSLVKLRDLYLFRCYGLKALPNGTEGLTSLEQLTINECPGIEKFPHGLLQRLPALKYLHIEGCPDLQRCCREGGEYFDSVSPIPRKTILSVESELQKPAGVQCAVCFLNPYVHKRYLCSHMYITSIPLSCSIVLTSIWCTTSFCLRMYNRTELCLSECILTVFLSAILQYLAILDYLQQWSPKLQDLFVLWVALQQCVMIVLVTVNKKRHFDRRARPFIPYVLFCLP

SEQ ID NO: 21360 - DNA, 3456 bp, Sorghum bicolor
  misc_feature: Ceres ANNOT ID no. 8714140
  misc_feature: Up-regulated in root tissues in response to methyl jasmonate treatment
  misc_feature: Up-regulated in shoot tissues in response to methyl jasmonate treatment
  misc_feature: Encodes the peptide sequence at SEQ ID NO 21361
atggctgagtcgctcctcctccccgtggtgcgcggcgtgcttggcaaggccaccgatgcgctcgtcaagaatgtcagccgcatgtggggcatcgacggcaaccgccgcgacctggagctcaagtttctgtacgtgcagtccctactggccgacgccgaggcgaaggccgaggcggacaccgaggccggccgcgccgtcaaggcgtggatgaaggagctcagggccgccgcgtaccaggccgacgacgttctcgacgacttccagtacgaggcgctgcgccgcgaggcccacagccttcgttctacctccagcaaggtacttgactacatcaccttcagaaatccactggtgttccgtcttaaagcgagcagggacctcaagaatgtgctggacaagatccacaagctggcacacgcatcggcactggacgagtctgcagacttcattggaagagacaacgacaaggatttcgtggtgaagcttttgctggaccagcaagatcagcggaatgtgcaggttctgcccatcataggaatgggaggtctgggcaagaccacactagccaagatggtgtacaatgacagcaatattcagaagcactttgagttgaagatgtggcactgtgtctcagacaacttcgaagccatttctgttgtgagatccatcatagagttggctacaaatgcaagatgtgacctgcctgacaccatagagctgttgcaagggaagctgcatgaagttgttgaccggaaaaggttcctactagttcttgatgatgtgtggaatgaagatcagcagaagtgggaggatgatcttaagccgctgctatgtttttctaatattggattgggaagcatgattgttgtcacaagtcgaagccaaaaagttgcctctataatgggcactcttccacaccatgaactagcatgcttgagtgatggtgattcatgggaattgttctcaaagaaagcatttagtaaaggggtgcaaaagcaagaagagttgataacgatcggtaaactgattgttagcaagtgcaagggactacctcttgctttaaagacaatgggtggcttgatgagttccaaacatcaaattaaggaatgggaggccattgcagaggatgatagggttggcaaagatgaagtattgtccattttaaaattgagctacatgcacttgtcatccgaaatgaagcaatgctttgccttctgtgcggtattccctaaggattatgagatggataaggataagttaatccaactatggatggcaaacaattttattcatgcagatggaactacagattttgtgcagaaaggtgaatttattttcagcgagttggtgtggaggtcatttattcaagatgtggatgtcaagatatttgatgaatatcatttcgctgcacctgcacacaagaaaattgggtgtaaaatgcatgatttaatgcatgacttagcacaagaaactacagatgagtgtgttgttgaagcagagctaattcagcggaaaacattgataaacaatgtacgtcacatccagttgtcatggtctaaaccaaaagaacaaatcactagattgatggaaaactcatctcctatccgcactttattaactcagtcagcacacgtgtcttttagtaaatcagatctcaaggcactcaagaagttaaaactaacatcattaagagcactacgttggggaaaccgatctgttatccgtacaaagctcataaatacaacacatttaagatatcttgatctttcggggtcaagaattgttagattgccgtcttcagtttgtatgttgtataatttgcaatcattgattctggatcattgttggaaactagagtttttaccggaatgcatgcaaactatgagaaacctcacccacatttatttaacaggatgtgataagttgaagcggatgcctccaaaacttagtctgctacacaacctctgcacactcacaaaatttattgttgactatggagatggctttggtattgaggagctcaaagacctaagacaacttggaaataggttggaactgttaaatttaaggaaagtaaagagtggttcgaagatcaatctccatgagaaaaagaatctaactgaactatttttgcattggggtcgtagcagaaaatacaatccattgcataatgaggtcatcagtaacaatgaggaagaagtgctagaatctcttgcacctcatgttgagctgaaaacaatggggctacatgggtatgctggcttatccatctcacaatggatgagagacccacaaaagtttcagtgtttaagagaactatatatttccaactgcccaagatgtaaggatatgccatttgtgtggttatcatcctctcttgagaaattgtatttacgctgcatggatagcctgtctgtattatgtaagaacattgacatggaaggttcaaggtgcaatacctctctagcaatttttccaaagttaaagacaatgtggttggagacattgccagagttggagagatgggcagaaaacagtgcaggagaacctaatagtttgttggtgtttccccagctggaagagctgcacatcatcaactgcatgaaaattgcaactcttccggaaagcccagctctcacttctctaaattgttacagtaagcctgtagaaggcctcgttcctatgggcatccctttgggatcttgtccatctattgtccagttgaacattgggatgctggtagacatggtgatgcctgtaaagaatcatcaaaaccaaagccaaagacctccgctagactgcctgagaagtttgcgtgtacaaaatgacagtggcttcatatcagtgttcaactcatccaaattgcaacttggtcttggggattgcctggccttcgtggaacaattggaaatctcatcatgcgacaatattttgcactggccagtagaggagttcagatgcttggttgggcttcgatctctggatattaaatggtgcgacagactagaggggaagggctcatcatccaaggaaatccttcctctaccccagttggaaaggttggaaatatatagctgtgatagcttgctggagataccgaagctgcccgcttcacttggggaattggagattaattcgtgcagaagtttggtggcgctgccttcgaaccttggagatctgccaaaattgaggcatctcaatctgtgggtctgcgatgagctgaaagtgctgcctgatgggatggatggcctcccttctcttgagcaactgtggatcggttcttgccctgggattgataaatttccacagggcctcctccagcggctcccggccctcagatccctggacatacggggctgccctgacctgcagagacgttgcagggaaggtggggactacttcgactttgtctctccaattccagataaagacatacccgcagcaacaacaaaaccctaa

SEQ ID NO: 21361 - protein, 1151 aa, Sorghum bicolor
  misc_feature: Ceres ANNOT ID no. 8714140
  misc_feature: Up-regulated in root tissues in response to methyl jasmonate treatment
  misc_feature: Up-regulated in shoot tissues in response to methyl jasmonate treatment
  misc_feature (573)..(1116): SWISSPROT Homolog: EC 2.7.11.1 Non-specific serine/threonine protein kinase
  misc_feature (132)..(434): Pfam ID: NB-ARC Pfam Description: NB-ARC domain
MAESLLLPVVRGVLGKATDALVKNVSRMWGIDGNRRDLELKFLYVQSLLADAEAKAEADTEAGRAVKAWMKELRAAAYQADDVLDDFQYEALRREAHSLRSTSSKVLDYITFRNPLVFRLKASRDLKNVLDKIHKLAHASALDESADFIGRDNDKDFVVKLLLDQQDQRNVQVLPIIGMGGLGKTTLAKMVYNDSNIQKHFELKMWHCVSDNFEAISVVRSIIELATNARCDLPDTIELLQGKLHEVVDRKRFLLVLDDVWNEDQQKWEDDLKPLLCFSNIGLGSMIVVTSRSQKVASIMGTLPHHELACLSDGDSWELFSKKAFSKGVQKQEELITIGKLIVSKCKGLPLALKTMGGLMSSKHQIKEWEAIAEDDRVGKDEVLSILKLSYMHLSSEMKQCFAFCAVFPKDYEMDKDKLIQLWMANNFIHADGTTDFVQKGEFIFSELVWRSFIQDVDVKIFDEYHFAAPAHKKIGCKMHDLMHDLAQETTDECVVEAELIQRKTLINNVRHIQLSWSKPKEQITRLMENSSPIRTLLTQSAHVSFSKSDLKALKKLKLTSLRALRWGNRSVIRTKLINTTHLRYLDLSGSRIVRLPSSVCMLYNLQSLILDHCWKLEFLPECMQTMRNLTHIYLTGCDKLKRMPPKLSLLHNLCTLTKFIVDYGDGFGIEELKDLRQLGNRLELLNLRKVKSGSKINLHEKKNLTELFLHWGRSRKYNPLHNEVISNNEEEVLESLAPHVELKTMGLHGYAGLSISQWMRDPQKFQCLRELYISNCPRCKDMPFVWLSSSLEKLYLRCMDSLSVLCKNIDMEGSRCNTSLAIFPKLKTMWLETLPELERWAENSAGEPNSLLVFPQLEELHIINCMKIATLPESPALTSLNCYSKPVEGLVPMGIPLGSCPSIVQLNIGMLVDMVMPVKNHQNQSQRPPLDCLRSLRVQNDSGFISVFNSSKLQLGLGDCLAFVEQLEISSCDNILHWPVEEFRCLVGLRSLDIKWCDRLEGKGSSSKEILPLPQLERLEIYSCDSLLEIPKLPASLGELEINSCRSLVALPSNLGDLPKLRHLNLWVCDELKVLPDGMDGLPSLEQLWIGSCPGIDKFPQGLLQRLPALRSLDIRGCPDLQRRCREGGDYFDFVSPIPDKDIPAATTKP

SEQ ID NO: 21362 - DNA, 1473 bp, Sorghum bicolor
  misc_feature: Ceres ANNOT ID no. 8714153
  misc_feature: Up-regulated in root tissues in response to salicylic acid treatment
  misc_feature: Encodes the peptide sequence at SEQ ID NO 21363
atgaagagcggcgggggaggaggaggaggaggaggcgggggcgggcagcagtggccgtgcgactactgcggggaggcggcggcggcgctgcactgccgcgcggacgccgcgcggctctgcgtggcgtgcgaccgccacgtgcacgccgccaacgcgctgtcgaggaagcacgtgcgcgtgccgctctgcgcggggtgcgccgcgcgcccggccgccgcgcgggtctccccagtcccgggcgccgacccggcgttcctctgcgccggctgctgcgacgacgccgcctcggcggcggtgcgcgtgccggtcgagggcttctcgggctgcccctcggcggccgagctcgccgcgtcatgggggctcgacctccgccgcgcggaggagggcaaggacggcgccggcggcgacatcgacgacggcgaccccttcctctcggtgctcgactactccgtgctcggggtggcggtcgacccggacctgcgcgacctctacgtgccgtgcgacccgccgcgggttcccgcccccgacgccgccggggcgcgcccgctcagggggcaggcgctgtgcgaccagctcgccgagatggcgcgacgcgagacggacacagcccacgcgcacccgcactcggatctgagcccgcgcacgcctcgccgcacctctgcggcatccggtggacgcttgccgccgggcaagatgtcgccccccgcggcgatgccgactcatcatcctccgcccgccgcggtccaggaggtgcctctgccgtacacgtccctgctcatgatggcgtccgccaactgcgccgacctcattggaggtgccgacagggtgggtgatgacgacgaacaactgctctgggactgcgctgcgccctcagtgccgcccacccagatttgggacttcaatttgggaaggtcaagggatcacgatgagaagtctgctcttgaagttggatatggttctaaccatggaggctttatgattaagagttatagtgacatgcttaaggaaatttcttcggggacaacgaaagatctggaagatatttatgactcaagatactgctcaactgccgaagatatcatgtcctctaatatctgtcagttgtcatcgaaaaatgtgagcaccgcgagcaacaaacggaagctgagctcctgtgcctcgacgatcgatggaccaacaacctctggaaaccatgtacccacatcaggaccagcactcaccagggagatctccttcggggatcaaacggtctccacccctgcagctgagaggcctgctgtgaggatcgacagcgagacgctcgcgcagaatagggacagcgctatgcagcggtacagggaaaagaagaagaaccgcaggtatgagaagcacatacggtacgagtcgaggaagctgagggcggacacaaggaagcgggtgaaagggcggttcgtcaagtcgaccgaagccctgaacgccggctatggcggatga

SEQ ID NO: 21363 - protein, 490 aa, Sorghum bicolor
  misc_feature: Ceres ANNOT ID no. 8714153
  misc_feature: Up-regulated in root tissues in response to salicylic acid treatment
  misc_feature (438)..(482): Pfam ID: CCT Pfam Description: CCT motif
  misc_feature (15)..(62): Pfam ID: zf-B_box Pfam Description: B-box zinc finger
MKSGGGGGGGGGGGGQQWPCDYCGEAAAALHCRADAARLCVACDRHVHAANALSRKHVRVPLCAGCAARPAAARVSPVPGADPAFLCAGCCDDAASAAVRVPVEGFSGCPSAAELAASWGLDLRRAEEGKDGAGGDIDDGDPFLSVLDYSVLGVAVDPDLRDLYVPCDPPRVPAPDAAGARPLRGQALCDQLAEMARRETDTAHAHPHSDLSPRTPRRTSAASGGRLPPGKMSPPAAMPTHHPPPAAVQEVPLPYTSLLMMASANCADLIGGADRVGDDDEQLLWDCAAPSVPPTQIWDFNLGRSRDHDEKSALEVGYGSNHGGFMIKSYSDMLKEISSGTTKDLEDIYDSRYCSTAEDIMSSNICQLSSKNVSTASNKRKLSSCASTIDGPTTSGNHVPTSGPALTREISFGDQTVSTPAAERPAVRIDSETLAQNRDSAMQRYREKKKNRRYEKHIRYESRKLRADTRKRVKGRFVKSTEALNAGYGG

SEQ ID NO: 21364 - DNA, 2481 bp, Sorghum bicolor
  misc_feature: Ceres ANNOT ID no. 8714236
  misc_feature: Up-regulated in root tissues in response to aminocyclopropane carboxylic treatment
  misc_feature: Encodes the peptide sequence at SEQ ID NO 21365
atgtatcgggcagtcctctgctcggtcgagtctcatctccgaacccaacccgttgacgagcataggggagataccatctatggcgctggggagcgaatccacgaagacggtgagcgaatccgcggtgacggcgagcagatccgcggccgtggccaccgcatccatggcgacggcacccacgaagaccgacagttccgccgagtgctgatgaggagtagtagtcgccgcggcagaacctgcagcttctcgtgcctcatgagacgggtcgaccccgagctccgttgccgtcgtcttccggcaagcgcgatggggaagacgcctccgaagaaggaggcggagggaagcccccggaataaagctcggcgggtggatgacgcggctccgactacgggttctgtggcgtcggcaccgagtccgacggggaagacgccgccgaaggcggaggaggcggagggaagtccgcggaagaaagctccgcggctggacgacgcggctctggctacggctcctggggcgtcggagcggaaaccgacggggaagtcgccgccgaagggtgtggcggagggaagcccgccgaagagatctcgaagcccgcggaataaatctccgcggcggcaggacaaatggcccgcagcggcactgcctctgcttacggttcctgagtcgtcggagctgatcgtggaagcagcggggcgggccagcgatgagaagcggtgcaagtgcaatcacgtcatcactgacagtgctatcgagaaattgattgcatcgctcaggtccaaggacgcatggacttgctatggttgttggcacgaattcaagaaggggatcatcagaatcaggcccgagaagagcgatctcttgatctgcgtgacatgctacgaccatctctgctgcggggttgggtcaattgcttacccgtttgggcactctcgagcacacgccctgaagaagaagcactggtttgctgttctgtactgtgatccagaaagaggatactgcttcaagtgtaacactgaggtgccaatgccggtcaaatttggggatggtgacgaggttggtcttcaagagatccgcaatattgtcagtcgaaagttactggctgccccaccatctgttggtcaaactgaggcggtcaatccaaagaaggtggaaatgacgggcaaagttcaggcagaaagccatccatctgggtttggtgtggatcttgcagacaaatggcctagctatggatccagatcatctgattcgcaaggctatgctatcagagggataccaaatcgaggaaacacatgctacatgagtgcagtattgcagtgcctatttgtgcttggtaagctgcgagaaaggatgttagcattggatcgtccaaaaagtcgccttgtcaaggtactcaaggagctttttctggaggcaagtgctgcaggagacttgctgaacccaaatgaagttttggaatgtgtaagcaaggactgtgcgccacgattcagagttggggctatggaagacagccacgaattgcttatggccttgcgcgacctttggaaccaaggtgaggtgaatgataactggcaaagtcatgcccctacagcaatggattccatttttaggtttaagatgcttcagacactatcctgcaaaaaatgtggttattcgtctccgacatccgttgatttatgggacctgaaattggatttcccatcaaagtggcatccaactaaaagtgctgcatcacaacaaacaagcgagagccccagatctcgaaagagggagattgctggtcaattatttccagcagatgtgcagagaaacttggaaaagatgcaaatagtttctggttattctcatgttattggttcagaggtgactttggaggaaacacaaaagcctttggaagttgattctactcaagcgcaacatatcagtcaaagcaaggatgttgtacagagtcgtttgcagattcaggagggcaagtctgttgattcacggacagaagattcaatgtcaattgaagaattcctaatgctgttttctgaagaagaccagatagtatggaagtgtactaattgtgccaaggatcatgaggagccaagtgccagtcaaagtaaaagtggtgagcagatagtgggaagcggcaatgaagatgatgttggagatactaataagattcttcgttttaccatgcttccacctgtctttgtcgacaaaggaaggaccctctatcgtctagctggtgttgtacagcacattgacattggcaacggcaagagatccttgaagtcaggacactacattgcgtacgttagagcaagaaggcttggacatcagcaagagggtagcagctgttcttcctcatggttttgtgcagacgacagtgatatcaaacaagtcactcttgaagaagttctcaactgtgaggcctatattcttttctatgagaggatggaaggcgaagacatttctggcataagacgtcagaactaa

SEQ ID NO: 21365 - protein, 826 aa, Sorghum bicolor
  misc_feature: Ceres ANNOT ID no. 8714236
  misc_feature: Up-regulated in root tissues in response to aminocyclopropane carboxylic treatment
  misc_feature (383)..(582): SWISSPROT Homolog: EC 3.1.2.15 Ubiquitin thiolesterase
  misc_feature (419)..(811): Pfam ID: UCH Pfam Description: Ubiquitin carboxyl-terminal hydrolase
MYRAVLCSVESHLRTQPVDEHRGDTIYGAGERIHEDGERIRGDGEQIRGRGHRIHGDGTHEDRQFRRVLMRSSSRRGRTCSFSCLMRRVDPELRCRRLPASAMGKTPPKKEAEGSPRNKARRVDDAAPTTGSVASAPSPTGKTPPKAEEAEGSPRKKAPRLDDAALATAPGASERKPTGKSPPKGVAEGSPPKRSRSPRNKSPRRQDKWPAAALPLLTVPESSELIVEAAGRASDEKRCKCNHVITDSAIEKLIASLRSKDAWTCYGCWHEFKKGIIRIRPEKSDLLICVTCYDHLCCGVGSIAYPFGHSRAHALKKKHWFAVLYCDPERGYCFKCNTEVPMPVKFGDGDEVGLQEIRNIVSRKLLAAPPSVGQTEAVNPKKVEMTGKVQAESHPSGFGVDLADKWPSYGSRSSDSQGYAIRGIPNRGNTCYMSAVLQCLFVLGKLRERMLALDRPKSRLVKVLKELFLEASAAGDLLNPNEVLECVSKDCAPRFRVGAMEDSHELLMALRDLWNQGEVNDNWQSHAPTAMDSIFRFKMLQTLSCKKCGYSSPTSVDLWDLKLDFPSKWHPTKSAASQQTSESPRSRKREIAGQLFPADVQRNLEKMQIVSGYSHVIGSEVTLEETQKPLEVDSTQAQHISQSKDVVQSRLQIQEGKSVDSRTEDSMSIEEFLMLFSEEDQIVWKCTNCAKDHEEPSASQSKSGEQIVGSGNEDDVGDTNKILRFTMLPPVFVDKGRTLYRLAGVVQHIDIGNGKRSLKSGHYIAYVRARRLGHQQEGSSCSSSWFCADDSDIKQVTLEEVLNCEAYILFYERMEGEDISGIRRQN

SEQ ID NO: 21366 - DNA, 1431 bp, Sorghum bicolor
  misc_feature: Ceres ANNOT ID no. 8714219
  misc_feature: Up-regulated in root tissues in response to salicylic acid treatment
  misc_feature: Encodes the peptide sequence at SEQ ID NO 21367
atggaggacgtgatggtctcctccgtgggtccccacttcagcgggctccgcctcgactcgcgccgcctctcctcctcgctctcgccgtcctcctccccctcccgctccgccaacgccgacgcctcgctggggttcgcatccccgaaggcggacgggaccaggaggcccttcgtcataggcgtatgtggagggaccgcgtcggggaagacgacggtgtgcgacatgataattcagcagctccacgaccaccgcgtcgtgctcgtcaaccaggattcattctaccgtggtttaactgaggaacagtctgagcaggtgcaagactacaattttgatcaccctgatgcattcgatacagatcaacttttggtgtgcatgggaaagctgaaaagtggacagtccgtgaatattcctatatatgattttaagaatcacaggcgatgctctgaaaaatttaggaaggtcaatgaatcagatgtcatcattttggaggggatcttggtttttcatgatcagagggttcgtgatttgatggacatgaaaatttttgttgacacagatgctgatattagacttgctagacgtataaggcgtgatactgttgaaagaggtagagatgttacctcagtgcttgagcagtatgttagatttgtcaagcctgcatttgatgcttttgtcctgccttcgaagaaatatgctgatgtgatcataccaaaagggggagataaccatgttgcaattgatctaattgtgcaacatatccacacaaaacttggtcagcataacctgtgcaaagtctacccaaatgtctttgtcgtacacacaactttccagatacgaggaatgcatactctcattcgtgacaagaacattactacacctgactttgttttctactcagataggctgattcgtctggtggttgagcatggtcttgggcatttgccatttacagagaagcaggtggttacaccaacaggatctgtttacatgggagttgacttctgcaagaagctctgtggagtgtctattgttcgaagtggcgaaagcatggaaaatgcactgcgtgcttgttgtaaggggataaaaataggcaaaattctatttcatcgcattggagataatggacaacaactcatataccataagctgcccgtggatattgctgaacgtcatgttttgcttttggaccctgtgcttggtacaggcaattcagctaatcaagccattgagcttcttatgaggaaaggagttcctgagcagcggatcatttttctgactctcatctcggcccctgaaggcatccattgtgtgtgcaagcgcttccctgatttgaagattgtaacctcagagattgatagcggattgaacgatgaatatcgtgtcatcccaggacttggagagtatggtgatcgatacttcggcacagactaa

SEQ ID NO: 21367 - protein, 476 aa, Sorghum bicolor
  misc_feature: Ceres ANNOT ID no. 8714219
  misc_feature: Up-regulated in root tissues in response to salicylic acid treatment
  misc_feature (53)..(476): SWISSPROT Homolog: EC 2.7.1.48 Uridine kinase
  misc_feature (58)..(245): Pfam ID: PRK Pfam Description: Phosphoribulokinase / Uridine kinase family
  misc_feature (284)..(437): Pfam ID: Pribosyltran Pfam Description: Phosphoribosyl transferase domain
MEDVMVSSVGPHFSGLRLDSRRLSSSLSPSSSPSRSANADASLGFASPKADGTRRPFVIGVCGGTASGKTTVCDMIIQQLHDHRVVLVNQDSFYRGLTEEQSEQVQDYNFDHPDAFDTDQLLVCMGKLKSGQSVNIPIYDFKNHRRCSEKFRKVNESDVIILEGILVFHDQRVRDLMDMKIFVDTDADIRLARRIRRDTVERGRDVTSVLEQYVRFVKPAFDAFVLPSKKYADVIIPKGGDNHVAIDLIVQHIHTKLGQHNLCKVYPNVFVVHTTFQIRGMHTLIRDKNITTPDFVFYSDRLIRLVVEHGLGHLPFTEKQVVTPTGSVYMGVDFCKKLCGVSIVRSGESMENALRACCKGIKIGKILFHRIGDNGQQLIYHKLPVDIAERHVLLLDPVLGTGNSANQAIELLMRKGVPEQRIIFLTLISAPEGIHCVCKRFPDLKIVTSEIDSGLNDEYRVIPGLGEYGDRYFGTD

SEQ ID NO: 21368 - DNA, 1662 bp, Sorghum bicolor
  misc_feature: Ceres ANNOT ID no. 8714255
  misc_feature: Up-regulated in shoot tissues in response to salicylic acid treatment
  misc_feature: Encodes the peptide sequence at SEQ ID NO 21369
atggatgacgacttcgagatgccgaccgccggcgccgacgagatgatgggcgacgacgagatgggcgacttcggcggcgatgagggcccggtgttgaaggtgggcgaggagaaggaggtcggcaagcaggggctcaagaagaagctgctcaaggagggcgagggctgggagacgcccgaggtcggcgacgaggttgaagtgcattacacgggtacactccttgatggaacaaagtttgactcaagccgtgatcgcggagatcctttcaagttcaagcttggacaaggtcaagtgataaagggttgggatcaaggcatcaagaccatgaagaaaggagaaaatgctgtttttaccattcctccagaactggcttatggagcatctggttcaccgccaactattccaccaaatgcaaccctgcagtttgatgttgagctgctttcatggaccagtgtcaaagatatttgcaaagatggcggcatattcaagaagattcttaaagagggggagaagtgggagaacccaaaggatcctgatgaagtacttgtgaaatatgaggcccgtctcgaagatggtactgttgtatccaagtctgagggggttgagttcactgtaaaagatgggtacttttgtcctgccctggccaaagctgtcaagaccatgaaaaaggcagagaaggtgctccttacagtaaagccacaatatggatttggcgagaaaggtagaccagcagctggagaggaaggtggtgtgccaccaaatgccactctgcacattgaccttgagttggtttcgtggaagactgtcacagaaattggtgatgataagaaaatccttaagaaggttctcaaggagggagaaggttatgagcgtcccaacgagggtgccgttgttgaagtcaaaattaccggaaagcttcaggatggcacagtgtttacaaagaaggggcatgacgaagagccatttaaattcaagaccgatgaagaggaagttatagatggtcttgatcgtgctgtattgaacatgaagaagggtgaggttgctcttgtcacgattcctcctgaatatgcatttggttcaactgagtcaaagcaggatcttgctgttgttccacctaacagcacagtggtctacgaagttgaacttgtttcatttgtgaaggacaaggagtcgtgggacttaaacaatgaagagaagattgaggctgctggtaagaagaaagaggaagggaatgcattgttcaaattgggcaaatatgctagagcttccaagcgatatgagaaggccgccaagtacattgagtatgaaagttcattcagtgaagatgagaagaagcaatccaagcaactgaagatcagctgcaacttaaacaatgctgcctgcaaactgaagttgaaggactacaaggaagctgcgaagctttgcaccaaggttctggagctagatagccaaaatgtcaaggctctctacaggagggtgcaagcgtacattcaacttgctgacctagagctagcagaggccgatatcaagaaggcactggaaatcgatcctaacaacagggatgtgaagttggaatacaagaccctgaaggagaagatcaaggagtacaacaagaaggacgcgaaattctacagcaacatgttcgctaagatgacaaagtaa

SEQ ID NO: 21369 - protein, 553 aa, Sorghum bicolor
  misc_feature: Ceres ANNOT ID no. 8714255
  misc_feature: Up-regulated in shoot tissues in response to salicylic acid treatment
  misc_feature (56)..(553): SWISSPROT Homolog: EC 5.2.1.8 Peptidylprolyl isomerase
  misc_feature (53)..(147): Pfam ID: FKBP_C Pfam Description: FKBP-type peptidyl-prolyl cis-trans isomerase
  misc_feature (286)..(383): Pfam ID: FKBP_C Pfam Description: FKBP-type peptidyl-prolyl cis-trans isomerase
  misc_feature (169)..(264): Pfam ID: FKBP_C Pfam Description: FKBP-type peptidyl-prolyl cis-trans isomerase
  misc_feature (486)..(519): Pfam ID: TPR_2 Pfam Description: Tetratricopeptide repeat
MDDDFEMPTAGADEMMGDDEMGDFGGDEGPVLKVGEEKEVGKQGLKKKLLKEGEGWETPEVGDEVEVHYTGTLLDGTKFDSSRDRGDPFKFKLGQGQVIKGWDQGIKTMKKGENAVFTIPPELAYGASGSPPTIPPNATLQFDVELLSWTSVKDICKDGGIFKKILKEGEKWENPKDPDEVLVKYEARLEDGTVVSKSEGVEFTVKDGYFCPALAKAVKTMKKAEKVLLTVKPQYGFGEKGRPAAGEEGGVPPNATLHIDLELVSWKTVTEIGDDKKILKKVLKEGEGYERPNEGAVVEVKITGKLQDGTVFTKKGHDEEPFKFKTDEEEVIDGLDRAVLNMKKGEVALVTIPPEYAFGSTESKQDLAVVPPNSTVVYEVELVSFVKDKESWDLNNEEKIEAAGKKKEEGNALFKLGKYARASKRYEKAAKYIEYESSFSEDEKKQSKQLKISCNLNNAACKLKLKDYKEAAKLCTKVLELDSQNVKALYRRVQAYIQLADLELAEADIKKALEIDPNNRDVKLEYKTLKEKIKEYNKKDAKFYSNMFAKMTK

SEQ ID NO: 21370 - DNA, 1188 bp, Sorghum bicolor
  misc_feature: Ceres ANNOT ID no. 8714268
  misc_feature: Up-regulated in shoot tissues in response to salicylic acid treatment
  misc_feature: Encodes the peptide sequence at SEQ ID NO 21371
atgtccatcccgcggctcctcgtcgccgtcctcttcgccacgctggcggcggcggcgtccactccagcccacgcggccggcgccgggtcctgcgcggcggagaagttctcggacaaccgcgtgttcgcggcgtgcgcggacctgacccgcctgggcgcgtcgctgcactggtcctacgacgccacgacctcctccctctccgtggcgttcctagcctccccaccctccggcgggtgggtcgcctgggggctcaaccccaaggcgcagaccatggacggcacgcaggcgctggtggccgtccccaaggccaacggcggcgggtacgaggtgcagacctacagcatctccggcaccacgctcgacaacccgggcccgctccccaactaccagacgtccaacctcgccgccgaggtcgccggcgacggccgcgtcacgattttcggaacactcaagctccagaacggcacgggcgccgaggtcaaccaggtctggcaggtcgggccgtactccagcggggctccccagatacacgagatgcaaagcgacaacatgaactccaaggggtcgctcaacctcctcaccggggccaccgccgccgcctccggaggcagcatcctccggcagaagaatactcatggaatcctgaatgctgtgagctggggtcttctgttgccgatgggagccattttcgcaagatacctcaagacattcaaatcagctgatccggcatggttctacctccacgttgcttgccagctgatcgggtacggcgtcggagtgtctggctgggcaactggtattcatcttggaaacctgtccaagggaatcacctactcactccacaggaacatcgggatcacagtatttgctcttggtactctgcagatatttgcgctcttcttgaggccaaagaaggatcacaagtaccggctgtactggaacatctaccaccactcggtcggctacaccatcatcatactgggcatcatcaacatcttcaagggcatgtccatcctggacgtggagcagaagtggaagacggggtacatcatcgcgatcgccatcctaggcgccatcgccgtgatcctggaggtcgtcacatggggcatcgttctgaagcggcggaaggaggacagcaagacctacaatggcacctcgaacggcggccgcttgccgctatctatgtaa

SEQ ID NO: 21371 - protein, 395 aa, Sorghum bicolor
  misc_feature: Ceres ANNOT ID no. 8714268
  misc_feature: Up-regulated in shoot tissues in response to salicylic acid treatment
MSIPRLLVAVLFATLAAAASTPAHAAGAGSCAAEKFSDNRVFAACADLTRLGASLHWSYDATTSSLSVAFLASPPSGGWVAWGLNPKAQTMDGTQALVAVPKANGGGYEVQTYSISGTTLDNPGPLPNYQTSNLAAEVAGDGRVTIFGTLKLQNGTGAEVNQVWQVGPYSSGAPQIHEMQSDNMNSKGSLNLLTGATAAASGGSILRQKNTHGILNAVSWGLLLPMGAIFARYLKTFKSADPAWFYLHVACQLIGYGVGVSGWATGIHLGNLSKGITYSLHRNIGITVFALGTLQIFALFLRPKKDHKYRLYWNIYHHSVGYTIIILGIINIFKGMSILDVEQKWKTGYIIAIAILGAIAVILEVVTWGIVLKRRKEDSKTYNGTSNGGRLPLSM

SEQ ID NO: 21372 - DNA, 1014 bp, Sorghum bicolor
  misc_feature: Ceres ANNOT ID no. 8714279
  misc_feature: Down-regulated in root tissues in response to salicylic acid treatment
  misc_feature: Encodes the peptide sequence at SEQ ID NO 21373
atgacaatgctggagcagcggactattgattcggcttcccgtgaattcagactaaactatgagcaaaccaagcgttttgccattgacaaggcagtctactgtgatccgttctccatttgcgggcacatgtggcggatagtctgctacccaagaggggatattgggtctgacagtggtgaatacctcacactctatctggagctgctgagcacatccacaagtggtaaggccatctgcgacatccttttattgaacaagaacggtaagccatgttctaggattgcatcatcaagggtttgtgttcctctgcctcatagcaggaatgctgctgaatgggtctttatcactagtatgtatatttcatttaataatctagaggaaaatttcctgacagagggacatatcacttgggtatgctccatcatggttagccgtgatgtcagcatccctatgccagcctcagacattggaaaacattttggtatgctgctagatagcatggatgggactgatatttcattcacaattgacaatgagacattccatgcacaccgagcagtgcttgctgcccgttcacccgtcttcaaatctgagctcctcggttccatggctgagtctactatgccaaacatcaccctctgtgacattgctccagccacattcagagtcatgcttcggtttatgtacacagatgccttgcctagagatgatgagctcggggactctcccttagagatgatgcgacatctactagctgcggctgaccggtatgcattggaccgactgaagctcatttgtgcacagagattgttggatggtttgtctgtcgacactgttggtactaccttagcttgtgctgaaatgtacagctgcctggagttaaagagcaagtgcattgacttttttacagctggggaaaatttcaagaaggctttcttaactaaaggttttattcaattggtgcagcattttccttccattattgatgagcttcgagagaggatgggactataa

SEQ ID NO: 21373 - protein, 337 aa, Sorghum bicolor
  misc_feature: Ceres ANNOT ID no. 8714279
  misc_feature: Down-regulated in root tissues in response to salicylic acid treatment
  misc_feature (160)..(274): Pfam ID: BTB Pfam Description: BTB/POZ domain
MTMLEQRTIDSASREFRLNYEQTKRFAIDKAVYCDPFSICGHMWRIVCYPRGDIGSDSGEYLTLYLELLSTSTSGKAICDILLLNKNGKPCSRIASSRVCVPLPHSRNAAEWVFITSMYISFNNLEENFLTEGHITWVCSIMVSRDVSIPMPASDIGKHFGMLLDSMDGTDISFTIDNETFHAHRAVLAARSPVFKSELLGSMAESTMPNITLCDIAPATFRVMLRFMYTDALPRDDELGDSPLEMMRHLLAAADRYALDRLKLICAQRLLDGLSVDTVGTTLACAEMYSCLELKSKCIDFFTAGENFKKAFLTKGFIQLVQHFPSIIDELRERMGL

SEQ ID NO: 21374 - DNA, 1149 bp, Sorghum bicolor
  misc_feature: Ceres ANNOT ID no. 8714337
  misc_feature: Up-regulated in shoot tissues in response to methyl jasmonate treatment
  misc_feature: Up-regulated in root tissues in response to methyl jasmonate treatment
  misc_feature: Up-regulated in shoot tissues in response to salicylic acid treatment
  misc_feature: Encodes the peptide sequence at SEQ ID NO 21375
atgggcgtggaggaggcggggcgcgccgccaccggcaagaagctggcgctggcgagcatcggcttcgcggacgtccgcgtgggcgccgccgtgcccgggggtgccggcgtgtacaaggacggcttgctcgtcgtgggcctgcccgtgcccaaggacgacggcctcgacgccgccgcccgcgtcgtcggggacctcgccgccaggctgcccgacgttggcgccgccgctaggacttttctgaggaatagagaagtcgcagaattcgtgagtggagcattggctggtgcaatgactaaggctgttcttgctcccttagaaactatcaggacaagaatggttgtaggtgtaggatcaaaacatatttttggtagctttgtggagattgttgaacataatggctggcaaggactctgggcaggtaatacaataaatatgctccggattatcccaactcaagcaattgagctcgggacatttgaatgtgtcaaaaggactatggcatcagcacaagagaaatggaaagaggatggatgcccaaagatacaacttggcaatttgaaaattgagctgccatttcacttactatcgccaattgcaattggaggtgcggcagctggaatagctagcactttagtgtgccatcctcttgaggttcttaaggatcgcatgactgttaatcgtcaggcttatcctagtattgccattgccatcaacaagatctaccggactgatggacttggtggtctttatgctggcctctgcccaacgttggttggcatgcttccatatagcacatgctactatttcatgtacgagaccatcaagacttcctactgccgtgcacataaaaagaaatctttgaaccgtcctgagctgctgatcattggggctctttcaggtctaactgcaagcacaatcagcttccctctagaagtggcaagaaagcggctaatggtgggatccctacaagggaagtgcccaccccacatgattgcagcattagctgaggtggtccaagaggagggcgtcaagggtcttttccgaggttgggcggcgagctccctgaaggtcatgccgacgtctggtgtcacctggatgttttatgaggcatggaaggagcttcttttgggttcacggctccatgcctaa

SEQ ID NO: 21375 - protein, 382 aa, Sorghum bicolor
  misc_feature: Ceres ANNOT ID no. 8714337
  misc_feature: Up-regulated in shoot tissues in response to methyl jasmonate treatment
  misc_feature: Up-regulated in root tissues in response to methyl jasmonate treatment
  misc_feature: Up-regulated in shoot tissues in response to salicylic acid treatment
  misc_feature (288)..(379): Pfam ID: Mito_carr Pfam Description: Mitochondrial carrier protein
  misc_feature (87)..(170): Pfam ID: Mito_carr Pfam Description: Mitochondrial carrier protein
  misc_feature (196)..(282): Pfam ID: Mito_carr Pfam Description: Mitochondrial carrier protein
MGVEEAGRAATGKKLALASIGFADVRVGAAVPGGAGVYKDGLLVVGLPVPKDDGLDAAARVVGDLAARLPDVGAAARTFLRNREVAEFVSGALAGAMTKAVLAPLETIRTRMVVGVGSKHIFGSFVEIVEHNGWQGLWAGNTINMLRIIPTQAIELGTFECVKRTMASAQEKWKEDGCPKIQLGNLKIELPFHLLSPIAIGGAAAGIASTLVCHPLEVLKDRMTVNRQAYPSIAIAINKIYRTDGLGGLYAGLCPTLVGMLPYSTCYYFMYETIKTSYCRAHKKKSLNRPELLIIGALSGLTASTISFPLEVARKRLMVGSLQGKCPPHMIAALAEVVQEEGVKGLFRGWAASSLKVMPTSGVTWMFYEAWKELLLGSRLHA

SEQ ID NO: 21376 - DNA, 3360 bp, Sorghum bicolor
  misc_feature: Ceres ANNOT ID no. 8714401
  misc_feature: Down-regulated in shoot tissues in response to salicylic acid treatment
  misc_feature: Encodes the peptide sequence at SEQ ID NO 21377
atgcagagggaggtggggccgcaagtggcccctccgctcttcctccaccagatccagccgatgcctccccacgccgccgccgcgaagaagcgcggccacccgtggcctgccgccgccggcgccgccgtggcgcccgcggaggccgccgccgggaactggaaccccaggctgtgggactgggacagccgcgccctcaccgccaggccgtcctccgatgcgctccgcctcgccggtggccagcagccccagccatcagccaaggcggctgaggcgcagcgccaggggaccgccgggggaaacggcgcgctgaacctgcagctcggtctgcgagaagacgccgcgacgccgatggacgccagcccgacggctcccgcggcgtcgtcgtcgccgtccccgcctcctgcttcggcttcggcggggcaggagccggtggttaggccgagcaagcgcgtgcggtccggatcgccgggcagcgctgggggaggatcgggcggcggtggggctgccaacggaggcgcgggctacccgatgtgccaggtggatgactgccgagcggatctgaccagcgccaaggattatcaccggaggcacaaggtctgcgagacccacagcaagaccaccaaggcggtcgtcgccaaccaggcgcagcgcttctgccagcagtgtagtagatttcacccactcgcggagtttgatgagggtaagaggagctgccggcgtaggcttgctggccacaaccggcgaagaagaaaaacccagccaacagatgttgcttctcagttgctgctacctgggaaccaagaaaatgcagcaaataggacacaagatattgtcaatctaattacagtgattgcgcgtttgcaaggttctaatgttggtaaagtgcctagcatccctcccataccagataaacaaaatctggttgaaattataagcaaaataaattcattgaacaacacgacctctgcggcgaagtctcctccatcagaagtcgttgatttgaatgcttcgcaagagcaacaagagcaacggcaggattctgtggagaagacgaccaacggaattgacaagcaaactgtgccatcaaccatggacttgctaggagttttttcaactggccttgcaacttcgacacctgagacaaatacatctcagtcccaagggagcagtgacagcagtggtaataacaagagcaagagccattcaaccgagccagcaactgttgtgaattcacatgataaaccaacccgagattttcctgctgctggtttcatgagaagcaacagcactcacgagagccgacctcatatatacaagcagatagaacaagaaaccagaccatacttgtcactgcagctgtttggcagcactgaggcggatatcccacctaagatggactcggtgaataagtacttatcttctgagagtagtaatcctctggatgagagatctccttcatcctctccgccaataacccgcaagtttttccccatacattcggttgatgaagaggttcgacaccctcatattacagattatggggaagatgctacaatgggtgaagttagcacaagccaggcatggtgtgcaccaccacttgatctcttcaaggattcagaacgccccgtcgagaatggatcgccgccaaatcctggttaccagtcctgctatgcttcaacatcttgttcagaccattcaccttcaacctcgaactcagatggacaggatcggactggtaggattattttcaagctgtttggcaaggaacctagcacaatacctgggaaccttcgtgacgatatagtaaattggctcaaacacagccctactgaaatggagggatacattcgacctggttgcattgtactatccatgtacctatcaatggcggctattgcatgggatgagcttgaagaaaatctcctccagagagtaaactcattagttcaaagttctgatatggatttctggaggaaaggaaggtttttagttcgaactgactcccagttggtatcttataaagcgggaatgacccgtttatcgaaatcgtggagaacatggaatacccctgaattgacctttgtgtcaccaattgctgttgttggtggccggaagacttccctcattcttaaaggccgcaatctatctattcctggcacacagatccattgtacaagtatagggaagtacatatccaaagaagttctgtgctcagcatatccaggtaccatatatgatgattcaggtgttgagacctttgacttgccaggacaaccagatcttattcttggacgctgctttattgaggtggaaaacaggttcaggggtaacagcttccctgtgattgttgcaagttcaagtgtttgccaggagttgagaaacctagaagttgagcttgaggattcacaggttcttgatgttccttctgatggtcagattcatgactctcggcagtcaaagacaagggttcaagttctgcacttccttaatgaacttggctggctttttcagagggcttctgcctgtacattgtccaccagatctgatatgtctgatttggatttgattaagttttcaactgcacggttcaaatatcttttactgttctctagtgagcgtgactggtgctctcttactaaaacacttctggatattcttgctaagagaagcttggtcagcaaggaactatcaaaggaaacaatggagatgctggctgagattcatcttctgaacagagcagtaaaaagaaagagtaggagcatggtgcatttgcttgtacagtttgttgtaatttgccctgataattccaaggtttaccccttccttccaaatttgcctggccctggtggtttaactccgttgcatcttgctgcatccattgagaatgcagaggatattgtggatgccttgacagatgatcctcaacagattggtttgacctgttggcagtcagttctagacgaagatggccaatctcctgaaacatatgccaagttgaggaatcataattcttataatgagcttgtagcacaaaagctggtggacgtgaagaacaaccaggttactataacagttaatggcgatgaaatttgtatggatcagttagggaatgttggtgaccataaacaatctggggttcaggcgttgcaaataagatcttgctcccagtgtgccattttggagtctggtgtgctaaggcagccggtgcgatcaaggggattgcttgctcggccttatatccattccatgcttgctatagcagcagtctgcgtctgcgtctgtgtattcatgcgagctttgctgcggattaattctggtaaatccttcaagtgggaaaggctggattttggtacaatataa

SEQ ID NO: 21377 - protein, 1119 aa, Sorghum bicolor
  misc_feature: Ceres ANNOT ID no. 8714401
  misc_feature: Down-regulated in shoot tissues in response to salicylic acid treatment
  misc_feature (177)..(255): Pfam ID: SBP Pfam Description: SBP domain
MQREVGPQVAPPLFLHQIQPMPPHAAAAKKRGHPWPAAAGAAVAPAEAAAGNWNPRLWDWDSRALTARPSSDALRLAGGQQPQPSAKAAEAQRQGTAGGNGALNLQLGLREDAATPMDASPTAPAASSSPSPPPASASAGQEPVVRPSKRVRSGSPGSAGGGSGGGGAANGGAGYPMCQVDDCRADLTSAKDYHRRHKVCETHSKTTKAVVANQAQRFCQQCSRFHPLAEFDEGKRSCRRRLAGHNRRRRKTQPTDVASQLLLPGNQENAANRTQDIVNLITVIARLQGSNVGKVPSIPPIPDKQNLVEIISKINSLNNTTSAAKSPPSEVVDLNASQEQQEQRQDSVEKTTNGIDKQTVPSTMDLLGVFSTGLATSTPETNTSQSQGSSDSSGNNKSKSHSTEPATVVNSHDKPTRDFPAAGFMRSNSTHESRPHIYKQIEQETRPYLSLQLFGSTEADIPPKMDSVNKYLSSESSNPLDERSPSSSPPITRKFFPIHSVDEEVRHPHITDYGEDATMGEVSTSQAWCAPPLDLFKDSERPVENGSPPNPGYQSCYASTSCSDHSPSTSNSDGQDRTGRIIFKLFGKEPSTIPGNLRDDIVNWLKHSPTEMEGYIRPGCIVLSMYLSMAAIAWDELEENLLQRVNSLVQSSDMDFWRKGRFLVRTDSQLVSYKAGMTRLSKSWRTWNTPELTFVSPIAVVGGRKTSLILKGRNLSIPGTQIHCTSIGKYISKEVLCSAYPGTIYDDSGVETFDLPGQPDLILGRCFIEVENRFRGNSFPVIVASSSVCQELRNLEVELEDSQVLDVPSDGQIHDSRQSKTRVQVLHFLNELGWLFQRASACTLSTRSDMSDLDLIKFSTARFKYLLLFSSERDWCSLTKTLLDILAKRSLVSKELSKETMEMLAEIHLLNRAVKRKSRSMVHLLVQFVVICPDNSKVYPFLPNLPGPGGLTPLHLAASIENAEDIVDALTDDPQQIGLTCWQSVLDEDGQSPETYAKLRNHNSYNELVAQKLVDVKNNQVTITVNGDEICMDQLGNVGDHKQSGVQALQIRSCSQCAILESGVLRQPVRSRGLLARPYIHSMLAIAAVCVCVCVFMRALLRINSGKSFKWERLDFGTI

SEQ ID NO: 21378 - DNA, 1374 bp, Sorghum bicolor
  misc_feature: Ceres ANNOT ID no. 8714415
  misc_feature: Up-regulated in shoot tissues in response to salicylic acid treatment
  misc_feature: Encodes the peptide sequence at SEQ ID NO 21379
atgggaaccaagaatcttacacggaaccgccccgcttccatggcgacggcgtccaccacgctgctcctctccctcgccctcctcgccttcgcctgggcggcatcgccgtcgccggatgcggaggcgatctcccggttccaggagtacctccgcatcgacacggcgcagccggcgcccgactacgccgcggccgtggccttcctccggaaccaggcctccgaggccgggctcgaggcgcgcacgctcgagctcgtcgccgggaagcccctgcttctgctgcggtggcccgggcggcggccgtcgctcccctccgtactcctcaactcccacactgacgtcgtgccgtcggagccgagcaagtgggaccacccgcccttttccgccgccctcgatgaggcgtccggtcgcatctatgcgcgaggctcccaggacatgaagtgcgtggggatgcagtaccttgaagccatccgccgactccgttcttcaggatttattccagatcgaactattcatgtaatatttgttcctgatgaggagattggtgggcatgatggtgttgagctgtttgtttcatctaaggagttcaaagatatgaatgtggggttagtgcttgacgaagggcttccatctcctggggaggagtatcgggtgttctatgcagagcgtagcccctggtggcttaccataaaagcaaagggtgcaccagggcatggtgcaaagttgtatgatggcagtgcaatggagaatttaatgaaaagcgtggaggctatcaggagattcagaacatcgcagtttgatttagtgaagtctgggcagaaggctgaaggggatgttgtgtcagtgaattttgcatacctgaaggctggcacaccgacaccaacgggttttgtcatgaatctccaaccatctgaagcacaggtaggtcttgacatccggatgcctcctgatgttcatactgaagcactggagaggcgccttattgaagaatgggcaccttcctcacgcaacatgaccttcgagtttaaacagaggggttctgtcctggacaactttgggaagccagccttcacacctgctgacagctcgaacccatggtggccagtgcttggagaagctgttaagaaagctggcggtaaactcggtaaaccggaggtatttcctgcctctacagatgctcgctacttccggaagattggtttaccagcattcggtttctctcctatggcaaacacaccagtattgctccacgatcacaacgagttcctaagcaaagacgagtatatcaaaggaattggggtatacgagtcgatcatcagggagctggccactcacaacgatgaagccagagacgaagaatcgagggcagagctatga

SEQ ID NO: 21379 - protein, 457 aa, Sorghum bicolor
  misc_feature: Ceres ANNOT ID no. 8714415
  misc_feature: Up-regulated in shoot tissues in response to salicylic acid treatment
  misc_feature (42)..(443): SWISSPROT Homolog: EC 3.5.1.14 Aminoacylase
  misc_feature (106)..(440): Pfam ID: Peptidase_M20 Pfam Description: Peptidase family M20/M25/M40
MGTKNLTRNRPASMATASTTLLLSLALLAFAWAASPSPDAEAISRFQEYLRIDTAQPAPDYAAAVAFLRNQASEAGLEARTLELVAGKPLLLLRWPGRRPSLPSVLLNSHTDVVPSEPSKWDHPPFSAALDEASGRIYARGSQDMKCVGMQYLEAIRRLRSSGFIPDRTIHVIFVPDEEIGGHDGVELFVSSKEFKDMNVGLVLDEGLPSPGEEYRVFYAERSPWWLTIKAKGAPGHGAKLYDGSAMENLMKSVEAIRRFRTSQFDLVKSGQKAEGDVVSVNFAYLKAGTPTPTGFVMNLQPSEAQVGLDIRMPPDVHTEALERRLIEEWAPSSRNMTFEFKQRGSVLDNFGKPAFTPADSSNPWWPVLGEAVKKAGGKLGKPEVFPASTDARYFRKIGLPAFGFSPMANTPVLLHDHNEFLSKDEYIKGIGVYESIIRELATHNDEARDEESRAEL

SEQ ID NO: 21380 - DNA, 2088 bp, Sorghum bicolor
  misc_feature: Ceres ANNOT ID no. 8714473
  misc_feature: Down-regulated in root tissues in response to methyl jasmonate treatment
  misc_feature: Up-regulated in shoot tissues in response to methyl jasmonate treatment
  misc_feature: Encodes the peptide sequence at SEQ ID NO 21381
atgggcgcaagagataatggggagggaagggatgagaagaagggaattggatcagattatgtacctactagagattccttttcttcacaaggtgagtctcgggttccaaggaagctcagtaaaaaggagacaaaagacaataatagcccccgaacaaccaaaagcagtgccagccgtcaagctcaaactaagctgcaacataaaggattaaacagtgtacagaacaagtctcagaaacaaaagaaaacagttagtcctgctaaggctgttgaagttagaaaaccagacattacaagaattccttcccgccctccgtcagaattgtctgaggaaacagatgatataatcagtgatgctggaactgttgatgataaaggcaccgaggaggccaaggagatcgatgtgttagatgaagctccacactgtgatcagagtactggtactgatgacgaaattcctgatattgaagacaaggtagttgatcatggaaaatcagttgtaggtcaaggcaatggggaattagtgttgaaaattgacaagttggaacaggaacttcgtgaagttgctgctcttgaagtttccctgtactctgtagtccccgagcatggaagttcagcacataagttgcacaccccagctcggcgtctttctaggctatatatccatgcatccaagttttggtctgaagataagagagcttcggtagcaaaaagcattgcttctggtcttgttcttgttgcaaaatccagtagcaatgatgcttcgaggctgacattctggctgtccaacacagttgtcctcagggagataattgtacaaacttttggcatctcacatcaatttactccatccatgacgactatgaacatgaatggtggtgccaaaaaacttgatgggaaatctatgacaatgctgtggagaaacaatttcaatggcatgcaaaccaaacttgctgcaatgcagatgccagatgattggcaggaaacaagtacacttttggctgcactagacaagatcgaatcttggatattttctcgcattgttgagacagtatggtggcaggcactaactcctcacatgcaaaaacggacggaaggcgcatcaactccaaaggctggtagagtgttaggtcctgctttgggtgatcagcagcagggcaccttttctgttaacctgtggaaggctgcgtttcatgatgcattcaacagaatgtgcccccttcgtgctggtggacatgagtgtggctgtttgccagtattagcaaaactggtgatggagcaatgtgtagcccgtttggatgttgccatgtttaatgccatccttcgtgaatcagcaagtgagataccaacagaccctatatctgacccaattgttgacccaaaagtcctaccgattccagctggtgatctaagctttgggtcaggcgcgcagctgaagaactctattggaaactggtccagatggctgacagataagcttggcatagatgatgatgattctgatgaaataggagatgttgaagatgaaagaagagggagagctgaaacaaaatcgtttcaactgcttaatgaattaagtgatctcctgatgctcccaaaggacatgcttcttgaaaaatctatcaggaaagaggtctgcccttcaattggccttcaattagtgacaagaatcctgtgcaacttcaccccagatgagttttgccctgatgcggttccaagcacggtcttagaagagctgaattctgagagcttgctggagcgtcacaccaacaaagacgtgatcaatgtgtttccatgcatagctgctcctatagtgtaccgagcaccttcaacgttggatgcggcagagaaagtggcagacataggagttggcgcaaagctggacaggaaagcttcaatggtgcagaggagagggtataccagtgacgatgaccttgatgacctggattctccgcttgcatccctaatcgacaggagcgctccaccttcgccatcaaatggtttcacacatttcagttctcagagaggagtttccatggagaatacaagatacacgctcctaagagaagtatggctggagcaacggtga

SEQ ID NO: 21381 - protein, 695 aa, Sorghum bicolor
  misc_feature: Ceres ANNOT ID no. 8714473
  misc_feature: Down-regulated in root tissues in response to methyl jasmonate treatment
  misc_feature: Up-regulated in shoot tissues in response to methyl jasmonate treatment
MGARDNGEGRDEKKGIGSDYVPTRDSFSSQGESRVPRKLSKKETKDNNSPRTTKSSASRQAQTKLQHKGLNSVQNKSQKQKKTVSPAKAVEVRKPDITRIPSRPPSELSEETDDIISDAGTVDDKGTEEAKEIDVLDEAPHCDQSTGTDDEIPDIEDKVVDHGKSVVGQGNGELVLKIDKLEQELREVAALEVSLYSVVPEHGSSAHKLHTPARRLSRLYIHASKFWSEDKRASVAKSIASGLVLVAKSSSNDASRLTFWLSNTVVLREIIVQTFGISHQFTPSMTTMNMNGGAKKLDGKSMTMLWRNNFNGMQTKLAAMQMPDDWQETSTLLAALDKIESWIFSRIVETVWWQALTPHMQKRTEGASTPKAGRVLGPALGDQQQGTFSVNLWKAAFHDAFNRMCPLRAGGHECGCLPVLAKLVMEQCVARLDVAMFNAILRESASEIPTDPISDPIVDPKVLPIPAGDLSFGSGAQLKNSIGNWSRWLTDKLGIDDDDSDEIGDVEDERRGRAETKSFQLLNELSDLLMLPKDMLLEKSIRKEVCPSIGLQLVTRILCNFTPDEFCPDAVPSTVLEELNSESLLERHTNKDVINVFPCIAAPIVYRAPSTLDAAEKVADIGVGAKLDRKASMVQRRGYTSDDDLDDLDSPLASLIDRSAPPSPSNGFTHFSSQRGVSMENTRYTLLREVWLEQR

SEQ ID NO: 21382 - DNA, 2151 bp, Sorghum bicolor
  misc_feature: Ceres ANNOT ID no. 8714567
  misc_feature: Up-regulated in shoot tissues in response to methyl jasmonate treatment
  misc_feature: Up-regulated in shoot tissues in response to salicylic acid treatment
  misc_feature: Encodes the peptide sequence at SEQ ID NO 21383
atggcgctgcggcacctcgtcacgggccagaacaactgcaccccggacggcgcctcgtcctccaaccccctcaacgccctcgccaacgccttcctcggccagtcctccaaggcgcagtcaataaaggaacttcctggttctgttagtgttccatctacatcagactttagcacgcctgctcccatatcaaacatccctggtgcagaaaatgagttcaaacaagaccagcgacctcttgcacggggcgctgactttattcgtggtggtcctgctaatgattggatcgagtcttttcggcctccgggggttcctcaacttggagtagaagcacaattccgagattttgagcaaatttataacaatacagggacaacctttcaaccgccattggatggtccaccacaaagagtgttgtctggtgtcttgcattcctttctcacaagtggcccagctggtgtgccatttcaacctcttcctgtaccagctgctcttggtttatctgaaagtgacaaacagtgcatacgtgatcgtagctgcataatggcacggcatatattttctgaccaaccagaagaatatatacaggctcaggtcaatactttgctgcattcgcttgatattgacaaccgtatgagaggacctatgcatggacattacccagaactacaggagtactggaaccagtcccaaagttctatgggtcctgccccgatgcataatgctgctgataaatggattactgagtttgacaagcaaaataataatccagaaaattgggcaaactctttcgaacaacaatatggccccaatgggtgggcctctgagtttgaacagcatcagtctcagatggccatgggcccgatgggaggagcaaacatgggcaacctggctgctatggagcaatcccgaatgcttgcacaaactttagcaagtaataatgatcccaagtttcagaattctaagttcttccagtttgtttcaaagatgagccggggtgaacttattatagaagataatcaagtaaaagaaggttcagcatcccaatccagtggctgggctgatgaatttcaaacacagtacaatgctaatgcaaactcatgggcggatcagtttgagcatgaagagctttcacatggggcggataagtgggttagcgagttctctagtcaacataatcaaggtgcactaaatgagaactgggttgatgagttctcgaaattaaatgtcactgatgaatgggcagaggaattcagtggaggtggttttggtgaaagctctgctgatccatgggttgatgagttccaagaacacatgtcgtctttcaaacaaagttcgggcacctctcgaggggtttatgttttttctgagaacaacccgtatgttggtcaccctaatccaatgcaggaaggacaggagctcttccgcaagggcctcttaagtgaagctgttcttgctttagaggctgaagttttgaagaatcctgataatgctgaaggttggaggttgttaggcgtaacacatgcagaaaatgatgatgaccagcaggccattgcagcaatgatgcgtgcgttggaagctaatccgacaaaccttgaaattcttcttgctcttggtgttagtcacacaaatgaattggagcagggagaagcgttaaggtatctttctaggtggcttcagaatcatccaaaatatggtggccttgtccctccgcagtcaactgattcaccttatggtcctgatgttgttagattgtttaatgaagctgctcagatgtcacctgaagatgcagatgttcatatagttctgggagtcttatacaacctatcaagagagtatgataaagctatagcttcatttaagacagcactgcagctcaaaccacaggactattcactctggaacaagcttggtgcaacccaagcaaacagcatccagagtgctgatgcaatattggcgtatcagcaggctctagacttgaaacccaactatgtgcgtgcatgggcgaatatgggaatcagctatgccaaccagggtttgtatgaggattccattcggtactatgtaagggcagttgcaatgaacccaaaagctgacaatgcctggcagtacttgaggatttctcttaggcctgaagatccgtcagcaagatga

SEQ ID NO: 21383 - protein, 716 aa, Sorghum bicolor
  misc_feature: Ceres ANNOT ID no. 8714567
  misc_feature: Up-regulated in shoot tissues in response to methyl jasmonate treatment
  misc_feature: Up-regulated in shoot tissues in response to salicylic acid treatment
  misc_feature (596)..(629): Pfam ID: TPR_1 Pfam Description: Tetratricopeptide repeat
  misc_feature (664)..(697): Pfam ID: TPR_1 Pfam Description: Tetratricopeptide repeat
  misc_feature (497)..(530): Pfam ID: TPR_2 Pfam Description: Tetratricopeptide repeat
MALRHLVTGQNNCTPDGASSSNPLNALANAFLGQSSKAQSIKELPGSVSVPSTSDFSTPAPISNIPGAENEFKQDQRPLARGADFIRGGPANDWIESFRPPGVPQLGVEAQFRDFEQIYNNTGTTFQPPLDGPPQRVLSGVLHSFLTSGPAGVPFQPLPVPAALGLSESDKQCIRDRSCIMARHIFSDQPEEYIQAQVNTLLHSLDIDNRMRGPMHGHYPELQEYWNQSQSSMGPAPMHNAADKWITEFDKQNNNPENWANSFEQQYGPNGWASEFEQHQSQMAMGPMGGANMGNLAAMEQSRMLAQTLASNNDPKFQNSKFFQFVSKMSRGELIIEDNQVKEGSASQSSGWADEFQTQYNANANSWADQFEHEELSHGADKWVSEFSSQHNQGALNENWVDEFSKLNVTDEWAEEFSGGGFGESSADPWVDEFQEHMSSFKQSSGTSRGVYVFSENNPYVGHPNPMQEGQELFRKGLLSEAVLALEAEVLKNPDNAEGWRLLGVTHAENDDDQQAIAAMMRALEANPTNLEILLALGVSHTNELEQGEALRYLSRWLQNHPKYGGLVPPQSTDSPYGPDVVRLFNEAAQMSPEDADVHIVLGVLYNLSREYDKAIASFKTALQLKPQDYSLWNKLGATQANSIQSADAILAYQQALDLKPNYVRAWANMGISYANQGLYEDSIRYYVRAVAMNPKADNAWQYLRISLRPEDPSAR

SEQ ID NO: 21384 - DNA, 1659 bp, Sorghum bicolor
  misc_feature: Ceres ANNOT ID no. 8714560
  misc_feature: Up-regulated in shoot tissues in response to salicylic acid treatment
  misc_feature: Encodes the peptide sequence at SEQ ID NO 21385
atggggattgtcaagatagcaagtcgtgagcctgcagcggagagtggttacagttgtggagttgaggaattcacacgagaggacaaaattcttcttcagagctttcctgatcctgaatctcttggctctgagcaggcagagctggactgtgagcttgcagtgtccagaggtcagatgtgcaatatcccctatgggctttatgatctgcatgacttgacagaggttctttctttggatacatggaattcgtgcctgacggaagatgatagactccatctagcagcctacctccctgacatggagcaacaagacttcgccacaaccatgaaagagctgttcagtggcgatgctatgttctttggaagtccacttagaagctttttccttggattgaacggtggcctttattctccacaagtttctcaggcaagggagttactgatgatgcttcaaagacggagacattaccatttcctcaggtggtaccacgatggtatggttggtaagtttgcatccatgagcaatctgttgaggagttctgatacgagtgctagtcttggagagaaggttcccatctcgcgcaaccgggtatatgagaagcgtttcccatgtcttagtcttagcagtaccactccaccagttactatcaaggatgaaattgccactgtttcatcaccaatgaaacgagccaaactcacggatgggccattaagcactcattgttcaaccagacatcatgaaacagcccatgtagccaaatcagcagaaatgaactcattggaaagtcagaacttccatcctatcaatgatcccaggcaaaattgtagtaaactacccagaggtgtactgaaaataaggactggttgtgcttctgttattggtgacagtgaagggacacgtcatagacctggattggttcgagctgatcagccaagaacacagagctccagattttgcactccgcctcttgtttctgcacacgatgtttatggtttttctgagaattcatcttctcacatcaacagaatcaatggcacgtctgctagttcacaacatactcccttacaatgggatggtacactagaaccttatgcactgatggacaaaatcccactaggagtcccaatgacagttccagaggagcacagtgcagtttacccttccatgatgctgagaggtttctatgaaccagcagctaaccatagcttagcatatcccagtgaagcatatgacaccagagaatgtgcccacatgaaagaccttctgaagaacttcggtggtcaaaacatcgtagtccatcaaagttctcctgatccatttgcaagagtcagtgacagtcatcaaatgaatggatactccacaatgcacagtttaagaaatgctgaaagtgtctcagagatgttgagccttggcacaaggatatacccacctcataacaatgtctcagagcagcgggaaaccacgtgcatgtaccatgatggcacgaagctggagcgacctcctgccagggctgttgctgaagctgaagaatctcgtcaattcgcttacacctacgcaaggaggaagccacccaagagaccaactatggtggaagatccagtgccaccaagtgtgctagacagcatggccaacatgaaagcaaatgcaatcaaactctga

SEQ ID NO: 21385 - protein, 552 aa, Sorghum bicolor
  misc_feature: Ceres ANNOT ID no. 8714560
  misc_feature: Up-regulated in shoot tissues in response to salicylic acid treatment
MGIVKIASREPAAESGYSCGVEEFTREDKILLQSFPDPESLGSEQAELDCELAVSRGQMCNIPYGLYDLHDLTEVLSLDTWNSCLTEDDRLHLAAYLPDMEQQDFATTMKELFSGDAMFFGSPLRSFFLGLNGGLYSPQVSQARELLMMLQRRRHYHFLRWYHDGMVGKFASMSNLLRSSDTSASLGEKVPISRNRVYEKRFPCLSLSSTTPPVTIKDEIATVSSPMKRAKLTDGPLSTHCSTRHHETAHVAKSAEMNSLESQNFHPINDPRQNCSKLPRGVLKIRTGCASVIGDSEGTRHRPGLVRADQPRTQSSRFCTPPLVSAHDVYGFSENSSSHINRINGTSASSQHTPLQWDGTLEPYALMDKIPLGVPMTVPEEHSAVYPSMMLRGFYEPAANHSLAYPSEAYDTRECAHMKDLLKNFGGQNIVVHQSSPDPFARVSDSHQMNGYSTMHSLRNAESVSEMLSLGTRIYPPHNNVSEQRETTCMYHDGTKLERPPARAVAEAEESRQFAYTYARRKPPKRPTMVEDPVPPSVLDSMANMKANAIKL

SEQ ID NO: 21386 - DNA, 2097 bp, Sorghum bicolor
  misc_feature: Ceres ANNOT ID no. 8714558
  misc_feature: Up-regulated in root tissues in response to salicylic acid treatment
  misc_feature: Up-regulated in shoot tissues in response to salicylic acid treatment
  misc_feature: Down-regulated in root tissues in response to methyl jasmonate treatment
  misc_feature: Encodes the peptide sequence at SEQ ID NO 21387
atggcctcggagacggagacgttcgccttccaggcggagatcaaccagctgctctcgctcatcatcaacaccttctactccaacaaggagatcttcctcagggagctcatctccaactcgtccgatgccttggacaagatcaggtttgagagcttgacggacaagagcaagctggatgcccagccggagttgttcatccacattgtccctgacaaggccaacaacacgctgaccatcattgacagtggcattggcatgaccaagtcagaccttgtgaacaaccttggtactattgcccggtccggcacaaaggagttcatggaggcactggctgctggtgccgatgtgtccatgattggccagttcggtgttggtttctactcggcctaccttgttgctgagagggtcgttgtgaccaccaagcacaacgatgatgagcagtatgtgtgggagtctcaggccggtggctccttcactgtcacacgtgacacctctggggagcaacttggcaggggtacaaagatgaccctctacctcaaggatgatcagttggagtaccttgaggagcgccgcctgaaggatctgatcaagaagcactcagagttcatcagctacccaatttctctctggattgagaagaccactgagaaggaaatttctgatgatgaagatgaggaagataagaaggatgaggagggcaaggttgaggatgttgatgaggagaaggaagaaaaggagaagaaaaagaagaagatcaaggaggtttctcacgagtggcagttggtcaacaagcagaagccaatctggatgaggaagcctgaggagatcaccaaggaagagtatgctgctttctacaagagcttgaccaacgactgggaggagcatcttgccgtgaagcacttctctgttgagggtcagcttgagttcaaggccgttctctttgtgccaaagagggcccccttcgacctcttcgacaccaggaagaagctgaacaacatcaagctctatgttcgccgtgtcttcatcatggacaactgtgaggagctgatcccagagtggctgagctttgtcaagggcattgttgactctgaggatcttcccctcaatatctcccgtgagaccctccagcagaacaagatcctcaaggtcatcaggaagaaccttgtcaagaagtgcattgagctgttctttgagattgccgagaacaaggaggactacaacaagttctatgaggccttctccaagaacctcaagcttggcatccacgaggactccaccaacaggaccaagattgctgagctcctgaggtaccactccaccaagagcggagatgagctgaccagcttgaaggactatgttaccaggatgaaggagggccagaatgacatctactacatcactggcgagagcaagaaggctgtggagaactctcccttccttgagaagctgaagaagaagggctatgaagtcctgtacatggtggatgccattgatgagtacgctattggacagctcaaggagtttgagggcaagaagcttgtctctgccaccaaggagggcctgaagcttgatgagagcgaggacgagaagaagaaaaaggaggagctcaaggagaagttcgagggcctctgcaaggtgatcaaggaggtgctgggcgacaaggtggagaaggtggtggtctctgaccgcgtggtggactccccctgctgcctcgtgactggtgagtacggctggaccgccaacatggagaggatcatgaaggcccaggcgctcagggactccagcatgtctgggtacatgtcctccaagaagacgatggagatcaacccggagaacgccatcatggaggagctgcgcaagcgcgcggaggctgacaagaacgacaagtctgtcaaggaccttgtcatgctgctgttcgagacggcgctgctcacctccggcttcagcctcgacgaccccaacaccttcggcagccgcatccaccgcatgctcaagctgggcctgagcattgacgaggacgaggccccggaggctgacactgacatgccccctctggaggacgacgccggcgagagcaagatggaggaggtcgactaa

SEQ ID NO: 21387 - protein, 698 aa, Sorghum bicolor
  misc_feature: Ceres ANNOT ID no. 8714558
  misc_feature: Up-regulated in root tissues in response to salicylic acid treatment
  misc_feature: Up-regulated in shoot tissues in response to salicylic acid treatment
  misc_feature: Down-regulated in root tissues in response to methyl jasmonate treatment
  misc_feature (185)..(698): Pfam ID: HSP90 Pfam Description: Hsp90 protein
  misc_feature (28)..(182): Pfam ID: HATPase_c Pfam Description: Histidine kinase-, DNA gyrase B-, and HSP90-like ATPase
MASETETFAFQAEINQLLSLIINTFYSNKEIFLRELISNSSDALDKIRFESLTDKSKLDAQPELFIHIVPDKANNTLTIIDSGIGMTKSDLVNNLGTIARSGTKEFMEALAAGADVSMIGQFGVGFYSAYLVAERVVVTTKHNDDEQYVWESQAGGSFTVTRDTSGEQLGRGTKMTLYLKDDQLEYLEERRLKDLIKKHSEFISYPISLWIEKTTEKEISDDEDEEDKKDEEGKVEDVDEEKEEKEKKKKKIKEVSHEWQLVNKQKPIWMRKPEEITKEEYAAFYKSLTNDWEEHLAVKHFSVEGQLEFKAVLFVPKRAPFDLFDTRKKLNNIKLYVRRVFIMDNCEELIPEWLSFVKGIVDSEDLPLNISRETLQQNKILKVIRKNLVKKCIELFFEIAENKEDYNKFYEAFSKNLKLGIHEDSTNRTKIAELLRYHSTKSGDELTSLKDYVTRMKEGQNDIYYITGESKKAVENSPFLEKLKKKGYEVLYMVDAIDEYAIGQLKEFEGKKLVSATKEGLKLDESEDEKKKKEELKEKFEGLCKVIKEVLGDKVEKVVVSDRVVDSPCCLVTGEYGWTANMERIMKAQALRDSSMSGYMSSKKTMEINPENAIMEELRKRAEADKNDKSVKDLVMLLFETALLTSGFSLDDPNTFGSRIHRMLKLGLSIDEDEAPEADTDMPPLEDDAGESKMEEVD

SEQ ID NO: 21388 - DNA, 1206 bp, Sorghum bicolor
  misc_feature: Ceres ANNOT ID no. 8714659
  misc_feature: Up-regulated in shoot tissues in response to salicylic acid treatment
  misc_feature: Up-regulated in root tissues in response to salicylic acid treatment
  misc_feature: Encodes the peptide sequence at SEQ ID NO 21389
atgaaggtagagcgcgacctccacatgagccgcggcgatggcgaggacagctacgcctccaactccaggcttcaggagaagtccatactgaagacgaggccggtgctccacaaggccgtggcggcggcgcacgcgtcgtcgctctcctccggcggcggcgccatggtcgtcgcggacctcggctgctcgtcggggcccaacacgctgctcgtcgtctccgaggtgctcggagccgtcgccgacaggcgagaggatctggcaatggccgctggcgcccaaccgcagcacgtgcagttcttcctgaacgacctgcccgggaacgacttcaacctcgtgttccaatccctggagctgttcaagaagctggccgtcaaggacaagggggacgcgctgccgccgtactacgtcgccgggctgccgggctccttctacacgcggctgttcccggaccgctgcgtccacctcttccactcctcctactgcctcatgtggcgctccaaggtccccgacgagctcgccggaggcgccgtcgtcaacgagggcaacatgtacatctgggagaccacgccgccggcggtggtggcgctgtaccggaggcagttccaggaggacttctcgctgttcctcaggctgcgccacagggagctcgtgtccggtggccagatggtgctggcgttcctcggcaggaagaacaaggacgtgctccatggcgaggtcagctacatgtggggcctcctcgcgcaggctcttcagtcactcgtcaaacagggacgtgtggagaaggagaagctggactccttcaacctgccgttctacgcgccgtcggtggacgaggtgagggacgtgatcaggcagagccaggcgttcgacgtcacccacatccagctcttcgagtccaactgggatccgcacgacgacatggaggacgacgacggcggcctcgtgctcgacggcgtccagagcggcgtcaacgtcgccaagtgcatcagggccgtgatcgggccactcatcgcgcaccacttcggcgaccacgtactcgacggcctcttcgagctctatgccaagaacgtcgccgtgcacctccagaaagtgaagaccaagtaccctgtcatcgtcgtttcactcaaggcatcaattagtcgtgcgccaaagaaccaagctaatgacaagtattattcaggtttcacgcacggccagtttatgtag

SEQ ID NO: 21389 - protein, 401 aa, Sorghum bicolor
  misc_feature: Ceres ANNOT ID no. 8714659
  misc_feature: Up-regulated in shoot tissues in response to salicylic acid treatment
  misc_feature: Up-regulated in root tissues in response to salicylic acid treatment
  misc_feature (1)..(375): SWISSPROT Homolog: EC 2.1.1.141 Jasmonate O-methyltransferase
  misc_feature (36)..(378): Pfam ID: Methyltransf_7 Pfam Description: SAM dependent carboxyl methyltransferase
MKVERDLHMSRGDGEDSYASNSRLQEKSILKTRPVLHKAVAAAHASSLSSGGGAMVVADLGCSSGPNTLLVVSEVLGAVADRREDLAMAAGAQPQHVQFFLNDLPGNDFNLVFQSLELFKKLAVKDKGDALPPYYVAGLPGSFYTRLFPDRCVHLFHSSYCLMWRSKVPDELAGGAVVNEGNMYIWETTPPAVVALYRRQFQEDFSLFLRLRHRELVSGGQMVLAFLGRKNKDVLHGEVSYMWGLLAQALQSLVKQGRVEKEKLDSFNLPFYAPSVDEVRDVIRQSQAFDVTHIQLFESNWDPHDDMEDDDGGLVLDGVQSGVNVAKCIRAVIGPLIAHHFGDHVLDGLFELYAKNVAVHLQKVKTKYPVIVVSLKASISRAPKNQANDKYYSGFTHGQFM

SEQ ID NO: 21390 - DNA, 798 bp, Sorghum bicolor
  misc_feature: Ceres ANNOT ID no. 8714696
  misc_feature: Down-regulated in shoot tissues in response to aminocyclopropane carboxylic treatment
  misc_feature: Encodes the peptide sequence at SEQ ID NO 21391
atgcaggaggtgtccgtcgagcccggccgtcggccggcgcagcagccgcaccatcagttcgcgggcgtcgacctccgccgacccaaggggtacgccacggcgccggtgcaggaggcgacaccggcggtcaaggttgccgagggcggggacccgtgcccgcggtgcgcgtcgcgggacaccaagttctgctactacaacaactacaacacctcccagccacgccacttctgcaagggctgccgccgctactggaccaagggcggcacgctgcgcaacgtccccgtcggaggcggcacccgcaagaagccctcgtcgtcgtcctacgcggcggcggcagcagcagcagcagacgccgacaacaagccgccgaagaagaagcccgccagcaagaagcgccgcgtcgaggcgccggtcccggagcccgccgctgccgcagacgccagtggtgtcacagacaccgtcgccgccgccgactccgccaagacgacgacgacgacgaccaccaccaccaccgacggcgccagcgagatcaccacggagactgaggcggcggtcgccgtggcggttccagtggcggaggaggactccgagtccctggcgcacctgctgctgcagcctggggcggaggaggccgtctcgctcggtctcgggctctccgacttcccctccgccgccgggaaggcggtgcttgacgacgactcgttcgtgtggcccgcggcgttcgacctgggcacgtgctgggccagcgccgggttcgccgacacggaccccgccagcctcttcctcaacctcccgtga

SEQ ID NO: 21391 - protein, 265 aa, Sorghum bicolor
  misc_feature: Ceres ANNOT ID no. 8714696
  misc_feature: Down-regulated in shoot tissues in response to aminocyclopropane carboxylic treatment
  misc_feature (45)..(107): Pfam ID: zf-Dof Pfam Description: Dof domain, zinc finger
MQEVSVEPGRRPAQQPHHQFAGVDLRRPKGYATAPVQEATPAVKVAEGGDPCPRCASRDTKFCYYNNYNTSQPRHFCKGCRRYWTKGGTLRNVPVGGGTRKKPSSSSYAAAAAAAADADNKPPKKKPASKKRRVEAPVPEPAAAADASGVTDTVAAADSAKTTTTTTTTTTDGASEITTETEAAVAVAVPVAEEDSESLAHLLLQPGAEEAVSLGLGLSDFPSAAGKAVLDDDSFVWPAAFDLGTCWASAGFADTDPASLFLNLP

SEQ ID NO: 21392 - DNA, 3885 bp, Sorghum bicolor
  misc_feature: Ceres ANNOT ID no. 8714805
  misc_feature: Up-regulated in shoot tissues in response to salicylic acid treatment
  misc_feature: Encodes the peptide sequence at SEQ ID NO 21393
atggcgccggaccgccccttagaggcctttttcgccgccgcccgtggcgccatcgcgcaccttcaccttcaccttcccgtcatccacatccctggatcccattccggttccaatcccaactccaaggaacccgaggccgactgcctgctccacctccacgtcgtcgtcaccaacttcttccacaagcccctcaagtcattcgccaggtgcttcaagccccagcggcggggaggcaaacactccccgccgctccgctgggatcacagcaatggcgccacccccaccccgcagcagcagctggagctccttctctgcattgcgttcgacgccttcgcccacaacctgcacttgctggaggacgcctgcaggcagaaaggtgaagagtttggtgtggctacccgacagctccagcaatttgtggttctcaggaagataatcgatgggaagagggctgatttcgatgggttcctttccaacctgggctttgcaaaggttggggcaccgccgccgccagcaaggatcatgggtggtgcgtcccctgtcccagcaccagcgccagtaagcgaccaggaggatggtgctggaattggggacagtgacaaggaggatggtgctggaattggaattggggacggcgaggtggtggacaatgctagtggtacacagcagccagcacagagattgcctgcccggctgcttaacatccctttgtcgaatgtggagcgtctgcggtctacgctgtcggcagtttcactgacggagctcattgaattagtcccccagctggtgagcagatcgtcaatatcggcagatgcacatcctgacaagaagaagcttttctcagtgcaagacttcttcagatatgcggaaattgaaggaaagcgattctttgaagagttggacagagacagtgatggtcaagtcactctagaagatcttgaaattgcaatgaggaagaggcggttaccaaggaggtatgctcgagaattgtttcgccatacaagaagcaacttcttttcgaaatcaattgggtggaagcaatttttatccttgatggaacagaaggaggcaaccattctccgagcatataccacgttgtgtttgagcaagtctggaacacttcacaagaatcaaattttgacttccttgaaaggtgctggacttccggccaatgaagataatgccactgccatgctacggtatctaaattctgattcagaaggatcaatctcatatggccatttccggaacttcatgcttctacttccttcagaacgccttgaggatgatcctcggaacatctggtttgaagctgctactgttgttgctgttcccccacctatagaaatatccacaggaagtgttttgaagtctgctttagctggaggtcttgcaagtgcgctctctacctctctgctgcatcctattgattcaatgaagacacgtgtccaagcatctacactctcatttccagagctcatttcaaagcttccacaaattgggcttcagggattgtatcggggttctatcccagcaattcttggccagttttcaagccatggtttgaggacaggaatctttgaagcaaccaagcttgtattaattaatgtcgctccgacacttccagagattcaggtgcaatcaatggcttccttctgcagcacagtcctagggactgcagtccgtataccttgtgaggttcttaagcagcgtttgcaagctggaatcttcaacaatgtaggggaggcaattgttggcaccatgcgacaagatggcccaaagggattttttcgtggcactggggccacactctgtcgcgaggttccgttctatgttgctggaatgtgcctctatgcagaagctaagaaggcagcacagcatgttttgaagagagacttggaagcatgggaaacagtggcagttggagcattgtctggaggagttgcagcaatagtgaccactccatttgacgtgatgaagacgcggatgatgactgcccctccaggcacaccagtgtctatgcagatgatagtcttctccatccttcgaaatgagggtccacttgggctttttaagggcgcgatcccccgcttcttctggattgcccctcttggcgcaatgaactttgcaggctacgagcttgccaagaaggcgatgatcgaagatgagagcaagtccagagaatcaatagaggagaagaaaaccatgagcttctcctcatcaattagttggtacaagatggttgttttgggtggcgctgatgatccgacacacaaacttggtgacattgttgatcacacacgccaacagcatgcaacaggattaccggagaaacccagtaatgtcagttgtcacaatggaaatgggcacaatcccctgcgaagttcagcctctgattcatacaagtattactatgatgctgatgcaccatccgagtccgattggcagtccacctcaccagcttcctcttcctctactcgacaaatgcttggagatgggcacagaaataatggctcctctttccgctcgtcgtcgatagcatcatcccagactcagagaccatcatcttcttcttcttcttcaagtcgacgtttcacggtgcccttcgtgaagaagatcgactggggctctctgtgggacaagtccaaggaatggattcggaaccccatgaacatggcgctgtctgtctggatcctcgccgtcggtgtctcaggtgccatcctcttcatggtcatgaccgggatgctgaaccgcgtgctgccaagcaagccgcagcgagacacgtggttcgaggtgaacaaccagatcctgaacgcgctcttcaccctcatgtgcctctaccagcacccgaggaggttctaccacctcgccctgctgtgccggtggagagccggcgacatgcatcagctccggcaagtatactgcaaggatggaacctgcaagcccaacgagagaaagcatatgatggttgtcatcctgctcctccacttgaactgctttgctcagtacgcgctgtgtggcctgaatcttggttaccgaagaccacagcgtccggtgatcggagttgccctcaccatatcggttgccatctgcgcgccggctgtcgccgggctgtacaacaacctcagccctcttggcaaagactacgaggcggcacaaccagaggcagacgacgaagagtcacagctccagcggaaaacgcccgagacggagaggaggtacacgttggtgccacgacaaggccatggcagcggcagctcgccgtcgtcgccgcagtgggtcggcgggctgttgggggatatgtgggaggacatgtcgctggcgtacctgtcggtgttctgcagctgctgcgtgttcgggtggaacatgagcaggctcggcttgggcaacatgtacgtccatgtcgccaccttcgtgctcttgtgcctggcgccattcttcatcttcgacctggcggccatcagcgtggacgacgaggccgtgagggacgcgctggggctggccggcgtcttcctctgcgtgttcggcctgctctacggcggattctggaggatccagatgcgcaggaggttcggcctccccgagaaccgagcctgctgcggcaagccggacctcacagactgcatgcagtggctctgctgctactcgtgctccctggctcaggaagtccgcaccgccgatgcctacgaggtggtgttggaagacaagcagcagccgatgccgatgccgatgcatcacccccggcaccatccaactctgcaggaagagctatcgacgatgcaggagcccctcaggtttgcaggtgtcttcgcttcaccttcacctcatctaaacgacgacggcgtcaccattcccccgtcgtcactgtcagctacacgtacataa

SEQ ID NO: 21393 - protein, 1294 aa, Sorghum bicolor
  misc_feature: Ceres ANNOT ID no. 8714805
  misc_feature: Up-regulated in shoot tissues in response to salicylic acid treatment
  misc_feature (262)..(415): SWISSPROT Homolog: EC 2.7.11.1 Non-specific serine/threonine protein kinase
  misc_feature (634)..(723): Pfam ID: Mito_carr Pfam Description: Mitochondrial carrier protein
  misc_feature (454)..(538): Pfam ID: Mito_carr Pfam Description: Mitochondrial carrier protein
  misc_feature (543)..(629): Pfam ID: Mito_carr Pfam Description: Mitochondrial carrier protein
  misc_feature (1093)..(1226): Pfam ID: PLAC8 Pfam Description: PLAC8 family
  misc_feature (292)..(320): Pfam ID: efhand Pfam Description: EF hand
MAPDRPLEAFFAAARGAIAHLHLHLPVIHIPGSHSGSNPNSKEPEADCLLHLHVVVTNFFHKPLKSFARCFKPQRRGGKHSPPLRWDHSNGATPTPQQQLELLLCIAFDAFAHNLHLLEDACRQKGEEFGVATRQLQQFVVLRKIIDGKRADFDGFLSNLGFAKVGAPPPPARIMGGASPVPAPAPVSDQEDGAGIGDSDKEDGAGIGIGDGEVVDNASGTQQPAQRLPARLLNIPLSNVERLRSTLSAVSLTELIELVPQLVSRSSISADAHPDKKKLFSVQDFFRYAEIEGKRFFEELDRDSDGQVTLEDLEIAMRKRRLPRRYARELFRHTRSNFFSKSIGWKQFLSLMEQKEATILRAYTTLCLSKSGTLHKNQILTSLKGAGLPANEDNATAMLRYLNSDSEGSISYGHFRNFMLLLPSERLEDDPRNIWFEAATVVAVPPPIEISTGSVLKSALAGGLASALSTSLLHPIDSMKTRVQASTLSFPELISKLPQIGLQGLYRGSIPAILGQFSSHGLRTGIFEATKLVLINVAPTLPEIQVQSMASFCSTVLGTAVRIPCEVLKQRLQAGIFNNVGEAIVGTMRQDGPKGFFRGTGATLCREVPFYVAGMCLYAEAKKAAQHVLKRDLEAWETVAVGALSGGVAAIVTTPFDVMKTRMMTAPPGTPVSMQMIVFSILRNEGPLGLFKGAIPRFFWIAPLGAMNFAGYELAKKAMIEDESKSRESIEEKKTMSFSSSISWYKMVVLGGADDPTHKLGDIVDHTRQQHATGLPEKPSNVSCHNGNGHNPLRSSASDSYKYYYDADAPSESDWQSTSPASSSSTRQMLGDGHRNNGSSFRSSSIASSQTQRPSSSSSSSSRRFTVPFVKKIDWGSLWDKSKEWIRNPMNMALSVWILAVGVSGAILFMVMTGMLNRVLPSKPQRDTWFEVNNQILNALFTLMCLYQHPRRFYHLALLCRWRAGDMHQLRQVYCKDGTCKPNERKHMMVVILLLHLNCFAQYALCGLNLGYRRPQRPVIGVALTISVAICAPAVAGLYNNLSPLGKDYEAAQPEADDEESQLQRKTPETERRYTLVPRQGHGSGSSPSSPQWVGGLLGDMWEDMSLAYLSVFCSCCVFGWNMSRLGLGNMYVHVATFVLLCLAPFFIFDLAAISVDDEAVRDALGLAGVFLCVFGLLYGGFWRIQMRRRFGLPENRACCGKPDLTDCMQWLCCYSCSLAQEVRTADAYEVVLEDKQQPMPMPMHHPRHHPTLQEELSTMQEPLRFAGVFASPSPHLNDDGVTIPPSSLSATRT

SEQ ID NO: 21394 - DNA, 3246 bp, Sorghum bicolor
  misc_feature: Ceres ANNOT ID no. 8714787
  misc_feature: Down-regulated in shoot tissues in response to salicylic acid treatment
  misc_feature: Encodes the peptide sequence at SEQ ID NO 21395
atgaccccttccccctccttctcctacacgcccaggagcggcgcctcttcctccgcccacaagcccccaaccacaggcaggcaccgggatcggggccccctcctcttcaacggcaacggtaacagcagcatcagcgctgcccagcaggctgcacagcagcagcaaacctccaccacctcctcctcctcctcctcctccaaggggtccggatccggaggcgttaacgtccaggtcctcctcagatgcaggccattgagcgacgaggaacgccgcgtcggcactcccgtggtggtcacttgcaatgaccagaaacgggaggtttctgttgcccagaacatcgctaacaagcaaattgatcgcacctttcccttcgataaggtgttcggaccaaagtctcagcagcaggatatcttcaaccatgctgttgtgccacttgtcagtgaggttttagacggttacaattgcacaatatttgcatatggtcagactggaactggcaaaacatacaccatggaaggcggaggacgcaaagcactgaacggtgacctcccatctgatgccggtgtcattccaagggctgttaagcgcatatttgacgtccttgaggcacagagtgcagagtacagcatgaaggtttcttttcttgagttgtacaatgaggagctcactgatcttctagccccggaggaatctaaattctctgatgacaagtccaagaagcctatggcactcatggaggatggcaagggaggagtctttgttagagggctcgaggaagagctagtttcttcggctgctgagatctacaggatactggagagaggctctgcaaagagaaaaactgctgaaactcttctcaacaagcaaagcagtcgctcgcactctattttctccatcaccatccatattaaggaatgcacacccgagggtgaggaaatgatcaagtgtggaaagcttaatctcgttgaccttgctggctctgaaaacatatctaggtccggtgctagagacgggcgcgctcgcgaggcaggagaaattaacaagagtctgcttacacttgggcgtgtcattaatactcttgttgagcactctggacacataccatacagggatagcaagttaacaagattgttaagggattccttgggagggaagacaaagacttgcatcatagcgaccatcgcaccttcagtacactgccttgaggagacgctaagcaccctggattacgcacatcgtgcaaaacacatcaagaataagccagaggtcaatcagaagatgatgaaatctgcgctcatcaaagatttgtactttgaaatggaccgtctcaagcaagaactatatgctgcaagagagaaaaatggtgtttatattccgagggaacaatacttagcagatgaagctgaaaagaagcatgatagaggaattcttcaggccatgtcagagaaactggatcggttggagcttattttggaatcaaaagataagcaattagaagagcttcaaggactctatgattctcagaaagttctgagtgcagatctaagtgatcaacttcagacattacagaaaagaatgaaggaaacagagtgcaccctagcggatcttgaagcgaaatacatgaaggcaaataatactattaaggagaagcaatatttgatagaaaatcttcttaaatcagaaaaagttatcgttggtgaagcacaaagactccgatcagagctggagaatacagcaggggatctgcatgggctattttcaaaattagaaaggaaggaaaagattgaagatacaaatagaagtacaattcaacatttccattcccagctgactcaagacattagtgtcttgcatagaacagtctcaacctcggtctctcaacaggagagccaactaaaatcacttgaagaagagatgcaatcttttgtcacctcaaagggcaaggttgctggaggacttcaagagcatgtaagaaagctcaaagagagcttcaattctaggatagcagaattgcatgattttgcaaatgaactcaagcataaatctgtgttgagctttgaaaaccttaattcgcaagttatcacacacacatctggccttgaggattgcatgaagggcctgttggttgatgctgaccaaatactcattgcactacaaaatgggctttctcagcaagaagtgaacttagctacatttattgagcagcagcatgaggggctctctagaaatttggagagaacaaagtctgtttcgacaactacaatgaacttcttcaaaactatagattcccatgcattggagctcataaagattttggaagaatcacagatggaacatcaaaagcaactcttccagcttcagaagaagtttgagtcctttgttgctgatgaagagaagtacttgatggagaaggtcgcagggttatttgcagaatcaaatgctagaaagaaaattatggttcaagatgatatatgcagcctcaataggactgcttctgagcgttcaaacaatttacaaactgaaactaccaagcttcatgattttacatcttctatgaaagagcaatgggaagcctacatgaagagaactgaagaggcattccaacaaaatgtatcatctattgaacagaaacgatgcttcttggcagggaatctgcagcagtgcaagggaagggtagaatcatgttcagaacaatggattactgcacaaaatttggtgttggcgcttggaagaaacaatgcagaagccatcagttcagtcataagtgctgggaatgacgtgagcaaccaactggatgcaagattttcatctgctgtcactgctggatttgaagatagtgacatttcaagcaaatcccttcttagttctattgatgattcgttaagattggaccatggtatttgtgagaatgtgaaatccatcgtgatgacatccagaacagaacttcatgacttggaacatggtcactatgagaagacaaaagtaataacagggaatgccgatagatctctgggacatgattataaggtggatgaagcaacttgttcaacaccaagaaggcgtgagatcaacattccggacagccaatcgatcagggagttggtaaccccccttgatgatctcgtgaaggcattttgggacagcagaacaccggcaaagcttgctgtcaatggaaacgggaagcagcagttggcagggtcgacgacacccgaaacacagagatcccctcttgccacgataaactag

SEQ ID NO: 21395 - protein, 1081 aa, Sorghum bicolor
  misc_feature: Ceres ANNOT ID no. 8714787
  misc_feature: Down-regulated in shoot tissues in response to salicylic acid treatment
  misc_feature (394)..(778): SWISSPROT Homolog: EC 2.7.11.1 Non-specific serine/threonine protein kinase
  misc_feature (81)..(418): Pfam ID: Kinesin Pfam Description: Kinesin motor domain
MTPSPSFSYTPRSGASSSAHKPPTTGRHRDRGPLLFNGNGNSSISAAQQAAQQQQTSTTSSSSSSSKGSGSGGVNVQVLLRCRPLSDEERRVGTPVVVTCNDQKREVSVAQNIANKQIDRTFPFDKVFGPKSQQQDIFNHAVVPLVSEVLDGYNCTIFAYGQTGTGKTYTMEGGGRKALNGDLPSDAGVIPRAVKRIFDVLEAQSAEYSMKVSFLELYNEELTDLLAPEESKFSDDKSKKPMALMEDGKGGVFVRGLEEELVSSAAEIYRILERGSAKRKTAETLLNKQSSRSHSIFSITIHIKECTPEGEEMIKCGKLNLVDLAGSENISRSGARDGRAREAGEINKSLLTLGRVINTLVEHSGHIPYRDSKLTRLLRDSLGGKTKTCIIATIAPSVHCLEETLSTLDYAHRAKHIKNKPEVNQKMMKSALIKDLYFEMDRLKQELYAAREKNGVYIPREQYLADEAEKKHDRGILQAMSEKLDRLELILESKDKQLEELQGLYDSQKVLSADLSDQLQTLQKRMKETECTLADLEAKYMKANNTIKEKQYLIENLLKSEKVIVGEAQRLRSELENTAGDLHGLFSKLERKEKIEDTNRSTIQHFHSQLTQDISVLHRTVSTSVSQQESQLKSLEEEMQSFVTSKGKVAGGLQEHVRKLKESFNSRIAELHDFANELKHKSVLSFENLNSQVITHTSGLEDCMKGLLVDADQILIALQNGLSQQEVNLATFIEQQHEGLSRNLERTKSVSTTTMNFFKTIDSHALELIKILEESQMEHQKQLFQLQKKFESFVADEEKYLMEKVAGLFAESNARKKIMVQDDICSLNRTASERSNNLQTETTKLHDFTSSMKEQWEAYMKRTEEAFQQNVSSIEQKRCFLAGNLQQCKGRVESCSEQWITAQNLVLALGRNNAEAISSVISAGNDVSNQLDARFSSAVTAGFEDSDISSKSLLSSIDDSLRLDHGICENVKSIVMTSRTELHDLEHGHYEKTKVITGNADRSLGHDYKVDEATCSTPRRREINIPDSQSIRELVTPLDDLVKAFWDSRTPAKLAVNGNGKQQLAGSTTPETQRSPLATIN

SEQ ID NO: 21396 - DNA, 3048 bp, Sorghum bicolor
  misc_feature: Ceres ANNOT ID no. 8714848
  misc_feature: Down-regulated in shoot tissues in response to salicylic acid treatment
  misc_feature: Encodes the peptide sequence at SEQ ID NO 21397
atggctggcagggcgcctgagatcgatgaggacctccacagccgccagctcgccgtctatgggcgcgagaccatgaagcgcctcttcggctccaacgtcctcgtctctggactccagggactaggcgctgagatcgcaaaaaaccttgcccttgccggtgtcaagtctgtaaccttgcatgatgataacaaagtcgagctatgggacctgtcaagcaacttcttcctctcggagaaggacgttgggcaaaaccgtgctcaagcttgtgttccaaagctacaagagctgaacaatgctgtcatcatctctaccataactggtgatttgaccaaggaacagctttctaactttcaggctgtggtctttactgatatcagcacagaaaaagcagttgagtttgatgattactgtcatagccaccaaccaccaattgctttcattaagtcggaagttcgtggcctttttggcagtgtttactgtgattttggtcctgagtttactgttttggatgtcgatggtgaggaaccacatacaggaattgtggcatcaatcagcaatgacaacccagcacttgtttcttgtgtggatgatgagcgtttggagttccaagatggtgatctagttgttttctctgaagtgcatggaatgaccgagctcaatgatggaaaaccaagaaagatcaagagcgcaaggccttattctttcactctagaagaagacaccacctcatatggcacatacattagaggtggtattgtcacacaggtgaagccaccaaaggttctgaaattcaaaaccctgaaggaggcaatcaaggagccaggagaatttctcatgagtgatttctccaagtttgaccgcccacctcttttgcatttggccttccaagctttggacaagtttaggtctgagttggcacggttccctattgctgggtcagctgatgatgcacagaagctgattgatcttgctattagtattaatgaaactcttggtgatagtaagcttgaagaaattgacaagaagctcctgcagcatttcgcaagtggttccagggctgttttgaatcctatggctgcaatgtttggtggtattgtaggtcaggaggttgttaaagcatgctcagggaaattccatccactttaccagttcttctactttgattctgttgaatctctgccagttgaaccattggagcctagtgatttgaagccagagaacagtagatatgatgcacaaattagtgtctttggggctaagcttcaaaagaaactggagcagtcaaaaatcttcatggttggttctggggctcttggatgtgaattcttgaagaaccttgcgttaatgggtatttcttgcagtcaaaatgggaagctgactgtgacagatgatgatgttatagagaaaagcaatctcagtcgccagtttctcttccgtgactggaacattggacagcccaagtccacagttgctgcaactgctgctatggcaattaatcctaagcttcatgtggaggcccttcagaacagagcgagtcctgagactgaaaatgtgtttaatgatgccttttgggagagcttggatgctgttgttaatgcattggacaatgtgactgcaagaatgtacattgactccagatgtgtatatttccagaagccacttcttgaatcaggcactctgggtgccaagtgcaacacacagatggttatacctcacctaacagaaaactatggggcatctagagatccaccagaaaagcaggcacctatgtgcactgtacattcatttcctcacaatattgatcactgcctaacgtgggctaggtctgagtttgagggtctacttgagaagactcccaccgaagtaaatgctttcctgtcgaaccctggtggatatgcaactgctgcaagaactgctggtgatgcacaggctagggaccaacttgagcgagttattgaatgccttgagacagacaagtgtgagacattccaagattgtattacctgggcccggctgaagtttgaggattatttctccaaccgtgtaaagcagctgacattcactttccctgaagacgcaatgactagctctggtgctcctttctggtctgctcctaagcggttcccgcgacctctggagttctcatcgtctgactcaagtcacctcaacttcttgttggctgcttctatactaagggcagagacatttggaatacccatacctgattgggcgaaaaacccaacgaaactggctgaagctgtggacaaggtcattgttccggatttccaaccaaaacagggtgttaagatagagacagatgagaaggctactagcctttcctctgcgtctgttgatgatgctgccgtcattgaagagcttatagcaaagctggaagcaatttctaaaacattgccaccaggattccatatgaaccctatacagtttgagaaggatgatgataccaatttccatatggacttgattgctggttttgccaacatgcgggctaggaactacagcatccctgaagttgacaagttgaaggcaaagttcatagcgggaagaatcatcccagccatcgcgacctcaactgcaatggccactggccttgtctgcctggagctttacaaagtccttgctggtgggcacaaggttgaagactaccggaacacatttgcgaaccttgcgatcccgctcttctccatggcggaacctgtgccacccaagaccatcaagcaccaagacatgtcctggactgtctgggaccgctggaccgtaactggcaacatcacgctgagggagctcctggaatggctcaaggagaagggcttgaatgcgtacagcatatcctgtgggacctcactgctgtacaactccatgttcccgagacacaaggatcggctagacaagaaggtggtggatgtggccagggaggtggccaaggtagaagtgcctttgtaccgccgccatctggacgttgtggtggcctgtgaggatgatgatgacaatgacgtcgacatcccgcttgtgtccatttacttccggtaa

SEQ ID NO: 21397 - protein, 1015 aa, Sorghum bicolor
  misc_feature: Ceres ANNOT ID no. 8714848
  misc_feature: Down-regulated in shoot tissues in response to salicylic acid treatment
  misc_feature (426)..(570): Pfam ID: ThiF Pfam Description: ThiF family
  misc_feature (29)..(168): Pfam ID: ThiF Pfam Description: ThiF family
  misc_feature (814)..(882): Pfam ID: UBACT Pfam Description: Repeat in ubiquitin-activating (UBA) protein
  misc_feature (713)..(774): Pfam ID: UBACT Pfam Description: Repeat in ubiquitin-activating (UBA) protein
MAGRAPEIDEDLHSRQLAVYGRETMKRLFGSNVLVSGLQGLGAEIAKNLALAGVKSVTLHDDNKVELWDLSSNFFLSEKDVGQNRAQACVPKLQELNNAVIISTITGDLTKEQLSNFQAVVFTDISTEKAVEFDDYCHSHQPPIAFIKSEVRGLFGSVYCDFGPEFTVLDVDGEEPHTGIVASISNDNPALVSCVDDERLEFQDGDLVVFSEVHGMTELNDGKPRKIKSARPYSFTLEEDTTSYGTYIRGGIVTQVKPPKVLKFKTLKEAIKEPGEFLMSDFSKFDRPPLLHLAFQALDKFRSELARFPIAGSADDAQKLIDLAISINETLGDSKLEEIDKKLLQHFASGSRAVLNPMAAMFGGIVGQEVVKACSGKFHPLYQFFYFDSVESLPVEPLEPSDLKPENSRYDAQISVFGAKLQKKLEQSKIFMVGSGALGCEFLKNLALMGISCSQNGKLTVTDDDVIEKSNLSRQFLFRDWNIGQPKSTVAATAAMAINPKLHVEALQNRASPETENVFNDAFWESLDAVVNALDNVTARMYIDSRCVYFQKPLLESGTLGAKCNTQMVIPHLTENYGASRDPPEKQAPMCTVHSFPHNIDHCLTWARSEFEGLLEKTPTEVNAFLSNPGGYATAARTAGDAQARDQLERVIECLETDKCETFQDCITWARLKFEDYFSNRVKQLTFTFPEDAMTSSGAPFWSAPKRFPRPLEFSSSDSSHLNFLLAASILRAETFGIPIPDWAKNPTKLAEAVDKVIVPDFQPKQGVKIETDEKATSLSSASVDDAAVIEELIAKLEAISKTLPPGFHMNPIQFEKDDDTNFHMDLIAGFANMRARNYSIPEVDKLKAKFIAGRIIPAIATSTAMATGLVCLELYKVLAGGHKVEDYRNTFANLAIPLFSMAEPVPPKTIKHQDMSWTVWDRWTVTGNITLRELLEWLKEKGLNAYSISCGTSLLYNSMFPRHKDRLDKKVVDVAREVAKVEVPLYRRHLDVVVACEDDDDNDVDIPLVSIYFR

SEQ ID NO: 21398 - DNA, 1077 bp, Sorghum bicolor
  misc_feature: Ceres ANNOT ID no. 8715189
  misc_feature: Down-regulated in root tissues in response to methyl jasmonate treatment
  misc_feature: Down-regulated in shoot tissues in response to methyl jasmonate treatment
  misc_feature: Down-regulated in shoot tissues in response to salicylic acid treatment
  misc_feature: Encodes the peptide sequence at SEQ ID NO 21399
atggcgacgacgtgctcgctccttcccatgaataacaactccctaccatgcctcctcgtcgttgtcctcctcgctgtctccctcggcgccggcagctgctcaccgacgacggttcagctggttggcggcggcggcggctacgtcgacgacagcagcagcttcgacagtgctactgatgatcagatgatggagcggttccaacgctggaaggtagagtacaaccgaagctacgcgacggcttcggaggagcgccaccgtttccaggtgtacgccggcaacatgcggtacatcctggcgaggaacggcgaggacccctcgtacgagctcggtgagacggagtacaccgacctcaccaccgacgagttcatggccatgtacaccacggccacgctagcgctggacgacggcttcgacgacgacggcgacagcaacgacggcggcgacggagacgacgacagtgatggcgatgatggcggtgactttgacaccgtgagcggtggccatggcggccacggccgccgttgcgtccgccgttgtgtccgccgttgcatcatcactggcaaaagaggagtagttggccttggccaccgcaagcgttgcgtccgccgttgccgccgccgttgctaccccgtcgtcaaggagacgatcaccactgggtcgggaaagacgacagttcatggcggcggtgtgtttgtgaacgacgaggcggcgctgatgaacgcggtggtggccggccggcagcagcaggagcagccggtggtggccgtcgtcgcgatcagggccggccacccggacttccaccacttcagggggcaaggcgtgtaccgagggcggtgcggcagcaggttcaaccacgccgtcgccgtggttgggtacggggaggacgcggccaccggggagaagtactggatcgtcaagaactcgtgggggaccaagtggggcgacggcggctacatcaagttgaagaggcaacaagtccccgccgccgccggcagcccagcagcagcggcagcagggggctactgcggcctcgccgtcagagtcagaccacctttcgtcccaaccatgaccatgtga

SEQ ID NO: 21399 - protein, 358 aa, Sorghum bicolor
  misc_feature: Ceres ANNOT ID no. 8715189
  misc_feature: Down-regulated in root tissues in response to methyl jasmonate treatment
  misc_feature: Down-regulated in shoot tissues in response to methyl jasmonate treatment
  misc_feature: Down-regulated in shoot tissues in response to salicylic acid treatment
  misc_feature (265)..(323): SWISSPROT Homolog: EC 3.4.22.33 Fruit bromelain
  misc_feature (66)..(122): Pfam ID: Inhibitor_I29 Pfam Description: Cathepsin propeptide inhibitor domain (I29)
  misc_feature (160)..(352): Pfam ID: Peptidase_C1 Pfam Description: Papain family cysteine protease
MATTCSLLPMNNNSLPCLLVVVLLAVSLGAGSCSPTTVQLVGGGGGYVDDSSSFDSATDDQMMERFQRWKVEYNRSYATASEERHRFQVYAGNMRYILARNGEDPSYELGETEYTDLTTDEFMAMYTTATLALDDGFDDDGDSNDGGDGDDDSDGDDGGDFDTVSGGHGGHGRRCVRRCVRRCIITGKRGVVGLGHRKRCVRRCRRRCYPVVKETITTGSGKTTVHGGGVFVNDEAALMNAVVAGRQQQEQPVVAVVAIRAGHPDFHHFRGQGVYRGRCGSRFNHAVAVVGYGEDAATGEKYWIVKNSWGTKWGDGGYIKLKRQQVPAAAGSPAAAAAGGYCGLAVRVRPPFVPTMTM

SEQ ID NO: 21400 - DNA, 5436 bp, Sorghum bicolor
  misc_feature: Ceres ANNOT ID no. 8715223
  misc_feature: Up-regulated in shoot tissues in response to methyl jasmonate treatment
  misc_feature: Encodes the peptide sequence at SEQ ID NO 21401
atggcagacttggcactcgctgggttaaggtgggcagcatcgcccattttcaacaagcttcttaacgaagcttcagcttacctcagtgtggacatggtgcgtgagctccaaaaactagaagccaccgtcctgccacaatttgatctggtgattcaagcagcagagaagagcccccataagggcaagctcgaggcatggcttcggcggctcaaagaagccttttatgatgctgaggacctgctggacgagcatgagtacaatctcctcaagcgcaaggccaagagcggaaaagatcccctgctaggagaggatgaaacctcctccattgcatcaacaatcatgaagccttttcatactgctaagagcaaggcacgcaacttgctccctgagaatagaaggctaattagcaagatgaatgagatcaaagctatcctaacagaagccaaggagcttcgggatcttcttagcatagcacctggaaatactacaggtttagggtggccagctgtaccagcaaccattgttcctccaaccacagtgacatcactttccacatcaaaggttttcggtcgtgacaaggatcgcgatcgtatattagattttcttcttggcaagacagcagctgacgaggcaagttcgactaggtactccagtttggccattattggtgcgggcggaatggggaagtccaccttagtgcagtatgtctacaatgacaagaggatagaagaaggctttgatatcaggatgtgggtctgcatctcacgcaagcttgatgtccgtcgtcacacaagggagattattgagtctgcaacaaatggggagtgcccatgtattgataatcttgatactctccagtgcaaattacgtgacatactgcagaagtcacagaaattcctacttgtcttggatgatgtttggttcgaaaaatcagacagcgagacagagtggtttcagctcctggatccatttgtctctaaacagatgggaagcaaagttttggtgacttctcggcgtgaaacacttccggccgctgttttctgtgatcaacaacaagttgttcatttggaaaaaatggatgatgccaatttcttggcactcttcaaacaccatgctttctctggagcaaaaattggagatcaacttttgcacaataagctggaacatactgcagtggagattgctaaaaggcttggacaatgtcctttggcagcaaaagttcttggttcccggttgagcacaaaaaaagatactgctgaatggaaaggtgctctaaagctcagagatttaagtgagcccttcacagttctcttgtggagttacaagaagttagatccacgtctgcagaggtgcttcttgtattgcagcttattcccaaaaggtcataaatataaacctgatgagttggttcacctttgggtggcagaagggcttgttggttcatgtaatttgagtagcatgacaatagaagatgtcgggagggattatttcaatgagatgctctctgggtctttctttcaattggtttctgaaacagagtattattcatactatatcatgcacgacatccttcatgatttggcacagtcactctctgtagaagactgcttcagattagaagaggataatatcagagaagtaccatgcactgttcgacatctctctcttcaggttgagagtttgcaaaagcataagcaaattatctacaagctacagaatttacgcactatcatctgcattgatccactaatggatgatgcaagcgatatttttgatcagatgctgcggaaccagaagaagttacgtgtattgtatttgtcattttacaacagtagtaagttgcctgaatctattggtaggctgaagcaccttcggtatttgaaccttatcagaacgttaatttctgaattgcctagatcattatgtactctttaccacttgcagttacttcagttaagcctaacggtggagaggttgcctgacaagctttgcaacttaagtaagttgcgacatatgggggcgtacaaggagtacccacatgccttgatggaaaaatctattcatcaaattcccaatataggcaagctaatttcgctacaacacatgcataccttttctgtgcaaaagaagcaaggatacgagttgtggcagctgaaggacttgaatgagcttggtggcagtttaaaagtagaaaatcttgagaatgtttcagaaaaagaagaagccttagagtccatgctctataagaagaatcgccttaaaaagttgcggcttgcctggagtagcgagaagggaatggatgcagtggatactttacatctggatgttctagaaggtctgagaccgtcaccccaacttagtggcctcacaatcaaaggctacaaatctggcacatatccaaggtggttacttgagccatcctattttgaaaatttggaatgtttaaagcttaattgctgcactttgttagaaggcctaccacctaatactgagctcctacggcattgcactaggctgtgtctaaaaaatgttccaaaattgaagattttatcttgtcttccagcaatgcttacaaaattgtcaattgagacgtgcccactgcttatgtttgtctccaaaaatgagctcgaccagcatgatttgagggaaaatataatgaagacagaggacctggcatctaaacttgcatcaatgtgggaggtcaattcaggatcaaatattagggaagtacttgcagaggactattcatccctgaagcagttgacaacgcagatgggtgatgatatatcacaacatcttcaaattattgaaagtggcctagaggaaggaggagatataatattggagaaagaaaatatgatcaaggcatggcttttttgccatgagcagaggataacagtcatttatggaaggaccatggagctgccactggttctaccatcaggaatacgtgaactttatctttcttcatgcagtattacagatgaagctttagctatttgccttggtggcctcacttcattgacaacgttaatgctggaatataatatggcattaactgcacttccttcagaagaggtgtttgagcatttgacaaagcttgacttgttggctgtaagaggttgttggtgtctcagatcactggggggctcacatgctgctccatctctttccagactttattgtattgattgcccttctttagatctggcaggtgcagcagaatctatgtcattcaaccttgctggagacctctacatatgtggctgcattctggcagccgattcgttcattaatggcttgccacacctgaaatctctttccattgcatgttgcagaagcttcccgtccttatcgattggccacctgacctcccttgaatcattatctctacttcgtctccccgatctgtgctctcttgaaggcttgtcttcctggcaacttgatagcctaagtttgatagatgttccaaacctcactgccaagtgcatctcacagtttcgtgtccagaaatggctcagcgttagtagtttcgtactgctcaaccagatgctcaaggctgaagggtttatagtcccaccaaatcttggtcttcatgtttgcaaggagccgtcagcttcatttggagaatgtgcaaatctcttatctgtcaagcacctggacatttgggattgcaaaatggagtccctgccaggaaatctaaaatttctctccagtctggagagtcttgatatcggcatttgccccaacataacatctttaccagttctgccatcctccctccagcgcataactatatatggttgtgacgacttgaagaagaactgccgagagcctgatggagaaagctggccacagatttcacacatccgctggaagcacctcgacctcaaggtcaccctggcacaagcacaacacgacactgactcgccacccagttcaagtcagaagccaatccgttgcagatgctgtcccctcggttctctgtttggtgactgtgcacagtccacagttgggacttgcgaggcaggtggaaaatattccaaaattgtcaaaattgaaaattgccaatccgttgcagatttcacacatccgctagaaaatgttccaaaattgaaaatattaccttgtcttccagcaatgcttacaaaattgtcaattcagacgtgcccactgcttatgtttgtctccaaaaatgagctcgaccagcatggttcgaggggaaatataatgaagacagaggacctggcatctaaacttgcatcaatgtgggaggtcaattcaggatttaatattacggaagtacttgtagaggactattcatccctgaagcagttgacaacgcagatgggtgatgatatatcacaacatcttcaaattattgaaagtggcctagaggaaggaggagatataatatcagacaaagaaaatatgatcaaggcatggcttttttgccatgagcagaggataagagtcctttatggaaggaccatggagctgccactggttgtaccatttggacttgttgatgaagctttagctatttgccttggtggcctcacttcatttacaaggttaagactggaatataatatggcattatctgcacttccatcagaagaggtgtttgagcatttgatcaagcttgactggttgactataagaggttgttggtgtctcagatcactggggggcttaagtgctgctccatatctttccagattttattgtattgattgcccttctttagatctggcacgtggagcagaatttatgtcattcaaccttgctggagagctccacatatgtggctgcattcttgcagctgattcattcattaatggcttggcacacctgaaatctcttatcattatgtgttgcagaacctccccgtccttatcgattggccacctgacctcccttgaatcattagatctaattcatctccccgatctgtgctctcttgaaggcttgtcttcctggcaacttcaatacctaagtttgatagatgttccaaaccttactaccaagtgcatctcacagtttcgtgtccagcaattgctcgtcgttagtagtttcgtactgctcaacttgatgctcaaggctgaagggtttatagtcccaccgaaccttattcttcgttattgcaacgaggcgtcagcttcctttggagaatgtgcaaatctcttatctgtcaagcacctgtacttttggcaatgcaaaatggagttcctgccaggaaatctaaaatttctctcaagtctggagagtcttgatatccgccattgccccaacataacatctttaccagttcttccatcctccctccagcgcataagtctatatggttgtgacgacttgaggaagaactgccgagagcctgatggagaaagctggccacagatttcacacatccgctggaagcacttcgattaa

SEQ ID NO: 21401 - protein, 1811 aa, Sorghum bicolor
  misc_feature: Ceres ANNOT ID no. 8715223
  misc_feature: Up-regulated in shoot tissues in response to methyl jasmonate treatment
  misc_feature (173)..(484): Pfam ID: NB-ARC Pfam Description: NB-ARC domain
MADLALAGLRWAASPIFNKLLNEASAYLSVDMVRELQKLEATVLPQFDLVIQAAEKSPHKGKLEAWLRRLKEAFYDAEDLLDEHEYNLLKRKAKSGKDPLLGEDETSSIASTIMKPFHTAKSKARNLLPENRRLISKMNEIKAILTEAKELRDLLSIAPGNTTGLGWPAVPATIVPPTTVTSLSTSKVFGRDKDRDRILDFLLGKTAADEASSTRYSSLAIIGAGGMGKSTLVQYVYNDKRIEEGFDIRMWVCISRKLDVRRHTREIIESATNGECPCIDNLDTLQCKLRDILQKSQKFLLVLDDVWFEKSDSETEWFQLLDPFVSKQMGSKVLVTSRRETLPAAVFCDQQQVVHLEKMDDANFLALFKHHAFSGAKIGDQLLHNKLEHTAVEIAKRLGQCPLAAKVLGSRLSTKKDTAEWKGALKLRDLSEPFTVLLWSYKKLDPRLQRCFLYCSLFPKGHKYKPDELVHLWVAEGLVGSCNLSSMTIEDVGRDYFNEMLSGSFFQLVSETEYYSYYIMHDILHDLAQSLSVEDCFRLEEDNIREVPCTVRHLSLQVESLQKHKQIIYKLQNLRTIICIDPLMDDASDIFDQMLRNQKKLRVLYLSFYNSSKLPESIGRLKHLRYLNLIRTLISELPRSLCTLYHLQLLQLSLTVERLPDKLCNLSKLRHMGAYKEYPHALMEKSIHQIPNIGKLISLQHMHTFSVQKKQGYELWQLKDLNELGGSLKVENLENVSEKEEALESMLYKKNRLKKLRLAWSSEKGMDAVDTLHLDVLEGLRPSPQLSGLTIKGYKSGTYPRWLLEPSYFENLECLKLNCCTLLEGLPPNTELLRHCTRLCLKNVPKLKILSCLPAMLTKLSIETCPLLMFVSKNELDQHDLRENIMKTEDLASKLASMWEVNSGSNIREVLAEDYSSLKQLTTQMGDDISQHLQIIESGLEEGGDIILEKENMIKAWLFCHEQRITVIYGRTMELPLVLPSGIRELYLSSCSITDEALAICLGGLTSLTTLMLEYNMALTALPSEEVFEHLTKLDLLAVRGCWCLRSLGGSHAAPSLSRLYCIDCPSLDLAGAAESMSFNLAGDLYICGCILAADSFINGLPHLKSLSIACCRSFPSLSIGHLTSLESLSLLRLPDLCSLEGLSSWQLDSLSLIDVPNLTAKCISQFRVQKWLSVSSFVLLNQMLKAEGFIVPPNLGLHVCKEPSASFGECANLLSVKHLDIWDCKMESLPGNLKFLSSLESLDIGICPNITSLPVLPSSLQRITIYGCDDLKKNCREPDGESWPQISHIRWKHLDLKVTLAQAQHDTDSPPSSSQKPIRCRCCPLGSLFGDCAQSTVGTCEAGGKYSKIVKIENCQSVADFTHPLENVPKLKILPCLPAMLTKLSIQTCPLLMFVSKNELDQHGSRGNIMKTEDLASKLASMWEVNSGFNITEVLVEDYSSLKQLTTQMGDDISQHLQIIESGLEEGGDIISDKENMIKAWLFCHEQRIRVLYGRTMELPLVVPFGLVDEALAICLGGLTSFTRLRLEYNMALSALPSEEVFEHLIKLDWLTIRGCWCLRSLGGLSAAPYLSRFYCIDCPSLDLARGAEFMSFNLAGELHICGCILAADSFINGLAHLKSLIIMCCRTSPSLSIGHLTSLESLDLIHLPDLCSLEGLSSWQLQYLSLIDVPNLTTKCISQFRVQQLLVVSSFVLLNLMLKAEGFIVPPNLILRYCNEASASFGECANLLSVKHLYFWQCKMEFLPGNLKFLSSLESLDIRHCPNITSLPVLPSSLQRISLYGCDDLRKNCREPDGESWPQISHIRWKHFD

SEQ ID NO: 21402 - DNA, 3849 bp, Sorghum bicolor
  misc_feature: Ceres ANNOT ID no. 8715225
  misc_feature: Up-regulated in shoot tissues in response to methyl jasmonate treatment
  misc_feature: Encodes the peptide sequence at SEQ ID NO 21403
atggcagacttggcgatcactggcttaagatgggcggcatcgccagtattcaacaagctccttgctgatgcttcagcttacctcagcgtggacatggtgcgtgagctacaacaactagaagccaccatcttgccacaatttgacctggtgattcaagcggctgagaagagcgcctacaggggcaagctggaggcatggctccggcggctcaaagaagccttctatgatgccgaggacctgctggatgagcatgagtacaacctcctcaagcgcaaggccaagagcgggaaggatcccttggtaggggaggacgaaacctcctccattgcatcgaccatcctgaagccacttcgtgccgccaaaagcagggcacacaatttgctccctgagaacagaaagctaattagcaagatgaatgagctcaaggctatcctgaaggaagcaaacgaactccgtgatcttcttagcataccacctggaaatactgcatgtgaaggtgacatactttccacatcaaaggttttcggtcgtgacaaggatcgtgatcatatagttgattttcttcttggcaagacagcagctgacgaggcaagttcaactaggtactccagtttggccattgttggagcgggaggaatggggaagtccaccttagcgcagtatgtctacaatgacaagaggataaaagaaggctttgatgtcaggatatgggtctgcatctcacgcaagcttgatgtccgccgtcacacaaggaagattattgagtctgcaacaaatggggagtgcccatgtattggtaatcttgatactctccagtgcaaattacgtgacatactgcagaagtcagagaaattcctacttgtcttggatgatgtgtggttcgaaaaatctgacagtgagacagagtggtttcaactcctggatccattaatctctaaacagtcaggaagcaaatttttggtgacttctcgaagtgcaacacttccagcagctgttcactgtgaactagaacaagttgttcatttggaaaacatggacgatgccgactttcttgcactcttcaaacaccatgttttctctggaccaaaaattggagacgagcttctatatagtaagctggaacatactgcagaggtgatttctaaaaggcttggacggtgtcctttggtagcaaaagttctaggatcccgattaagcaaaaagaaagatatcactgaatggaaagctgcactgaagctgagtgatttaagtgagcccttcatggctctgttgtggagttatgagaagttagatccacgtctgcagaggtgcttcttgtattgcagcttatttcccaaaggtcatagatataatcatgatgagttgatttacctttgggtggcagaagggcttgttggttcatgtaatttgagtagcaggacaatagaagatgtcgggagggattatttcaatgagatggtctctgggtctttctttcaattggtttctgaaacagagtgttattcatactatatcatgcacgacatccttcatgatttggcacagtcactctctgtagaagactgcttcagattagaagaggataatatcagagaagtaccatgcactgttcgacatctctctcttcaggttgagagtttgcaaaagcataagcaaattatctacaagctacagaatttacgcactatcatctgcattgatccactaatggatgatgcaagcgatatttttgatcagatgctgcggaaccagaagaagttacgtgtattgtatttgtcattttacaacagtagtaagttgcctgaatctgttggtgagctaaagcaccttcggtatttgaacctcatcagaacatcagtgtctgaattgcctagatcattatgtactctttaccacttacagttacttcagttaaacacaatggtggagaggttacctgacaagctttgcaatttaagtaagttacgacatttgggggcatacatcgattgcgtacctaccttgtctggaaaatctattcatcaaattcccaatataggcaagctaacttcgctacaacacatgcataccttttctgtgcaaaaaaagcaagggtgcgagttgtggcagctgaaggacttgaatgagcttggtggcagtttaaaagtagaaaatcttgagaatgtttcagaaaaggaagaagccttagagtccatgctatataagaagaatcgccttaaaaagttgcggcttgcctggagtagcgagaagggaatggatgcagcggatactttacatctcgatgttctagaaggtctgagaccgtcaccccaacttagtggcctcacaatcaaaggctacaaatctggcacatatccaaggtggttacttgagccatcctattttgaaaatttggaatgttttaagcttaatggctgcactttgttagaaggcctaccacctaatactgagctcctacggcattgcactaggctgtgtctaaaaaatgttccaaaattgaagatattaccttgtcttccagcaatgcttacaaaattgtcaattcagacgtgcccactgcttatgtttgtctccaaaaatgagctcgatcagcatgatttgagggaaaatataatgaacacggaggacctggcatctaaacttgcatcgatgtgggaggtcaattcgggatcagatattaggagagtacttttagaggactattcatcactgaagcagttgacaacacagatgggtgatgatatatcacaacatcttcaaattattgaaagtggcctaaaggaaggaggagatataatattggagaaagaaaatatgatcaaggcatggcttttttgccatgagcagaggataagagtcatttatggaaggaccatggagctgccactggttctaccatttggacttgttagtattgttctttcttcatgcagtattacagatgaagctttagctatttgccttggtggcctcacttcattgacaacgttaagactggaatataatatggcattaagtgcacttccgtcagaagaggtgtttgagcatttgacaaagcttgacttgttggatgtaagaggttgttggtgtctcagatcactggggggctcacatgctgctccatctctttccagactttattgtattgattgcccttctttagatctggcaggtgcagtagaatctatgtcattcaaccttgctggagacctctacatatgtggctgcattctggcagccgattcgttcattaatggcttgccacacctgaaatctctttccattgcatgttgcagaagcttcccgtccttatcgattggccacctgacctcccttgaatcattatctctacttcgtctccccgatctgtgctctcttgaaggcttgtcttcctggcaacttgatggcctaagtttgatagatgttccaaacctcactgccaagtgcatctcacagtttcgtgtccagaaatggctcagcgttagtagtttcgtactgctcaaccagatgctcaaggctgaagggtttatagtcccaccaaatcttggtcttcatgattgcaaggagccgtcagcttcatttggagaatgtgcaaatctcttatctgtcaagcacctggacatttgggattgcaaaatggagtccctgccaggaaatctaaaatttctctccagtctggagagtcttgatatcggcatttgccccaacataacatctttaccagttctgccatcctccctccagcgcataactatatatggttgtgacgacttgaagaagaactgccgagagcctgatggagaaagctggccacagatttcacacatccgctggaagcacttcgtttaa

SEQ ID NO: 21403 - protein, 1282 aa, Sorghum bicolor
  misc_feature: Ceres ANNOT ID no. 8715225
  misc_feature: Up-regulated in shoot tissues in response to methyl jasmonate treatment
  misc_feature (158)..(470): Pfam ID: NB-ARC Pfam Description: NB-ARC domain
MADLAITGLRWAASPVFNKLLADASAYLSVDMVRELQQLEATILPQFDLVIQAAEKSAYRGKLEAWLRRLKEAFYDAEDLLDEHEYNLLKRKAKSGKDPLVGEDETSSIASTILKPLRAAKSRAHNLLPENRKLISKMNELKAILKEANELRDLLSIPPGNTACEGDILSTSKVFGRDKDRDHIVDFLLGKTAADEASSTRYSSLAIVGAGGMGKSTLAQYVYNDKRIKEGFDVRIWVCISRKLDVRRHTRKIIESATNGECPCIGNLDTLQCKLRDILQKSEKFLLVLDDVWFEKSDSETEWFQLLDPLISKQSGSKFLVTSRSATLPAAVHCELEQVVHLENMDDADFLALFKHHVFSGPKIGDELLYSKLEHTAEVISKRLGRCPLVAKVLGSRLSKKKDITEWKAALKLSDLSEPFMALLWSYEKLDPRLQRCFLYCSLFPKGHRYNHDELIYLWVAEGLVGSCNLSSRTIEDVGRDYFNEMVSGSFFQLVSETECYSYYIMHDILHDLAQSLSVEDCFRLEEDNIREVPCTVRHLSLQVESLQKHKQIIYKLQNLRTIICIDPLMDDASDIFDQMLRNQKKLRVLYLSFYNSSKLPESVGELKHLRYLNLIRTSVSELPRSLCTLYHLQLLQLNTMVERLPDKLCNLSKLRHLGAYIDCVPTLSGKSIHQIPNIGKLTSLQHMHTFSVQKKQGCELWQLKDLNELGGSLKVENLENVSEKEEALESMLYKKNRLKKLRLAWSSEKGMDAADTLHLDVLEGLRPSPQLSGLTIKGYKSGTYPRWLLEPSYFENLECFKLNGCTLLEGLPPNTELLRHCTRLCLKNVPKLKILPCLPAMLTKLSIQTCPLLMFVSKNELDQHDLRENIMNTEDLASKLASMWEVNSGSDIRRVLLEDYSSLKQLTTQMGDDISQHLQIIESGLKEGGDIILEKENMIKAWLFCHEQRIRVIYGRTMELPLVLPFGLVSIVLSSCSITDEALAICLGGLTSLTTLRLEYNMALSALPSEEVFEHLTKLDLLDVRGCWCLRSLGGSHAAPSLSRLYCIDCPSLDLAGAVESMSFNLAGDLYICGCILAADSFINGLPHLKSLSIACCRSFPSLSIGHLTSLESLSLLRLPDLCSLEGLSSWQLDGLSLIDVPNLTAKCISQFRVQKWLSVSSFVLLNQMLKAEGFIVPPNLGLHDCKEPSASFGECANLLSVKHLDIWDCKMESLPGNLKFLSSLESLDIGICPNITSLPVLPSSLQRITIYGCDDLKKNCREPDGESWPQISHIRWKHFV

SEQ ID NO: 21404 - DNA, 354 bp, Sorghum bicolor
  misc_feature: Ceres ANNOT ID no. 8715294
  misc_feature: Up-regulated in shoot tissues in response to methyl jasmonate treatment
  misc_feature: Up-regulated in root tissues in response to methyl jasmonate treatment
  misc_feature: Up-regulated in shoot tissues in response to salicylic acid treatment
  misc_feature: Encodes the peptide sequence at SEQ ID NO 21405
atggctcggcttgctgtggcgatcgccgtggtggcggcggcggcggtggtggtgctggcggcgacgacctcggaggcggccatctcctgcgggcaggtgagctcggccatcgcgccctgcctgtcctacgcccggggccagggctccgcaccctcagcaggctgctgcagcggcgtcaggagcctcaactccgccgcccgcaccaccgccgacaggcgcgccgcctgcaactgcctcaagaacgccgcccgtggcatcagcggcctcaacgccggcaacgccgccagcatcccctccaagtgcggcgtcagcgtcccctacaccatcagcacctccaccgactgctccaggtaa

SEQ ID NO: 21405 - protein, 117 aa, Sorghum bicolor
  misc_feature: Ceres ANNOT ID no. 8715294
  misc_feature: Up-regulated in shoot tissues in response to methyl jasmonate treatment
  misc_feature: Up-regulated in root tissues in response to methyl jasmonate treatment
  misc_feature: Up-regulated in shoot tissues in response to salicylic acid treatment
  misc_feature (30)..(115): Pfam ID: Tryp_alpha_amyl Pfam Description: Protease inhibitor/seed storage/LTP family
MARLAVAIAVVAAAAVVVLAATTSEAAISCGQVSSAIAPCLSYARGQGSAPSAGCCSGVRSLNSAARTTADRRAACNCLKNAARGISGLNAGNAASIPSKCGVSVPYTISTSTDCSR

SEQ ID NO: 21406 - DNA, 354 bp, Sorghum bicolor; identical to SEQ ID NO: 21404
  misc_feature: Ceres ANNOT ID no. 8715292
  misc_feature: Up-regulated in shoot tissues in response to methyl jasmonate treatment
  misc_feature: Up-regulated in root tissues in response to methyl jasmonate treatment
  misc_feature: Up-regulated in shoot tissues in response to salicylic acid treatment
  misc_feature: Encodes the peptide sequence at SEQ ID NO 21407

SEQ ID NO: 21407 - protein, 117 aa, Sorghum bicolor; identical to SEQ ID NO: 21405
  misc_feature: Ceres ANNOT ID no. 8715292
  misc_feature: Up-regulated in shoot tissues in response to methyl jasmonate treatment
  misc_feature: Up-regulated in root tissues in response to methyl jasmonate treatment
  misc_feature: Up-regulated in shoot tissues in response to salicylic acid treatment
  misc_feature (30)..(115): Pfam ID: Tryp_alpha_amyl Pfam Description: Protease inhibitor/seed storage/LTP family

SEQ ID NO: 21408 - DNA, 957 bp, Sorghum bicolor
  misc_feature: Ceres ANNOT ID no. 8715338
  misc_feature: Up-regulated in root tissues in response to methyl jasmonate treatment
  misc_feature: Down-regulated in shoot tissues in response to methyl jasmonate treatment
  misc_feature: Down-regulated in shoot tissues in response to salicylic acid treatment
  misc_feature: Up-regulated in root tissues in response to salicylic acid treatment
  misc_feature: Encodes the peptide sequence at SEQ ID NO 21409
atgttggcggtgttcagcggcggtgtggtggaggtgccggcggagctggtggcggcgggaagccggacgccgtcgcccaagaccagggcgtccgagctcgtcggccggttcctgggtgcctccgagccggccgtctccgtgcagctcggcgacctcggccacctcgcttactcccacaccaaccaggcactcctccgcccaaggtcgttcgcggcgaaagacgaggtgttctgcctgttcgagggtgtgctggacaacctggggcggctgagccagcagcacgggctgtccaccaagggcgccaacgaggtgctcctcgtcatcgaggcctacaagacgctccgtgaccgggcgccctacccggccagcttcatgctcgcacagctcaccggcagctacgccttcgtgctcttcgacaagtccaccaactccctcctcgtcgcatctgatcctgagggcaaggtgccgctcttctgggggatcactgctgatggctgcgtcgccttctctgatgacattgacatgctcaaaggatcatgtggcaaatcgctcgcgcctttcccacaaggttgcttctactctaacgcccttggaggcctgaagtgctatgagaaccccaagcacaaggtcactgctgttcctgcagacgaggaagaaatctgtggtgcaactttcaaggacgtcaccgtcggaacttccgacaggtgtcgggacttccgacgggtcagcactgctgacgctggccggaactgctggcactcgcgcgagacaggcctggcgtcgggacttccgacgcgtgcgcgcgcagaactcaacgtcgggacttccgacgctcacagttctcgcgcagcatgtcgggagttccgacacacgtcgggacttccgacaccagaagtcatagaagttaatcctaagtgcaagagaggtgctagagtgtctctaaaaagattaagatga

SEQ ID NO: 21409 - protein, 318 aa, Sorghum bicolor
  misc_feature: Ceres ANNOT ID no. 8715338
  misc_feature: Up-regulated in root tissues in response to methyl jasmonate treatment
  misc_feature: Down-regulated in shoot tissues in response to methyl jasmonate treatment
  misc_feature: Down-regulated in shoot tissues in response to salicylic acid treatment
  misc_feature: Up-regulated in root tissues in response to salicylic acid treatment
  misc_feature (129)..(215): SWISSPROT Homolog: EC 6.3.5.4 Asparagine synthase (glutamine-hydrolyzing)
MLAVFSGGVVEVPAELVAAGSRTPSPKTRASELVGRFLGASEPAVSVQLGDLGHLAYSHTNQALLRPRSFAAKDEVFCLFEGVLDNLGRLSQQHGLSTKGANEVLLVIEAYKTLRDRAPYPASFMLAQLTGSYAFVLFDKSTNSLLVASDPEGKVPLFWGITADGCVAFSDDIDMLKGSCGKSLAPFPQGCFYSNALGGLKCYENPKHKVTAVPADEEEICGATFKDVTVGTSDRCRDFRRVSTADAGRNCWHSRETGLASGLPTRARAELNVGTSDAHSSRAACREFRHTSGLPTPEVIEVNPKCKRGARVSLKRLR

SEQ ID NO: 21410 - DNA, 3111 bp, Sorghum bicolor
  misc_feature: Ceres ANNOT ID no. 8715477
  misc_feature: Up-regulated in shoot tissues in response to methyl jasmonate treatment
  misc_feature: Encodes the peptide sequence at SEQ ID NO 21411
atggagcgcgcacgccgccacgccagccgcgcgctgctgcgccgcctgctcgcggcggccaccaccaccaccaccaccgcgtcccctgccacgtcatcgtcccgcggcatctccaccctgtcgccggcggctcccgcggcggggaggcagcagcagcagcgccgccggcctcctccccaccagcacgcgcagggccggccggtgtcggtgtcggcgctacagccgagcgacacgttcccgcggcggcacaactcggcgacgcccgcggagcaggcggcgatggcaacaacctgcgggttcgacggcggcctcgacgcgctgatcgacgcgacggtgccagccgccatccgcgccccgccgatgcgcttctccgggaggttcgacgccgggctcaccgagtcgcagatgctggaccacatgcagcgcctggcgtccatgaacaaagcctacaagtccttcatcgggatggggtactacggcacgcacgtcccgggcgtcgtgctgcgcaacctcatggagaacccggcgtggtacacgcagtacaccccgtaccaggcggagatcgcgcagggccgcctcgagtcgctgctcaactaccagaccatggtcgccgatctcaccggtctccccatgtccaacgcgtccctcctcgacgaggccaccgccgccgctgaggccatggccatgtgcaacggcatcgttagggggaagaagaagacgttcctcatcgcgtccaactgccacccgcagaccatcgatgtctgccggacgcgcgccgacggattcgacatcagtgtcgtcgtcgctgacgccaaggactttgactacagcggcggcgacgtctgcggcgtgctcgtgcagtacccggggacggagggcgaggtgctcgactacgcgcagttcgtcagggacgcgcacgcgcacggcgtcaaggtcgtcatggccaccgacctgctcgcgctcaccacgctgcgcccgccgggcgagatcggcgccgacatcgccgtcggatccgcgcagcggttcggcgtgcccatgggctacggtggcccgcacgccgcgttcctcgccacgtcgcaggagtacaagcgtctcatgcccggccggatcatcggggttagcgtcgattccaccggcaagcccgcgctccgcatggcgatgcagacccgggagcagcacatccgcagggacaaggccaccagcaacatctgcactgcccaggccttgctcgccaacatggctgccatgtacgctgtctaccacggtccggcggggctgaaggcgatcgctgaccgggttcatggcctggctggcaccttcgcccacggcctcaagaagctcgggacagtgacggttcaggatctgcccttcttcgacacggtcaaggtcacgtgctctgatgcacgtgcaatcgccaaggaagctgtcaaaaacgagatgaaccttagggttgtcgacgccaacacgataaccgtagcatttgatgagacctccaccctggaggatgttgacaagctgttcaaggtgttcaacaatggcaaatcagcaagcttcacagctgaatccctcgccccagaggtctcaagctcaattcctagcagccttgctcgcgagagcccctacctaacgtaccacacagagcatgagcttcttcgttacctgcataagttgcagtccaaggatctctcactgtgccacagtatgatccctcttggttcttgcacaatgaagctaaacgctactgttgagatgatgcctgttacgtatcccaacttcgcgaacctccacccatttgccccaactgatcaggctgcagggtaccatgaaatgtttgacgacttgggcaacctgttatgcacgatcacaggttttgattctttctctttgcaaccaaatgctggtgctgcaggagagtatgctggattgatggttatccgtgcttacctcaactcaagaggagaacaccaccgcgatgtctgcatcattcctgtctcagcacacggcacaaatcctgcaagtgctgctatggttggaatgaagattgttgccgttggaaccgattccaagggtaacataaacatcgaggaattgaggaaagctgcagaagcaaacaaggacaacttggctgctctgatggttacctacccttcaactcacggagtctatgaagaaggcattgatgagatctgcaggatcattcatgaaaatggcggacaggtctacatggacggggctaacatgaatgctcaggttgggttaacaagccctggttttattggagctgatgtttgtcaccttaaccttcacaagacattttgcattccacatggtggaggtggtcctggcatgggtcctattggggttaagaagcatttggcaccgtttttaccctctcacccagtgattcccactggtggctttcctctccctgagaaaaccgaccctctcggtaccatttctgctgctccatggggatctgccttgattctgccaatttcctatgcatatatagccatgatgggttcacaaggactcactgatgcttcaaagatcgcgatcttgaatgcaaactacatggcaaaacgtctagagaaacactacccagttttgttccgtggagtcaatggaactgttgcccatgaattcatcattgatttaagaggatttaagacgactgctggtatagaaccagaggacgtggcaaagcgcctgatggactacggatttcactcaccaaccatgtcatggcctgttcctggcacacttatgattgaaccaactgaaagtgagagcaaggccgagctggacaggttctgtgatgctcttatctccatcagggaagagatcgcagagatagaaaatggcaaagcagatgtgctcaacaatgtcctgaagggcgctcctcacccaccgcaactcttgatgggtgacacatggagcaagccgtattccagggagtacgctgcgttccccgcggcatggctccggggcgccaagttctggccaacaactggtcgtgtggacaacgtctacggcgaccgcaacctcatctgcacactgcagcaggcgtcccaggtgaccgaggaagccgccgcagctgcaactgcgtaa

SEQ ID NO: 21411 - protein, 1036 aa, Sorghum bicolor
  misc_feature: Ceres ANNOT ID no. 8715477
  misc_feature: Up-regulated in shoot tissues in response to methyl jasmonate treatment
  misc_feature (68)..(1025): SWISSPROT Homolog: EC 1.4.4.2 Glycine dehydrogenase (decarboxylating)
  misc_feature (81)..(510): Pfam ID: GDC-P Pfam Description: Glycine cleavage system P-protein
MERARRHASRALLRRLLAAATTTTTTASPATSSSRGISTLSPAAPAAGRQQQQRRRPPPHQHAQGRPVSVSALQPSDTFPRRHNSATPAEQAAMATTCGFDGGLDALIDATVPAAIRAPPMRFSGRFDAGLTESQMLDHMQRLASMNKAYKSFIGMGYYGTHVPGVVLRNLMENPAWYTQYTPYQAEIAQGRLESLLNYQTMVADLTGLPMSNASLLDEATAAAEAMAMCNGIVRGKKKTFLIASNCHPQTIDVCRTRADGFDISVVVADAKDFDYSGGDVCGVLVQYPGTEGEVLDYAQFVRDAHAHGVKVVMATDLLALTTLRPPGEIGADIAVGSAQRFGVPMGYGGPHAAFLATSQEYKRLMPGRIIGVSVDSTGKPALRMAMQTREQHIRRDKATSNICTAQALLANMAAMYAVYHGPAGLKAIADRVHGLAGTFAHGLKKLGTVTVQDLPFFDTVKVTCSDARAIAKEAVKNEMNLRVVDANTITVAFDETSTLEDVDKLFKVFNNGKSASFTAESLAPEVSSSIPSSLARESPYLTYHTEHELLRYLHKLQSKDLSLCHSMIPLGSCTMKLNATVEMMPVTYPNFANLHPFAPTDQAAGYHEMFDDLGNLLCTITGFDSFSLQPNAGAAGEYAGLMVIRAYLNSRGEHHRDVCIIPVSAHGTNPASAAMVGMKIVAVGTDSKGNINIEELRKAAEANKDNLAALMVTYPSTHGVYEEGIDEICRIIHENGGQVYMDGANMNAQVGLTSPGFIGADVCHLNLHKTFCIPHGGGGPGMGPIGVKKHLAPFLPSHPVIPTGGFPLPEKTDPLGTISAAPWGSALILPISYAYIAMMGSQGLTDASKIAILNANYMAKRLEKHYPVLFRGVNGTVAHEFIIDLRGFKTTAGIEPEDVAKRLMDYGFHSPTMSWPVPGTLMIEPTESESKAELDRFCDALISIREEIAEIENGKADVLNNVLKGAPHPPQLLMGDTWSKPYSREYAAFPAAWLRGAKFWPTTGRVDNVYGDRNLICTLQQASQVTEEAAAAATA

SEQ ID NO: 21412 - DNA, 3111 bp, Sorghum bicolor; identical to SEQ ID NO: 21410
  misc_feature: Ceres ANNOT ID no. 8715478
  misc_feature: Up-regulated in shoot tissues in response to methyl jasmonate treatment
  misc_feature: Encodes the peptide sequence at SEQ ID NO 21413

SEQ ID NO: 21413 - protein, 1036 aa, Sorghum bicolor; identical to SEQ ID NO: 21411
  misc_feature: Ceres ANNOT ID no. 8715478
  misc_feature: Up-regulated in shoot tissues in response to methyl jasmonate treatment
  misc_feature (68)..(1025): SWISSPROT Homolog: EC 1.4.4.2 Glycine dehydrogenase (decarboxylating)
  misc_feature (81)..(510): Pfam ID: GDC-P Pfam Description: Glycine cleavage system P-protein

SEQ ID NO: 21414 - DNA, 3246 bp, Sorghum bicolor
  misc_feature: Ceres ANNOT ID no. 8715594
  misc_feature: Down-regulated in shoot tissues in response to salicylic acid treatment
  misc_feature: Encodes the peptide sequence at SEQ ID NO 21415
atgtcgcagatcctcctcctcctccgcctctccgcccactcccacggcgtccgcatccacggctgccgccgcctcagctccgcggtctacggcggcgggaggcggccggccgggccgccgcgggacgacgaggccagccgggcggtgcgggtgtcggtgtggtgggacttcgagaactgcaacatccccaacggcgtcaacgtcaaccgcgtcgccccgcgcgtgtccgccgcgctccgcgccgccggcatccgcgggccgctctccatcaccgccttcggggacgtgctgcagctcgcgcggtcctcacaggaggcgctcgccgctacgggcgtctccatctcccacgtcccaagcagtgggaagaatagttctgaccgctcttttatggctgatcttgtctactggattgctcagaatccgccaccagttcattttttccttatatctggggataaagattttgcaaacatcttgcatcgtttgcgaatgagcaactacaatgtactgcttgcttgtcctagttctgctaccagtgtactgtgcagtgcagcaacaatcatgtggccttgggatggtttagttagaggggaggatttgtcaccaaaacgttttaaccacccaccggatggtttacatggatcttggtatggtcactgccaaggagcccttgatgacccctccctggagaaggaatcgaaggaacccatcaatgtagcatctgatccaaagcatttttcagtaccatctgataccaagcctagctcagcccctaaatatgtaacaaatgcaattctagaggtactacgttcatatcctgaagggatgaggatctcagaactccgaggacagcttataaagaacagtattgatcttgatacagatttttttggtcacaagaaattctctcgccttcttgaatcaatgccaaatgttgttaaactagtagatcatccaagtgaaaaccaactatatgcaattcccgtcaacaaaagacttctgcagcctggtgacagagcccttgatgaccccttcctggagaaggaatcagaggaacccatcaaggtaccaactgagtcccagcattgttcagtaccatctgataccaagcctagctcagttcctaaatatgtaaaaaatgcaattctggagacactacgttcatatcctgaagggatcaacctttcactactccgaacagagctcaagaagaaaacaatttgtctcggtccaggtttttttggctacaagaagttctcttgccttctccaatcaataccagatattgaattggtgggtcctcaaactggtgaaggatatgcaattgctgtcaacagaagattgctgcagcctggtgacggatgtactaagacccttagctcagatcaatgtaatgtcagggagaataacccaactgggacagcacacactgataagaagcatacactaagttcttctcaaagcattgactggagcagaagcttcatagagacactaagtgaacacccacctacattttctgtcttaccttccccatcaaatgggctatctgaggaccaaaatgagtgcccagtggctgatgtgagtgggtcgacagagtcaccatcaaagcacagggaagttgatgaaatgactacccctggaactccctcttcctcaggggtggaaaatgccgctaacaaagatggattctttaaaaggatctggacaatgtggaatggccccgagaatgttaagtctgaggtttctcaaaattgtgaaagcatttctgcagaagtgattgatgatttgcaaaaaatgacctcttccaaaaatgaccgctcagatggtactgagagcacggcagcagtaagtgataatttatcaatttcattaggtgacgatcattctgaaaaaataaagagagatccatcaattcctgaaaacccagaaccatgcagaaaacctgttgctgtttccgtgagtaaacctggaaagaaggatgacatttccgaaatgaattggggcctgtttaactgggcttcaaggtggtggacatttggaaaatcagatgcagatagtagtacaaccaacataaatgctgatgatgaactgaagactgactctattgaagaatttgaatcttcgaatgttccaacttatggaagtgcacagcaggtggttcatgaaatttttacaaagcctgacttgtgggcagttttggagcaacagttatcagaacctcttgggtctgaggttattttgaaagcaaagacaagggaggaattggcacatggattgcggaagttaaattgttggcctttgaaaggcctccttgagaaagatctgcatcatctggtacatttgttaatttcggaaaagaaatggattgaagaaacttcttccagacttttccctttccgtcttaccctccctcacaagagaaaatgtgttccatcgagttccaacaaatccaatggtcttagttttattttttcaagtgggaagccacaaaagggcaaatatgtttataaaagtaggaaaagcaagtctctcactagggaggagatactatcagattgtcacaagttgttgaaggagcttctttctgagtctgaatatggattcaacatcggaattttcaagcgctgttttactcagaagtatggatacgagcttaatcaccagaagcttgggtatccggaccttgaatcactgttgcaaattatgcctgatgcaagggtaaaattcccaagggttatgccctcagaacacgggaacggccagggtggcagcaaggcaaatggaaaccgaagcaatggtgatgacttgatttgggaggagcttggtcctgtatcagccactactgcaaccgctgctgcaggggtcgacaaggaaatgtgctactgtcctcccactccttcagatgatgaattctcggatagcgacagtgtaaaagatcagcagcctagaagaaacactgagcagcagagctcgcttctccagatcattggttcttggaacagtagcaagagtgatggctgtagcaagaaacctcaagacattgatgggttggtggactgttctagacgcagcccaggcaatcttgacagtatggccttaggaaaggctcaaacgtcttcaaaactatcgcataagcagtactctttcgtgtcggactctggggaagacagtgagccggataagctagttgagagcgtcttgggcagtctgcaaaaagcacgggcctcaaagttgcacaattga

SEQ ID NO: 21415 - protein, 1081 aa, Sorghum bicolor
  misc_feature: Ceres ANNOT ID no. 8715594
  misc_feature: Down-regulated in shoot tissues in response to salicylic acid treatment
MSQILLLLRLSAHSHGVRIHGCRRLSSAVYGGGRRPAGPPRDDEASRAVRVSVWWDFENCNIPNGVNVNRVAPRVSAALRAAGIRGPLSITAFGDVLQLARSSQEALAATGVSISHVPSSGKNSSDRSFMADLVYWIAQNPPPVHFFLISGDKDFANILHRLRMSNYNVLLACPSSATSVLCSAATIMWPWDGLVRGEDLSPKRFNHPPDGLHGSWYGHCQGALDDPSLEKESKEPINVASDPKHFSVPSDTKPSSAPKYVTNAILEVLRSYPEGMRISELRGQLIKNSIDLDTDFFGHKKFSRLLESMPNVVKLVDHPSENQLYAIPVNKRLLQPGDRALDDPFLEKESEEPIKVPTESQHCSVPSDTKPSSVPKYVKNAILETLRSYPEGINLSLLRTELKKKTICLGPGFFGYKKFSCLLQSIPDIELVGPQTGEGYAIAVNRRLLQPGDGCTKTLSSDQCNVRENNPTGTAHTDKKHTLSSSQSIDWSRSFIETLSEHPPTFSVLPSPSNGLSEDQNECPVADVSGSTESPSKHREVDEMTTPGTPSSSGVENAANKDGFFKRIWTMWNGPENVKSEVSQNCESISAEVIDDLQKMTSSKNDRSDGTESTAAVSDNLSISLGDDHSEKIKRDPSIPENPEPCRKPVAVSVSKPGKKDDISEMNWGLFNWASRWWTFGKSDADSSTTNINADDELKTDSIEEFESSNVPTYGSAQQVVHEIFTKPDLWAVLEQQLSEPLGSEVILKAKTREELAHGLRKLNCWPLKGLLEKDLHHLVHLLISEKKWIEETSSRLFPFRLTLPHKRKCVPSSSNKSNGLSFIFSSGKPQKGKYVYKSRKSKSLTREEILSDCHKLLKELLSESEYGFNIGIFKRCFTQKYGYELNHQKLGYPDLESLLQIMPDARVKFPRVMPSEHGNGQGGSKANGNRSNGDDLIWEELGPVSATTATAAAGVDKEMCYCPPTPSDDEFSDSDSVKDQQPRRNTEQQSSLLQIIGSWNSSKSDGCSKKPQDIDGLVDCSRRSPGNLDSMALGKAQTSSKLSHKQYSFVSDSGEDSEPDKLVESVLGSLQKARASKLHN

SEQ ID NO: 21416 - DNA, 1260 bp, Sorghum bicolor
  misc_feature: Ceres ANNOT ID no. 8715915
  misc_feature: Down-regulated in shoot tissues in response to salicylic acid treatment
  misc_feature: Encodes the peptide sequence at SEQ ID NO 21417
atgttgcccccgctttcttcggctccttcccgtctgctccccaggcgaactgtcgcttccgccaccgcctcctcgccctcgccttcgcctccgccttcacgcgcaggagggcacagccgccgccccctgcgctacgccgtcctcggcgccggcttcgcgggtctctccgtcgcgtggcacctcctcaagcatagcccgagggattcccgcgtgtcggtggacatctacgacgagaacggggtcgggggaggtgcgtcgggcgtctcgggagggcttctccatccctactcgcctaaagtgaagcttctctggagtggtgctgagttctggaaagagagcatggatctccttcgaagcgcagagcaagcaaatagaaccacggggtcagatataactaatggagatgataaccttatctggagaaggggaattgtacggccgcctacaactgagaaggctgcagacatattgctggagcgtctgatccctgggttgcgtaccccatttgacttcgcagtttacatgccactggcactgaacgtcaaccctaagaaatatctacaggcactgttctctgcgtgccaaaatctggcagatgaagcatcctcattaccaagtgagcagaaagagttcaagctatacaagcaacatgttgatgatctacaccatttggcaggaaattatgattcggtgatcgtctgccttggggccaaggttcgctcacttcctgaacttgcaaataagttgcctcttaggacctgtagaggagttatcgctgaatttaagttgccatccgatacagtagaagagtatggcagtcaaagcccttcaatcttatctgatgcatggctggcattccaaggtccccgatctgtttctatcggatcaacttggcaatggaagtctgagaacgattcttcaactgtatctgatgaagaatctcttactgcaatggaagagttgctcccaaaagcttctggcgtatatccaagaataaataaatgggattttgtaggtgcaagagctggaattcgagccatgcctccacttacagctaatgggtcgttgccactgttgggttgtttggacgatttactaggcaagaagagcaactgcacattttggctagttggtggacttggtgcaagaggtcttctgtatcatggtttagttggaaagttgactgccaaagctgtgatttcctgtgatgaaaacataataccttctgagttcacatgctggaatacaattaagccttag

SEQ ID NO: 21417 - protein, 419 aa, Sorghum bicolor
  misc_feature: Ceres ANNOT ID no. 8715915
  misc_feature: Down-regulated in shoot tissues in response to salicylic acid treatment
  misc_feature (44)..(398): Pfam ID: DAO Pfam Description: FAD dependent oxidoreductase
MLPPLSSAPSRLLPRRTVASATASSPSPSPPPSRAGGHSRRPLRYAVLGAGFAGLSVAWHLLKHSPRDSRVSVDIYDENGVGGGASGVSGGLLHPYSPKVKLLWSGAEFWKESMDLLRSAEQANRTTGSDITNGDDNLIWRRGIVRPPTTEKAADILLERLIPGLRTPFDFAVYMPLALNVNPKKYLQALFSACQNLADEASSLPSEQKEFKLYKQHVDDLHHLAGNYDSVIVCLGAKVRSLPELANKLPLRTCRGVIAEFKLPSDTVEEYGSQSPSILSDAWLAFQGPRSVSIGSTWQWKSENDSSTVSDEESLTAMEELLPKASGVYPRINKWDFVGARAGIRAMPPLTANGSLPLLGCLDDLLGKKSNCTFWLVGGLGARGLLYHGLVGKLTAKAVISCDENIIPSEFTCWNTIKP

SEQ ID NO: 21418 - DNA, 1155 bp, Sorghum bicolor
  misc_feature: Ceres ANNOT ID no. 8716063
  misc_feature: Down-regulated in shoot tissues in response to salicylic acid treatment
  misc_feature: Encodes the peptide sequence at SEQ ID NO 21419
atggcggccacagcgtccctgaagagcagccttctcctcccgtctcctatctccgacttcagcggcgcagccgtctccatctcagtctcagcgcagaagaggaggtcatcatggcagccaagaggggcgagggtgcaggtctcggcggcggcggcggcggactccaagaacattttggtgatggggggaacaaggttcattggggtcttcctgtccaggatccttgtcaaggagggtcatcaggttacattgttcactaggggaaaggcacccataactcagcagttaccaggagaatccgacgcagagtacgcagagttctcctccaaggttcagcacttgaaaggtgacaggcaggacttcgaattcgtcaagacaagcctggctgctaagggatacgatgtcgtttacgacatcaatggacgtgaggctgtgcaagttgagcctatcattgacgccttgcctaacctggaacagtacatctattgctcatcggcaggagtgtacctgaaatctgacattcttccacactgtgaggttgacgcggtggaccccaagagccgtcacaaggggaagctggagacggagagcctgctgacatcgcgcggcgtgaactggacgtccatcaggcccgtgtacatctacggcccgctcaactacaaccccgtggaggagtggttcttccaccggctaaaggccggccgccccatccccatccccggcgccggcaaccagatcacccagctcggccatgtcaaggacctggcaagagccttcaacctggtgctgggcaaccccaaggcgagccagcagatcttcaacatctccggcgccaagtacgtcaccttcgacggccttgcgcgggcctgcgcaaaggctggagggttccctgagccggagctcgtccactacaaccccaaggacttcgacttcggcaagaagaaggctttccccttcagggaccagcacttctttgcgtctgtggagaaggcgatcagcgagctcgggtggacgccggagttcgacctcgtcgacgggctcaccgactcgtacaacctcgacttcggccgcggcacgttccgcaaggcggctgacttcaccacagacgacataatcctcggcaagaagcttgccaccacccgagctcttatctga

SEQ ID NO: 21419 - protein, 384 aa, Sorghum bicolor
  misc_feature: Ceres ANNOT ID no. 8716063
  misc_feature: Down-regulated in shoot tissues in response to salicylic acid treatment
  misc_feature (58)..(364): SWISSPROT Homolog: EC 5.1.3.2 UDP-glucose 4-epimerase
  misc_feature (58)..(276): Pfam ID: Epimerase Pfam Description: NAD dependent epimerase/dehydratase family
MAATASLKSSLLLPSPISDFSGAAVSISVSAQKRRSSWQPRGARVQVSAAAAADSKNILVMGGTRFIGVFLSRILVKEGHQVTLFTRGKAPITQQLPGESDAEYAEFSSKVQHLKGDRQDFEFVKTSLAAKGYDVVYDINGREAVQVEPIIDALPNLEQYIYCSSAGVYLKSDILPHCEVDAVDPKSRHKGKLETESLLTSRGVNWTSIRPVYIYGPLNYNPVEEWFFHRLKAGRPIPIPGAGNQITQLGHVKDLARAFNLVLGNPKASQQIFNISGAKYVTFDGLARACAKAGGFPEPELVHYNPKDFDFGKKKAFPFRDQHFFASVEKAISELGWTPEFDLVDGLTDSYNLDFGRGTFRKAADFTTDDIILGKKLATTRALI

SEQ ID NO: 21420 - DNA, 2481 bp, Sorghum bicolor
  misc_feature: Ceres ANNOT ID no. 8716397
  misc_feature: Up-regulated in shoot tissues in response to salicylic acid treatment
  misc_feature: Encodes the peptide sequence at SEQ ID NO 21421
atgtgggcgcggaccagcaaaacgcccgtcctcatttggctccatcgtgtcgtgtactacatgtcaactgttgtactttcgacatttgaagactctggccctggtggagactggagaaggatgctgatgaacttcagggactggatctcgtaccgcctcgggtcctcgctgctgtccgccaggccgttcgcgctctcccccggcgccgatgacgccgtcgcctccgagggcgatgctcatggtacaacacacaatgactatgtagatactgttactgccagtccattttcttctaatgatacacgggtgtcagatgtcacaaccaactctaatggtggtgcaatttattctggtactgttcaacaagatgatgataacaagaagtcagatccattgatgaaagtcgaggcacttcaaatcaagtttctacggttagtatacagaactggagtgtctcccagtgctgatgtagttgcacaggttctgtacaggttgcagcttgcaaacttgattaaagctggtgaatcagttgccaggagaccaaaccttgctatcaacaaagccagggttatagctgcacagcaagaagcaccgggtgggcctgatctggacgtctcgttgcgaatccttcttctgggaaagactggtgtgggaaagagtgccatgataaattcaattttcgatgagaggaaggtggctaccgatgctctggttcctgctactcataggataaagaagattgaaggaacaattaaaggaataagagtcacagttatcgacacacctggcctgatgcctcattaccatggcgaaaggaggaacaggaagattctgagttctgtcaagcgcttcattaagcgatccccacctgatattgtgttatactttgagcggttggaccatattaacagcagatacaatgattacccactgctgaagcttatgactgacatattgggctcttcgatgtggttcgacactgtccttgtaatgactcactgttcctcatctcctcctgaaggaccagatggttaccctttggaatatgacaattacacacgttactgcaagaatgtggttcagcgtcatatccaggctgcagtttccaacatgcagttggataatccttttgtgctcacagacaatcatccaatgtgcagacgaaacacgaagggtgaaagggttttaccaaatgggcaggtatgggtatcagaactgctgctgctgtgtggggcaaccaagttgctgacagaagcaaattccttgcttaagtttcaagatagcttcctactgtcacaagcaaacaccaggctgccttcgctgcctcatcttctttcttcactccttaagcctcattcttcatcaagttcagatgccattgacagtgaattcacagaaatgtcagatgaggaggatgaatatgatcaactaccacccttccgcattctaaagaaatctgaatatgaaaatttgacaaatgaacagaagtctgcatatcttgatgaactggactaccgtgagactttgtacctaaagaaacagtggaaggagggaatcagaaaacaaaagcttactgaagctcagaatgacgaagttggtgatgattatgaagagagtgcatccccagaggttgtgcacatgtcagatatggacattccactatgttttgactctgattatcctgtgcatcgttaccgtcacattataactgatgatcagttgtttagaccagttttggatccccaaggatgggaccatgatattgggttcgatgccatcaattttgaagcatctaaagagttgaaaaagaatgtctctggagcaattacaggacagatgagaaaggacaaggaagacatgtatattcattcagaatgttcagtaagttataatgctcacagaggctgctccttgatggggggtatggatatgcaaatggcaagcagagatttggtttgtaccgtgcacggggatgcccagttccgcaatctgccttggaacactactggaggtggcatttctgtgactaagtttggcaacaagtactttgctggtgccaagttagaagactctgttaccattgggaaacgagttaaactggtagccaatgccggtagaatggctggctgtggacaagtggcacatggaggtggtgtgcagataacagcaagggggaaagattaccctgtgagggaagagagtgtcactgcagcggtctccgctttgtcgtttgaaaaggaaactgtaattggggccaaccttcagtcagacttccgagtgggccgaggatcaaaaatatcagtcagcgctaacttaaatagtaggaatttaggcaagctcagtgtcaggactagcacgtcagaccacgctgagatagctctgatagcagttgtgtcattgatccagttcattcttaggagaagatcggcagcagctgataaaggtgagcaagagattgatgacacctatttggatgactaa

SEQ ID NO: 21421 - protein, 826 aa, Sorghum bicolor
  misc_feature: Ceres ANNOT ID no. 8716397
  misc_feature: Up-regulated in shoot tissues in response to salicylic acid treatment
  misc_feature (207)..(400): Pfam ID: AIG1 Pfam Description: AIG1 family
MWARTSKTPVLIWLHRVVYYMSTVVLSTFEDSGPGGDWRRMLMNFRDWISYRLGSSLLSARPFALSPGADDAVASEGDAHGTTHNDYVDTVTASPFSSNDTRVSDVTTNSNGGAIYSGTVQQDDDNKKSDPLMKVEALQIKFLRLVYRTGVSPSADVVAQVLYRLQLANLIKAGESVARRPNLAINKARVIAAQQEAPGGPDLDVSLRILLLGKTGVGKSAMINSIFDERKVATDALVPATHRIKKIEGTIKGIRVTVIDTPGLMPHYHGERRNRKILSSVKRFIKRSPPDIVLYFERLDHINSRYNDYPLLKLMTDILGSSMWFDTVLVMTHCSSSPPEGPDGYPLEYDNYTRYCKNVVQRHIQAAVSNMQLDNPFVLTDNHPMCRRNTKGERVLPNGQVWVSELLLLCGATKLLTEANSLLKFQDSFLLSQANTRLPSLPHLLSSLLKPHSSSSSDAIDSEFTEMSDEEDEYDQLPPFRILKKSEYENLTNEQKSAYLDELDYRETLYLKKQWKEGIRKQKLTEAQNDEVGDDYEESASPEVVHMSDMDIPLCFDSDYPVHRYRHIITDDQLFRPVLDPQGWDHDIGFDAINFEASKELKKNVSGAITGQMRKDKEDMYIHSECSVSYNAHRGCSLMGGMDMQMASRDLVCTVHGDAQFRNLPWNTTGGGISVTKFGNKYFAGAKLEDSVTIGKRVKLVANAGRMAGCGQVAHGGGVQITARGKDYPVREESVTAAVSALSFEKETVIGANLQSDFRVGRGSKISVSANLNSRNLGKLSVRTSTSDHAEIALIAVVSLIQFILRRRSAAADKGEQEIDDTYLDD

SEQ ID NO: 21422 - DNA, 912 bp, Sorghum bicolor
  misc_feature: Ceres ANNOT ID no. 8716501
  misc_feature: Down-regulated in root tissues in response to methyl jasmonate treatment
  misc_feature: Down-regulated in root tissues in response to salicylic acid treatment
  misc_feature: Down-regulated in shoot tissues in response to salicylic acid treatment
  misc_feature: Encodes the peptide sequence at SEQ ID NO 21423
atgtccagccccatgcacgtccgcaaggccatccacttcgcctcgctgcgcgccaagctcgcgcagcagggcaaggccggcctcgcgctacgcctgctcctcgccgccgcgctcgcgggcttcctcctcgtcttcgccgcgcgcaccctgctggtgtcctcccctgccgccgcgacctcgtccttggcggagtgcgccgccaaggggaccgcggcggcgacggcggggctgccgctggcggtgatggaggcgctggtgcactacacgacgtccaacgtgacgccgcagcagaccgccgacgagatcggggtctcgctgcgcgtgctgcagcgccgggcgccctgcaacttcctcgtcttcgggctcggccacgacagcccgatgtgggcggcgctcaaccacggcgggcggacggtgttcctggaggaggacgcgtcgtggatcgccagcgtccgcgccacgcacccgtccctcgagtcctaccacgtggcctacgacacggtgctcaccgacgccgacgcgctcctccagctccgcgaccacccggcctgcgtcgcgcagccggacctcgcgtccgccgccgacgcctcctgccgcctcgcgctgagggggctgccgccggtgttccacgagctggagtgggacctcatcatggtggacgcgcccacggggtggacgccggaggcgcccggacggatgggcgccatctacactgccggcatggcggcgcgcgcgcgcaggcccggggatggacccaccgacgtgttcgtgcacgacgtcgaccgccccgtcgaggacgccttctccaaggccttcctgtgtgaggggtacctcgccgagcaggtcggccggatcaggcacttcgtcatcccgtcacaccgcgagaaggacggcacgccattctgcccttga

SEQ ID NO: 21423 - protein, 303 aa, Sorghum bicolor
  misc_feature: Ceres ANNOT ID no. 8716501
  misc_feature: Down-regulated in root tissues in response to methyl jasmonate treatment
  misc_feature: Down-regulated in root tissues in response to salicylic acid treatment
  misc_feature: Down-regulated in shoot tissues in response to salicylic acid treatment
MSSPMHVRKAIHFASLRAKLAQQGKAGLALRLLLAAALAGFLLVFAARTLLVSSPAAATSSLAECAAKGTAAATAGLPLAVMEALVHYTTSNVTPQQTADEIGVSLRVLQRRAPCNFLVFGLGHDSPMWAALNHGGRTVFLEEDASWIASVRATHPSLESYHVAYDTVLTDADALLQLRDHPACVAQPDLASAADASCRLALRGLPPVFHELEWDLIMVDAPTGWTPEAPGRMGAIYTAGMAARARRPGDGPTDVFVHDVDRPVEDAFSKAFLCEGYLAEQVGRIRHFVIPSHREKDGTPFCP

SEQ ID NO: 21424 - DNA, 1851 bp, Sorghum bicolor
  misc_feature: Ceres ANNOT ID no. 8717252
  misc_feature: Down-regulated in root tissues in response to salicylic acid treatment
  misc_feature: Encodes the peptide sequence at SEQ ID NO 21425
atggaggagctctccaagaaggctccggcaccaagcttgctttcgctgtgcctggacgcggtcgctgctcgtctcatcagcgacaacgcccgcgcaggcggaggcgtgggccgaactggttggccaggagggtgcggcggcggcgatggtctcggcgggttctcggaagatgacggaggggaggcagacgaggaccgcctgcacccggaggaggtggcggaggggcttccctgggagcttctccatcggctggcgtcccggctcccgcctgttgcactcgagtccctccatcacgctgcccatgcccggtgctgttcttctgctaaaactacttctggacttggattgcaagatggagacagacgtggcatgaaacgttcaaggtgtgaagacttcagcaccacttggcaattgttgttcaaacttcgctggccccttgataacgctgggcataataacttgggcactgtggactggcagcaaaagtattgggaaaagcatttacaagagtgcttggatgaagctgcagagagtgcctttcttccttctttttgtgggaatattggtgagctgagtatatcagttcttcagtatcaatgttgccccttatttttcaggtgcttgagactgcaaggtgttctttgcaatgcagaaacttctgacttgttgcaacaatgcaagctggaaagattaatgttcataagaattatatcagatccagaggttaatggtgcatgtttgcttctgagctggcatgcagagacactgctttctcttgaattcatccattgtcagctttatcctaccatcatggataaaatttgcaggagtttgtgccaggagggatctagccatggaatccaacgatttagcattaaatcgtcacaaatctgtgaaaccaagcctctgaccatctcttctggtctgttaaattttttgtcatctggcaagtcgttgcatctgctgtcacttaatgatactaagatgcagtcatcattagctcagatgattattcacactcttcttgagtcgtcatgtgatttacacacgcttgagatatcagaaaacaatattgctggctggctttcaaaactgaacaaaagttctacaaactcattagcgctgagatcagatatttttatgaactccctgtccattcttaacctgagggaaaataatttgcaaaaggatgatgttgtagatcttcacaaaattctaataaaaatgcctaatttaagagatttagatataagtggcaatccaatcatggatgaaggtatcagatcaatgatccctttcatttcatggtctattcaaaaggaaaatccacttttgagattaacagtcgagaactgtgagttgtccagtattggtgtgattatgcttctggagtgcctcacaactgtgaagcaaccccttgatgtgctatctattgcagacaatcatttagggagttctgtggcagctgcattggccaaattcttgggttcacatgtaagggctttaaatgctacggatattggcttgggaacattaggcttccaaatacttgaggaagcattgccaacggaagtggctctttcccacatcaacatcagattaatagggcgagcaccaaatcttgtctcagtcaatgcagcagcgaaccttttaccacctgaatcattggaagtcatctgtaactccttgaagcaagggacttgttatttggagcgagttgacctgactggcaacatgcatttatcaagcaatatttttcctgcattccttgaattcaagaagcatggaaagccaattctagtagtcccaccaaacttgagcacttgtgctccatatgatgatgacccatga

SEQ ID NO: 21425 - protein, 616 aa, Sorghum bicolor
  misc_feature: Ceres ANNOT ID no. 8717252
  misc_feature: Down-regulated in root tissues in response to salicylic acid treatment
MEELSKKAPAPSLLSLCLDAVAARLISDNARAGGGVGRTGWPGGCGGGDGLGGFSEDDGGEADEDRLHPEEVAEGLPWELLHRLASRLPPVALESLHHAAHARCCSSAKTTSGLGLQDGDRRGMKRSRCEDFSTTWQLLFKLRWPLDNAGHNNLGTVDWQQKYWEKHLQECLDEAAESAFLPSFCGNIGELSISVLQYQCCPLFFRCLRLQGVLCNAETSDLLQQCKLERLMFIRIISDPEVNGACLLLSWHAETLLSLEFIHCQLYPTIMDKICRSLCQEGSSHGIQRFSIKSSQICETKPLTISSGLLNFLSSGKSLHLLSLNDTKMQSSLAQMIIHTLLESSCDLHTLEISENNIAGWLSKLNKSSTNSLALRSDIFMNSLSILNLRENNLQKDDVVDLHKILIKMPNLRDLDISGNPIMDEGIRSMIPFISWSIQKENPLLRLTVENCELSSIGVIMLLECLTTVKQPLDVLSIADNHLGSSVAAALAKFLGSHVRALNATDIGLGTLGFQILEEALPTEVALSHINIRLIGRAPNLVSVNAAANLLPPESLEVICNSLKQGTCYLERVDLTGNMHLSSNIFPAFLEFKKHGKPILVVPPNLSTCAPYDDDP

SEQ ID NO: 21426 - DNA, 1008 bp, Sorghum bicolor
  misc_feature: Ceres ANNOT ID no. 8718093
  misc_feature: Up-regulated in root tissues in response to methyl jasmonate treatment
  misc_feature: Encodes the peptide sequence at SEQ ID NO 21427
atggctgcctccacagcatcatcatggtctgccgccggcggcctaagtgccacctcctgtgtgtctccgccaccgcagcgccgccatggcagcagcttgaagccgccgcagcgctctggacagccggcggcgacgaccctatccgcatcagggaaccaaccgaacctatcgtacttagactgtaggacaaggactaggaggagaggcgaccgaatcagagctgccgatgccgtgaccatggatggctgggcagcacggcttgaagccccggtagcggttgtcactggagcgtctagagggattggcagagccatagctgtggcacttggcaaagcagggtgcaaggtgattgtgaactatgccaagtcaggcatggaagctgaagaagtgtgcagagagatcgaggagtccggtgggacggcgatcagcttcgctgccgacgtctcttgcgaggccgacgtcgaatccatgatgagggccgcaattgatgcttggggagctctggatgtcctggtgaacaatgcagggattacacgtgacgcgctgctgatgcggatgaagaagacccagtggcaagaggtggttgatgtcaacctcaccggcgtttacttctgcgcccaggctgcagccaccgtgatgatgaagaggaagaagggaaggatcatcaacatcgcatcagtttccggtatcatcggcaacgtcgggcaggccaactactgcgccgccaaggctggggttattggcctcaccaaggccatggccagggagtacggaggcagaaacatcaatgtgaacgccgtagcaccgggctgggtggcgtccgacatgaccaataaactaggggacgatgtggaaaggaaggcgctcgagaccataccattaggacggtttgggaggccagaagaggttgccgggctggtggggttcctggctgttcatcctgccgctagttacatcaccggacaggcgagtagaaacggcttccagtttcagaataatgcaacgtga

SEQ ID NO: 21427 - protein, 335 aa, Sorghum bicolor
  misc_feature: Ceres ANNOT ID no. 8718093
  misc_feature: Up-regulated in root tissues in response to methyl jasmonate treatment
  misc_feature (82)..(322): SWISSPROT Homolog: EC 1.1.1.100 3-oxoacyl-[acyl-carrier-protein] reductase
  misc_feature (90)..(258): Pfam ID: adh_short Pfam Description: short chain dehydrogenase
MAASTASSWSAAGGLSATSCVSPPPQRRHGSSLKPPQRSGQPAATTLSASGNQPNLSYLDCRTRTRRRGDRIRAADAVTMDGWAARLEAPVAVVTGASRGIGRAIAVALGKAGCKVIVNYAKSGMEAEEVCREIEESGGTAISFAADVSCEADVESMMRAAIDAWGALDVLVNNAGITRDALLMRMKKTQWQEVVDVNLTGVYFCAQAAATVMMKRKKGRIINIASVSGIIGNVGQANYCAAKAGVIGLTKAMAREYGGRNINVNAVAPGWVASDMTNKLGDDVERKALETIPLGRFGRPEEVAGLVGFLAVHPAASYITGQASRNGFQFQNNAT

SEQ ID NO: 21428 - DNA, 1008 bp, Sorghum bicolor; identical to SEQ ID NO: 21426
  misc_feature: Ceres ANNOT ID no. 8718096
  misc_feature: Up-regulated in root tissues in response to methyl jasmonate treatment
  misc_feature: Encodes the peptide sequence at SEQ ID NO 21429

SEQ ID NO: 21429 - protein, 335 aa, Sorghum bicolor; identical to SEQ ID NO: 21427
  misc_feature: Ceres ANNOT ID no. 8718096
  misc_feature: Up-regulated in root tissues in response to methyl jasmonate treatment
  misc_feature (82)..(322): SWISSPROT Homolog: EC 1.1.1.100 3-oxoacyl-[acyl-carrier-protein] reductase
  misc_feature (90)..(258): Pfam ID: adh_short Pfam Description: short chain dehydrogenase

SEQ ID NO: 21430 - DNA, 1005 bp, Sorghum bicolor
  misc_feature: Ceres ANNOT ID no. 8718107
  misc_feature: Down-regulated in shoot tissues in response to methyl jasmonate treatment
  misc_feature: Down-regulated in root tissues in response to methyl jasmonate treatment
  misc_feature: Down-regulated in shoot tissues in response to salicylic acid treatment
  misc_feature: Down-regulated in root tissues in response to salicylic acid treatment
  misc_feature: Encodes the peptide sequence at SEQ ID NO 21431
atggagaggaagggagggtgctgcctcgcgccgaggtacggcgccgccgggcctgcggccgcgcagcagcaggcaggcgcggcgtggcagatgggcaggatcatgctcaagttccgcccgattgcacctaagccggcggccatggcgcccgtgccggcaccgacgccggtggtggctgggccgtccgttggtgcggccgggagagggaagcgaaaagccgtgtgcggtgcaggcggcgggaggagggggcggaagcccaagaaggcggctgcggtggtgactgcagcgcctgcgcttgcagcggcggcggcgcaggatgcgggcgactgcaagaaggactgcgagaaggagaagtcgtcgtcgtcgcggtcctcgtcctcgtcggggatgacgtccgtggactcgtcgccgccgccgccgcagcaccacctcccgacgctgctgccgctcatgcccgtgacggcggtggaggataagggccccgctgctggtgctgcgacagaggagcttccggcgcctgtgccgtctcaggtggccgcggcagccacggggtcggcacggccgtttgctccgcgggcgttgcgcccaggctccgcggcttgggcggcttcgttggtgacggtggaggaggtgaccgcgacgtggcgcgacggcgaggcgccgccgtcctccgcggcgtgcgtcgccgacgacgccccggcgttcgtgtcggaccagtggggccgcgtcacgtggaggaacgccgcgttcgtccgggctgtacccgcggacgacggcggcgacgaggtggagacgcagacgcccgtggcgctcagcggcgcgctcccggcgtggggcacctgctcgggattcacgtgccgcgtccgctggcactcgagcccccggcgcgtgggttccacttcctccgtggtggcgccctgcgatgtgtggcggctggacgccggcggcagctacctttggcggctggacctgcaggccgctctcactctcggcggccgcctgtga

SEQ ID NO: 21431 - protein, 334 aa, Sorghum bicolor
  misc_feature: Ceres ANNOT ID no. 8718107
  misc_feature: Down-regulated in shoot tissues in response to methyl jasmonate treatment
  misc_feature: Down-regulated in root tissues in response to methyl jasmonate treatment
  misc_feature: Down-regulated in shoot tissues in response to salicylic acid treatment
  misc_feature: Down-regulated in root tissues in response to salicylic acid treatment
MERKGGCCLAPRYGAAGPAAAQQQAGAAWQMGRIMLKFRPIAPKPAAMAPVPAPTPVVAGPSVGAAGRGKRKAVCGAGGGRRGRKPKKAAAVVTAAPALAAAAAQDAGDCKKDCEKEKSSSSRSSSSSGMTSVDSSPPPPQHHLPTLLPLMPVTAVEDKGPAAGAATEELPAPVPSQVAAAATGSARPFAPRALRPGSAAWAASLVTVEEVTATWRDGEAPPSSAACVADDAPAFVSDQWGRVTWRNAAFVRAVPADDGGDEVETQTPVALSGALPAWGTCSGFTCRVRWHSSPRRVGSTSSVVAPCDVWRLDAGGSYLWRLDLQAALTLGGRL

SEQ ID NO: 21432 - DNA, 2109 bp, Sorghum bicolor
  misc_feature: Ceres ANNOT ID no. 8718252
  misc_feature: Down-regulated in shoot tissues in response to salicylic acid treatment
  misc_feature: Encodes the peptide sequence at SEQ ID NO 21433
atggcctccttcacctgctcccaggtcggcgcgacggcagcgggcggagcttcgcccttcctcggctaccggcggcggagcggagccaccccgtcgagctccctcttcgtgggccggcggctggcggcgtcagtgcggatgcgcgcgccctctcgcggggccgcccgcgggggctccgcgctgcgggtcacgtgcgagaaggtggtggggatcgacctgggcaccaccaactccgcggtcgccgccatggagggcggcaagccgaccgtcgtcaccaacgccgagggcgcgcgcaccacaccctccgtagtcgcctacaccaagaccggggagcgcctcgtggggcagatcgctaagcgccaggcggtcgtcaaccccgagaacaccttcttctccgtcaagcgcttcatcggccgtaagatgtctgaggtcgacgacgaggccaagcaggtctcgtacggcgttgtcaaggacgagaacggcaacgtcaagctcgactgccccgctatcggcaaacagttcgctgccgaggagatctccgcgcaggttttgaggaagttggtggatgatgcatctaagtttcttaatgagaaaattacaaaagcagtggttacagtcccagcgtacttcaatgattcacaaaggacagcaactaaagatgctggtcgcattgcaggactggaagttctccgtattataaatgaaccaactgctgcatcattagcctatggtttcgagaagaaaaataatgaaacaattctagtgtttgatttgggaggcggtacctttgatgtatctgtattggaagttggagatggtgtgtttgaggtgctttccacatcaggtgacacacaccttggtggtgatgactttgataagagaatagtagattggcttgctagcaacttcaagaaagatgaaggtatcgatcttctgaaggataaacaagcccttcagaggcttactgaggcagcagagaaagctaagatggaactgtcaacgctgacacaggcaaatattagcctgccattcattactgcaaccgctgatgggccaaaacacattgaggcaaccctctcgagagccaaattcgaggaactatgttcagaccttatcgacaggcttaaaactcctgttaataatgccttgagagatgccaagttgtctgtcagtgatctagatgaagttattcttgtgggtggatccacccgaatccctgcggttcaagaacttgtgaggaagcttactgacaaggatcccaatgttacggtcaaccctgatgaggttgtttctcttggggcagctgtgcagggtggtgttttggcgggagatgtgaaagatgtcgttcttctggatgttactccattgtctcttggtttggagacattgggtggagtgatgacaaagattatccccaggaataccacattgcccacatcaaaatcggaggtattctcaacagctgcagatggacagacgagcgttgagattaatgttctccagggagaaagagagtttgttagggacaacaagtcccttggaagcttccggttggatgggatccctcctgcacctcgtggtgtcccacaaattgaagtgaagtttgatattgatgcaaatggtatcctctcagttgctgccattgataagggcactggaaagaaacaggacatcaccatcactggtgctagtacgctacctaaggatgaggttgagagaatggtagaagaagccgataagtttgccaaggaggacaaagagaagagagatgcaattgacaccaaaaaccaggcggactctgtggtctaccagactgagaagcaactcaaggagcttggcgacaaagtccccgctcccgtgaaagagaaggtggacgtgaaactccaggagctcaaagacgccatttctggtggatcaacacagagtatgaaggatgccatggctgctttgaaccaggaggtgatgcagattggccaggcaatgtataaccagcctggtgccagtgctgctgggcctactcctggcgctgaggctggacctacgcctggtactggaccagcgcagaatgatggggatgttattgacgcggacttcacagatagcaattga

SEQ ID NO: 21433 - protein, 702 aa, Sorghum bicolor
  misc_feature: Ceres ANNOT ID no. 8718252
  misc_feature: Down-regulated in shoot tissues in response to salicylic acid treatment
  misc_feature (68)..(663): Pfam ID: HSP70 Pfam Description: Hsp70 protein
MASFTCSQVGATAAGGASPFLGYRRRSGATPSSSLFVGRRLAASVRMRAPSRGAARGGSALRVTCEKVVGIDLGTTNSAVAAMEGGKPTVVTNAEGARTTPSVVAYTKTGERLVGQIAKRQAVVNPENTFFSVKRFIGRKMSEVDDEAKQVSYGVVKDENGNVKLDCPAIGKQFAAEEISAQVLRKLVDDASKFLNEKITKAVVTVPAYFNDSQRTATKDAGRIAGLEVLRIINEPTAASLAYGFEKKNNETILVFDLGGGTFDVSVLEVGDGVFEVLSTSGDTHLGGDDFDKRIVDWLASNFKKDEGIDLLKDKQALQRLTEAAEKAKMELSTLTQANISLPFITATADGPKHIEATLSRAKFEELCSDLIDRLKTPVNNALRDAKLSVSDLDEVILVGGSTRIPAVQELVRKLTDKDPNVTVNPDEVVSLGAAVQGGVLAGDVKDVVLLDVTPLSLGLETLGGVMTKIIPRNTTLPTSKSEVFSTAADGQTSVEINVLQGEREFVRDNKSLGSFRLDGIPPAPRGVPQIEVKFDIDANGILSVAAIDKGTGKKQDITITGASTLPKDEVERMVEEADKFAKEDKEKRDAIDTKNQADSVVYQTEKQLKELGDKVPAPVKEKVDVKLQELKDAISGGSTQSMKDAMAALNQEVMQIGQAMYNQPGASAAGPTPGAEAGPTPGTGPAQNDGDVIDADFTDSN

SEQ ID NO: 21434 - DNA, 1011 bp, Sorghum bicolor
  misc_feature: Ceres ANNOT ID no. 8718625
  misc_feature: Down-regulated in shoot tissues in response to aminocyclopropane carboxylic treatment
  misc_feature: Down-regulated in shoot tissues in response to methyl jasmonate treatment
  misc_feature: Down-regulated in shoot tissues in response to salicylic acid treatment
  misc_feature: Encodes the peptide sequence at SEQ ID NO 21435
atggcctggttcatgattccacgctgtctctgcggtatcattctgcggcgccttcctctgcagctgccagtgcagtccaggggcgtgagtgcaactgttgcttcatgtcgtgtttcactagtgatggcagaagttcaggatggccattatgattcaacatcacagtccactgacagcttgcgtgttgagcctatatatgagtcgttcctatgcccgcttaccaaacaggttatgcaggatcctgtctctattgacagtggtgttacgtttgaacgtgatgccattttgaagtatttcaatgagtgtcttagcagtgggaagaggcttgtctgccctgtaactaagatggagctcagcaacactgagttaaatccaagcatagctctgaggaacactattgatgaatggatgaatcgcaacgaggcagccaaacttgacgttgctcgtaagtcattgacttctgatagcatggaaagtgatatcctacaagcactccagtatgttgatgagatatgtcagagaagtagatccagtaggcaggttgtgagaagagatggattgataatcatgattgctgacttgttgaagaatagcagtacgaaagtacggcaatcagcactagagactcttagctccattgcaaaagatgacaatgacaataaggtcgagattgctgctggagacaatattcgcacaattgtaaagttcttaaatcatgggcagactcaggaaaaggaacaagctgtgtctctgttgtttgaactttcagaaaataaggctctttcagatagaattggcagtgtttctggagctattcttatacttgttggcttgtcaagcagtaaagtagaaaaccttctgattgttgacagagctgagaagacattggaaaatttagagagctgtgaaaagaatgttaggcagatggctgaaaatggtagattgcagccccttctgagactgcttcttgaagttagaattgtctccctgtttcaccaggcccccctttaa

SEQ ID NO: 21435 - protein, 336 aa, Sorghum bicolor
  misc_feature: Ceres ANNOT ID no. 8718625
  misc_feature: Down-regulated in shoot tissues in response to aminocyclopropane carboxylic treatment
  misc_feature: Down-regulated in shoot tissues in response to methyl jasmonate treatment
  misc_feature: Down-regulated in shoot tissues in response to salicylic acid treatment
  misc_feature (64)..(143): Pfam ID: U-box Pfam Description: U-box domain
MAWFMIPRCLCGIILRRLPLQLPVQSRGVSATVASCRVSLVMAEVQDGHYDSTSQSTDSLRVEPIYESFLCPLTKQVMQDPVSIDSGVTFERDAILKYFNECLSSGKRLVCPVTKMELSNTELNPSIALRNTIDEWMNRNEAAKLDVARKSLTSDSMESDILQALQYVDEICQRSRSSRQVVRRDGLIIMIADLLKNSSTKVRQSALETLSSIAKDDNDNKVEIAAGDNIRTIVKFLNHGQTQEKEQAVSLLFELSENKALSDRIGSVSGAILILVGLSSSKVENLLIVDRAEKTLENLESCEKNVRQMAENGRLQPLLRLLLEVRIVSLFHQAPL

SEQ ID NO: 21436 - DNA, 1566 bp, Sorghum bicolor
  misc_feature: Ceres ANNOT ID no. 8721106
  misc_feature: Down-regulated in root tissues in response to methyl jasmonate treatment
  misc_feature: Down-regulated in shoot tissues in response to methyl jasmonate treatment
  misc_feature: Down-regulated in shoot tissues in response to salicylic acid treatment
  misc_feature: Encodes the peptide sequence at SEQ ID NO 21437
atgtcccgccgtgcgccgttctccaacctggaccccgcgacggcggccgacacgcggcgccagcgctacgaccagcacgagcaggacgggtacatggagcatctcctgccgtacatccacagctgcgtccccgacccgcccgtctccaccaccgcccgcctcgtcgcccgccgcactggcccttccgacggcgtcgaccgcatcagcagcctctccgacacgctcctccgcgacatcgtctcccgcctccccttcaaggacgccgcgcgcaccgccgtgctcgccacgcgctggcgcgggctctggctcgccgcgccgctcgtcgtcgccgacgcgcacctcctgaaccactggcccccgacgcccgccgacgcggcgcccgtcaccgccgccgtgtcgcacgccctcgccacgcacccggggcccttccgctgcgtccacctcgtctccacccgcatggacgcgtaccagccccagctcaagcgctggctccgtctgctcgccgccaagggcgtccaggagctcgtcctcgtcaaccgcccgtgcccgcgggaggtgcccctccccgacacgctcttccggatcgccaccctcacccgcctctacatcggcgtctggaagttcccagacgcggcccacctccaaggcgcctcctttgccaacctacgcgaactcggcatcttcagcgtcgtcgtggaggacggggacatcgactctgtcgtcgccaggagccccgtactggagatcctcaacatccaagggaccattaaggggttgcgtctcgtcggcaacagccttcggtgcgtgcagatctgcgcttccgtggtggagaacattgccgtggtgcacaccccttgtctcgagcggctcatcctgtgggacgtacggggatctcccaaccctgccagtggcttgtgcaccaggatcaagattggaaaagcccccaagctgcgcattttgggatatctggagccaggaaaacacgtgctagagattggaggcaccaccatcatggctggcattaaaccaagcgcaagcacaatgctcaggacggtcaaggtcctgagcatcaaatcgtgttttggatccaatgacaccaagatgttgcctgacttcctgaaatgctttcccaacgttgaggctcttcactctgtcaaatgtaatgaacctggtgacaagctcaacaccaagttctggcaagaggctggtcccattgtaagtgtgcttatgcgcatcaaggtgatgacagtccgtgagttccgaggggagcaacatgagcttgccttcctccagtatttctacgagaatgcacgggtgttgaagtatgcatcagtcgtggcagccaatgcaagggtcactggaatatcagacaaacagatgttttccattctgcagaatatgaatgatgcaagatgggctagtaaatttggactggctatcatgggaagcaatggtcccgaaggaggtagaccctggatgtttgaacgaggatcaaatttttctgatgatgacccttttgcaccagttaaatttcttgaacatggccctgcctctgcgccaagatag

SEQ ID NO: 21437 - protein, 521 aa, Sorghum bicolor
  misc_feature: Ceres ANNOT ID no. 8721106
  misc_feature: Down-regulated in root tissues in response to methyl jasmonate treatment
  misc_feature: Down-regulated in shoot tissues in response to methyl jasmonate treatment
  misc_feature: Down-regulated in shoot tissues in response to salicylic acid treatment
  misc_feature (398)..(447): Pfam ID: FBD Pfam Description: FBD
  misc_feature (66)..(113): Pfam ID: F-box Pfam Description: F-box domain
MSRRAPFSNLDPATAADTRRQRYDQHEQDGYMEHLLPYIHSCVPDPPVSTTARLVARRTGPSDGVDRISSLSDTLLRDIVSRLPFKDAARTAVLATRWRGLWLAAPLVVADAHLLNHWPPTPADAAPVTAAVSHALATHPGPFRCVHLVSTRMDAYQPQLKRWLRLLAAKGVQELVLVNRPCPREVPLPDTLFRIATLTRLYIGVWKFPDAAHLQGASFANLRELGIFSVVVEDGDIDSVVARSPVLEILNIQGTIKGLRLVGNSLRCVQICASVVENIAVVHTPCLERLILWDVRGSPNPASGLCTRIKIGKAPKLRILGYLEPGKHVLEIGGTTIMAGIKPSASTMLRTVKVLSIKSCFGSNDTKMLPDFLKCFPNVEALHSVKCNEPGDKLNTKFWQEAGPIVSVLMRIKVMTVREFRGEQHELAFLQYFYENARVLKYASVVAANARVTGISDKQMFSILQNMNDARWASKFGLAIMGSNGPEGGRPWMFERGSNFSDDDPFAPVKFLEHGPASAPR

SEQ ID NO: 21438 - DNA, 840 bp, Sorghum bicolor
  misc_feature: Ceres ANNOT ID no. 8721298
  misc_feature: Down-regulated in root tissues in response to aminocyclopropane carboxylic treatment
  misc_feature: Down-regulated in shoot tissues in response to aminocyclopropane carboxylic treatment
  misc_feature: Encodes the peptide sequence at SEQ ID NO 21439
atggccgggagggagagggaccgggagatgctcctcccggtggtggccggcgagcatgtcgccggcgacgaggacgactcggagccgaccgctcccgtcatcatcgccgggccgccgccgcccacgacgtcagcgcgcgtgctccaccttcaccaccatcccaccggcatcgaggcgttttcgagagtgatacggagctgggcatggaagaagtttatgtctggatgtgtcatcctgctcccgatcgccatcaccttctacacgacatggtggttcatccgcttcgtcgacggcttcttctcgcccatctacgtccatctcgggatacatctcttcggcctcgggtttgtcacctccatcagcttcatcttcctcgtgggcgtgttcatgtcgtcgtggctgggcgcctccctcctcggcctcggcgagttctgcatcaagaggatgccgctggtgcgccacatctactcggcttccaagcagatcagcgccgcaatatcgccagaccagagctcaagagccttcaaggaggtggtgatcatccggcacccgaggatcggcgagtacgcgctgggcttcatcacgtccacggtggcgctgcgtggcgccggcgtccgcggcgaccagcaggaccttgcctgcgtctacgtgcccaccaacaacctctaccttggggacatcttcctcatgagccgcgccgacgtcattatcccggacctctccgtccgggaggccatcgagattgttctttcaggtggcatgtcggtaccaaagatcatatcggcggtggagggggccgttggcctcggcgaccacggcttagcaataaaggattcctag

SEQ ID NO: 21439 - protein, 279 aa, Sorghum bicolor
  misc_feature: Ceres ANNOT ID no. 8721298
  misc_feature: Down-regulated in root tissues in response to aminocyclopropane carboxylic treatment
  misc_feature: Down-regulated in shoot tissues in response to aminocyclopropane carboxylic treatment
MAGRERDREMLLPVVAGEHVAGDEDDSEPTAPVIIAGPPPPTTSARVLHLHHHPTGIEAFSRVIRSWAWKKFMSGCVILLPIAITFYTTWWFIRFVDGFFSPIYVHLGIHLFGLGFVTSISFIFLVGVFMSSWLGASLLGLGEFCIKRMPLVRHIYSASKQISAAISPDQSSRAFKEVVIIRHPRIGEYALGFITSTVALRGAGVRGDQQDLACVYVPTNNLYLGDIFLMSRADVIIPDLSVREAIEIVLSGGMSVPKIISAVEGAVGLGDHGLAIKDS

SEQ ID NO: 21440 - DNA, 1695 bp, Sorghum bicolor
  misc_feature: Ceres ANNOT ID no. 8721396
  misc_feature: Up-regulated in shoot tissues in response to salicylic acid treatment
  misc_feature: Encodes the peptide sequence at SEQ ID NO 21441
atggcgggtggttttggtaaggtgtatgagctagaagatttgcaaaatattacaaacaatttctctgaagagagactacttggtgaaggtggttttggtaaggtctataagggactgctaccgaatggggatataattgctgtgaagaagcttacatcgacaatgccaggaatcaaggacaggcaatttgacaatgaagcctggcatcttatgagacttagccacccaaatatagtgcaacttgtaggctactgttctcacacagaggaaatactagtactgcatcaggggaaatacgtttatgctgagaagtctgaaaggttgctttgcttggaataccagcctaagggaagccttcatgagcatctttcagacgaatcttctggacttgattgggactcacgctacaaaattattgagggtatttgcaatggtttgcattatcttcatgagaagtggcaagctagcacccctattattcacatggacctaaaacctaagaacatattgcttgatgacaatatggtgccaaaaattgctgactttggtttgtcgaggcttttcggtgaagagcaaactcgaacttgcactgcaagtcgtgatggaacattgggttacatggcgccagagtacttaaatagaggtataatcacaaaaaagttagacatattcagtttgggtgtaataatcatagagatagtgacagggcacaaggactacccagatgagactgacacatcatcccaggaatttattgagctggtgctcaagaattggagaaataggctggaaaaaacaccgggatatacaactgccttttctattttcccatctttttgccgagaaattgattaccaacgaataagaagatgcattcagattggtctagcctgtgtgaaacttaatcgggcgaaaaggccaacaacacttgaagttttgaacatgcttcacaaatcagaaggtgcagaatgcagcaatggaaaagaggattatactaatgaacgtccggaagaagtgaatgggcctctatacaacaaggctgaagacagattgaatggtacacaaaattttggttcttctaaaggaaagaagagagagagagatgagcgaggaattgatccagctaagttgcatcgagatagtctgcataacatctatgacagtgagcctggaagctttaagttggacgatatggagtctaaaatagcaaagataaagaaaggtggacttgcaaatgtagaagcagtggaggagctattacatcttatgaaacttgatcaaactgagcaaagaatagacctttctggtcgggttatacttgctgatgttattgcagccacagaaaaacctgatatccttcacgtatttatggaatcaaagggccttctggtgttggatagttggcttcaagaggctcacaaatggaggtctgacgatggtagcagtccaaaagaagcagataagcctattgggccaggggaattttttttggccatgcttcgtgcactcgctagattgcctatcaatttgagtgcattgcagaggtgtagcattgggaaaagtgttaatcgtctgcgcggacataaaaatgtggagattcagaagaagtccagattacttattgaggatgggaagcgacgtattgatgctgaaatgaagttagggcgtgtttggttgaggacaaaacaaaattaa

SEQ ID NO: 21441 - protein, 564 aa, Sorghum bicolor
  misc_feature: Ceres ANNOT ID no. 8721396
  misc_feature: Up-regulated in shoot tissues in response to salicylic acid treatment
  misc_feature (4)..(380): SWISSPROT Homolog: EC 2.7.11.1 Non-specific serine/threonine protein kinase
  misc_feature (21)..(316): Pfam ID: Pkinase Pfam Description: Protein kinase domain
  misc_feature (466)..(558): Pfam ID: TFIIS Pfam Description: Transcription elongation factor S-II protein N terminal
MAGGFGKVYELEDLQNITNNFSEERLLGEGGFGKVYKGLLPNGDIIAVKKLTSTMPGIKDRQFDNEAWHLMRLSHPNIVQLVGYCSHTEEILVLHQGKYVYAEKSERLLCLEYQPKGSLHEHLSDESSGLDWDSRYKIIEGICNGLHYLHEKWQASTPIIHMDLKPKNILLDDNMVPKIADFGLSRLFGEEQTRTCTASRDGTLGYMAPEYLNRGIITKKLDIFSLGVIIIEIVTGHKDYPDETDTSSQEFIELVLKNWRNRLEKTPGYTTAFSIFPSFCREIDYQRIRRCIQIGLACVKLNRAKRPTTLEVLNMLHKSEGAECSNGKEDYTNERPEEVNGPLYNKAEDRLNGTQNFGSSKGKKRERDERGIDPAKLHRDSLHNIYDSEPGSFKLDDMESKIAKIKKGGLANVEAVEELLHLMKLDQTEQRIDLSGRVILADVIAATEKPDILHVFMESKGLLVLDSWLQEAHKWRSDDGSSPKEADKPIGPGEFFLAMLRALARLPINLSALQRCSIGKSVNRLRGHKNVEIQKKSRLLIEDGKRRIDAEMKLGRVWLRTKQN

SEQ ID NO: 21442 - DNA, 1350 bp, Sorghum bicolor
  misc_feature: Ceres ANNOT ID no. 8722131
  misc_feature: Up-regulated in root tissues in response to methyl jasmonate treatment
  misc_feature: Up-regulated in shoot tissues in response to methyl jasmonate treatment
  misc_feature: Encodes the peptide sequence at SEQ ID NO 21443
atggaccacggtgtgtactactgtcttgtagctcttcttcctcttgcgtacttccttctcaagtcgttgtccaagaaagctccctgccatggacttgagctccctccaggcccatggcagctccccgtcgtcggcagcatccaccatctccgcggctccctcctgcaccgcgctctgcgggatctgtcgctccgccacggccctctcatgttcctcaagttcggcgagcttccggtcgtcgtagcgtccacgccggacgccgcgaaagaggtgatgaagacccacgacgccatcttctcgacgaggccgcagagcttcgccgccaagacggcgaccaaggacggccagggcatcgtcagggctccctacggcgaccactggcggcagctccgcaagatctgcaccatggcgctgctcaacgccaggcgcgtccaatccctgcggcctgcccgcgaggaggaggcgttccggttggtccaagccgtctcgtcgtcgtcctcatcgccgtccaccgccgccgcagcagcgccgctcgtggacctcggcaagctggtcgccatgtacgtggctgacgcgtcgttgcacgccatcttcggcaggcggttcaaggtgactgacagggacacgttgctgcgctacttggacgagggcgtccgtctcgccggcgggttcacggccagagacctgttcccgtcgtcgtggctggctcgcgctctgagccgccggcgggatcttatcggagcaggaatcgaaacagcaacaacaacaatgcagtgggcgatggctgagctgatgaggaatccaggtatgatggccaaggcacaagcagaggtcaggagagtgttcatgggccaaacaaaggtaaccgaagatcggctaggcgagctatcttatctgcaaatggtcatcaaggagaccctccgactgcatgtcccggggccattgctcgtgccaagggaatgccaggagcagtgccggatattgggctacgacgtgcccaagggagccatggtgctcgtgaacgcctgggccatcgctaggagcccagattgctgggaggagccggacgcgttccatcctgagaggtttctccgtgacacgagagatttcaggggcaacgactttgagttcatcccgtttggctccgggaggcggatctgccctgggatgacgttcgggttggcgaacatcgagctcggcctcgccagcttgctcttctactttgactggagcctcccggagggcgtggttcctggtgagatggacatgaccgagaccattgggatgactgctaagaggaaagcagacctcttgctgtctgccagtgcctgtgtcaatctgccgagttaa

SEQ ID NO: 21443 - protein, 449 aa, Sorghum bicolor
  misc_feature: Ceres ANNOT ID no. 8722131
  misc_feature: Up-regulated in root tissues in response to methyl jasmonate treatment
  misc_feature: Up-regulated in shoot tissues in response to methyl jasmonate treatment
  misc_feature (246)..(439): SWISSPROT Homolog: EC 1.14.13.68 4-hydroxyphenylacetaldehyde oxime monooxygenase
  misc_feature (35)..(439): Pfam ID: p450 Pfam Description: Cytochrome P450
MDHGVYYCLVALLPLAYFLLKSLSKKAPCHGLELPPGPWQLPVVGSIHHLRGSLLHRALRDLSLRHGPLMFLKFGELPVVVASTPDAAKEVMKTHDAIFSTRPQSFAAKTATKDGQGIVRAPYGDHWRQLRKICTMALLNARRVQSLRPAREEEAFRLVQAVSSSSSSPSTAAAAAPLVDLGKLVAMYVADASLHAIFGRRFKVTDRDTLLRYLDEGVRLAGGFTARDLFPSSWLARALSRRRDLIGAGIETATTTMQWAMAELMRNPGMMAKAQAEVRRVFMGQTKVTEDRLGELSYLQMVIKETLRLHVPGPLLVPRECQEQCRILGYDVPKGAMVLVNAWAIARSPDCWEEPDAFHPERFLRDTRDFRGNDFEFIPFGSGRRICPGMTFGLANIELGLASLLFYFDWSLPEGVVPGEMDMTETIGMTAKRKADLLLSASACVNLPS

SEQ ID NO: 21444 - DNA, 1350 bp, Sorghum bicolor; identical to SEQ ID NO: 21442
  misc_feature: Ceres ANNOT ID no. 8722132
  misc_feature: Up-regulated in root tissues in response to methyl jasmonate treatment
  misc_feature: Up-regulated in shoot tissues in response to methyl jasmonate treatment
  misc_feature: Encodes the peptide sequence at SEQ ID NO 21445

SEQ ID NO: 21445 - protein, 449 aa, Sorghum bicolor; identical to SEQ ID NO: 21443
  misc_feature: Ceres ANNOT ID no. 8722132
  misc_feature: Up-regulated in root tissues in response to methyl jasmonate treatment
  misc_feature: Up-regulated in shoot tissues in response to methyl jasmonate treatment
  misc_feature (246)..(439): SWISSPROT Homolog: EC 1.14.13.68 4-hydroxyphenylacetaldehyde oxime monooxygenase
  misc_feature (35)..(439): Pfam ID: p450 Pfam Description: Cytochrome P450

SEQ ID NO: 21446 - DNA, 1449 bp, Sorghum bicolor
  misc_feature: Ceres ANNOT ID no. 8722348
  misc_feature: Down-regulated in shoot tissues in response to methyl jasmonate treatment
  misc_feature: Down-regulated in shoot tissues in response to salicylic acid treatment
  misc_feature: Encodes the peptide sequence at SEQ ID NO 21447
atggcgcaccggccggacgccgcggcgccgctgctcgccaagcccgacgccgacgcgacgcctcctccgccgccgaagcgcaacaagtaccccttcttctgcgccgtgctcgcctccatgacctccgtgctcatgggctacaacgtggcggtgacgagcggcgcgcagatcttcatggcggaggacctcggggtgagcgacgcgcagatcgaggtgctctcgggggtcatcaacatctactccctcgtcggcgcgctgctggccggctggacctccgaccgcctcggccgccgcctcaccatcgtgctcgccaacgccttcttcctcgtcggcccgctcgccatggcgctcgcccgcggctacgccttgctcatggtcggccgcttcgtcgccggcgtcggcgtcggctacgcgctcgtcatcgcccccgtctacgccgccgagatcgcgccgccgtcttcccgcggcctcctcacctcacttcctgagatttttatcaacactggggtgatgctgagctacgtgtcgaacctcgccttctcggggctgccggtgcacctgtcgtggcgggtgatgttcgcggcgggcgtggtgcccaccgtgttcctggcggccggggtgctcaccatgccggagtcgccgcggtggctggccatgaagggccgcgtcgccgaggcgaaggccgtgctcgacaggacgtcggacacgcccgccgaggccgagcagcggctgctcgagatccaggacgtcgtgacgaacagcagcagcggcgtcggcggcggcggcgcgtggaaggaggtggcgacgaaggccggcgtccggcgcgtgctggccatggtgctgacgctgcagttcttccagcaggcgtcggggatcgactcggtggtgctgtacggcccgcgcgtgctggccatggccggcgtcacgtccaacaccttgctcctgagcctcaacgtcctgttcggcgtcgccaaggcaggctccatcctcgtcgccatggcgctggcggaccgcgtcgggcggcgcccgctgctgctggtcagcacgggcggcatgacggcggcgctgctcgtcctgggctccctgttcgcggcgttcgcgggggccaaggacgacgccgcggtggccgcggtgagcgtggcggccgtcgtggcgttcgtggtggcgttctccgtcgggctcggcccgctggcgtgggtgtacagctccgagatcctgccgctccggctgcgtgggcagggcgccgggctcggcaccgccatgaaccggatcatgagcggcgtcgtcaccatgaccttcatctcgctctaccagggcatcaccatggccggcgcgttctacctctacgccgccatcgccgccgcgtcgttcgtgttcgtctacgcctgcctgccggagaccagggggcggagcctcgaggacatggaggagctcttccacaccaagtga

SEQ ID NO: 21447 - protein, 482 aa, Sorghum bicolor
  misc_feature: Ceres ANNOT ID no. 8722348
  misc_feature: Down-regulated in shoot tissues in response to methyl jasmonate treatment
  misc_feature: Down-regulated in shoot tissues in response to salicylic acid treatment
  misc_feature (34)..(479): Pfam ID: Sugar_tr Pfam Description: Sugar (and other) transporter
MAHRPDAAAPLLAKPDADATPPPPPKRNKYPFFCAVLASMTSVLMGYNVAVTSGAQIFMAEDLGVSDAQIEVLSGVINIYSLVGALLAGWTSDRLGRRLTIVLANAFFLVGPLAMALARGYALLMVGRFVAGVGVGYALVIAPVYAAEIAPPSSRGLLTSLPEIFINTGVMLSYVSNLAFSGLPVHLSWRVMFAAGVVPTVFLAAGVLTMPESPRWLAMKGRVAEAKAVLDRTSDTPAEAEQRLLEIQDVVTNSSSGVGGGGAWKEVATKAGVRRVLAMVLTLQFFQQASGIDSVVLYGPRVLAMAGVTSNTLLLSLNVLFGVAKAGSILVAMALADRVGRRPLLLVSTGGMTAALLVLGSLFAAFAGAKDDAAVAAVSVAAVVAFVVAFSVGLGPLAWVYSSEILPLRLRGQGAGLGTAMNRIMSGVVTMTFISLYQGITMAGAFYLYAAIAAASFVFVYACLPETRGRSLEDMEELFHTK

SEQ ID NO: 21448 - DNA, 1413 bp, Sorghum bicolor
  misc_feature: Ceres ANNOT ID no. 8722421
  misc_feature: Up-regulated in shoot tissues in response to methyl jasmonate treatment
  misc_feature: Up-regulated in root tissues in response to methyl jasmonate treatment
  misc_feature: Up-regulated in shoot tissues in response to salicylic acid treatment
  misc_feature: Encodes the peptide sequence at SEQ ID NO 21449
atgggggacgatctccttctccgccggcgcgggggcgtcctgttcttggtcctctcggccgtgctcgtgctcctgggcggcggcgcggacgccggcgtgacgagctcgtaccggcggaagctggaggcgacggtggagatgccgctggacgccgacgtcttccgcgtccctcctggctacaatgcgccccagcaggtgcacatcacgctgggcgaccaggagggcacggcgatgacggtgtcgtgggtgacggcgagcgagctgggcaacagcaccgtcaagttcggggagaagccggacccggagaagatggagcgccgcgcggaggggacacacacgcgctacgactacttcaactacacctccgggttcatccaccactgcaccctcaagcacctcaagcacagcaccaagtactactacgccatggggttcggccacaccgtcaggaccttctccttcaccacgccgcccaagccgggacctgatgtccccttcaagttcggcctcatcggcgaccttggccagacgttcgactccaacatcacgctctcccactacgacgacaacggcggcgacgccgtcctctacgtcggcgacctctcgtacgcggacaaccacccgctgcacgacaacaaccggtgggacacgtggggccgcttcatggagcggaacgcggcgtaccagccgtggatctggacggcggggaaccacgagctggacttcgcgccggagctgggggagacgacgcccttcaagccctacacgcaccggtacccgacgccgtacctgtcctcggggagcacggagccgttctggtactcggtgaagctcgcctcggcgcacgtcgtggtgctctcctcctactccgcctacggcaagtacacgccgcagtggacgtggctgcaggcggagctccagcgggtcgacaggacgacgacgccgtggctcgtggtgctgatgcactcgccgtggtacaacagcaacaactaccactacatggaaggggagacgatgcgggtgcagttcgagaaatggctcgtggacgccagggccgacgtcgtgctcgccgggcacgtccactcgtacgagcgcagccaccgcgtgtccaacgtcgcctacgacatcgtcaacggggaggcgacgccggtgagggacgccggcgcgcccgtgtacgtgaccatcggcgacggcggcaacatcgagggcgtcgcggataacttcacgcggccgcagccgagctactcggcgttcagggaggcgagcttcgggcacgcgacgctggagatcaagaaccggacgcacgcctactactcgtggcaccggaaccacgacggcgccaaggtcgtcgccgatggcgtctggctcactaacaggtactggatgcctaccgccgacgacgacaccaactga

SEQ ID NO: 21449 - protein, 470 aa, Sorghum bicolor
  misc_feature: Ceres ANNOT ID no. 8722421
  misc_feature: Up-regulated in shoot tissues in response to methyl jasmonate treatment
  misc_feature: Up-regulated in root tissues in response to methyl jasmonate treatment
  misc_feature: Up-regulated in shoot tissues in response to salicylic acid treatment
  misc_feature (34)..(469): SWISSPROT Homolog: EC 3.1.3.2 Acid phosphatase
  misc_feature (166)..(363): Pfam ID: Metallophos Pfam Description: Calcineurin-like phosphoesterase
MGDDLLLRRRGGVLFLVLSAVLVLLGGGADAGVTSSYRRKLEATVEMPLDADVFRVPPGYNAPQQVHITLGDQEGTAMTVSWVTASELGNSTVKFGEKPDPEKMERRAEGTHTRYDYFNYTSGFIHHCTLKHLKHSTKYYYAMGFGHTVRTFSFTTPPKPGPDVPFKFGLIGDLGQTFDSNITLSHYDDNGGDAVLYVGDLSYADNHPLHDNNRWDTWGRFMERNAAYQPWIWTAGNHELDFAPELGETTPFKPYTHRYPTPYLSSGSTEPFWYSVKLASAHVVVLSSYSAYGKYTPQWTWLQAELQRVDRTTTPWLVVLMHSPWYNSNNYHYMEGETMRVQFEKWLVDARADVVLAGHVHSYERSHRVSNVAYDIVNGEATPVRDAGAPVYVTIGDGGNIEGVADNFTRPQPSYSAFREASFGHATLEIKNRTHAYYSWHRNHDGAKVVADGVWLTNRYWMPTADDDTN

SEQ ID NO: 21450 - DNA, 2403 bp, Sorghum bicolor
  misc_feature: Ceres ANNOT ID no. 8722876
  misc_feature: Up-regulated in shoot tissues in response to salicylic acid treatment
  misc_feature: Encodes the peptide sequence at SEQ ID NO 21451
atggttcttcaagtcaaatcaagagaaaagctcttcagcattcacaggaaacctctgccattagaaccttctttacttctacgtgaggctaataggcgcagggcttttctctctgttggaaatctatccgagctgtatgattcatctgatgcttcaggtttagatgcaaattcaaaacttcctcccaacagacctgcttctaacttaatgacaagaacaatgtcaggtccagcaacgtccgagacttcactgccagttgatcgtcccatgaggttgtcagaaattcatgttgcagctgagcatgcactgaaacaaacgatatcagatcctgattttatgacatcactttcatcactagaagaatttgagaaaagatatatggagcttactaaaggtgctgctgacaattaccaccgctcttggtggaaaagacatggagttgttcttgatggagagattgcagctctgttctttaagcatggaaattatgacctagctgtgaaatcctatgagaaagtttgtgctctctattctgcagagggctgggaagagctgttggcagatgttcttcctgatcttgcagaatgccagaagattcttaatgatgaagctggttatttgtcttcttgtgtaaagttactttctctggacagtggcttgttttcatctaaagagcggcaagctttccagtcagaagttgttcgacttgctcacagtgaaatgaaacatcttgtgccccttgatgtctcatcactaattacatttgctggaaatgctggtccaccactagaattatgtgatggagatcctggtacactatctgtagcagtttggagtggcttcccagatgacatcacactggagtctctcagtttaagattgtcagcttcttctagtgcagatgaaggtatcaaggcaattaaaagttcagattctcatgttctcgtaccaggtagaaatatcatctcttttaacattcctcctcaaaagcctggctcctatgtgttgggtgctctcactggacagattggcaaactgtcattcagatcgcatggattttctcaagatggtccagttgaaactgatgaatttatgagctttgagaagccaacaagacctgttttgaaggtgagaaaaccaagggctttagttgatattacacctgctgtgtcctctgcattgcttatgaatgagctccaatggattggattaattgttaagccaatagactattctttaaaaggtggcatattgcatatcgatgctggtgctgaactgaaaattgaggagtctcagatgattgaaatagaaatttacggaagtgatgtggagtgtgctaattctgccaacggctccattgaagctggaaaggttgaaaagatccctattgaaaatggaaagataaaacttccagattgggctagtgatgtgactactcttgtttggtttcctgttcgtgctattgatgatacaattgccagaggcgaatccccagtgtctcagaaacagagcgttgtagatgggatgagaatgattgctctcaagcttgagtttggagttttccataatcaagtgtttgaaaggaccattgcagtccattttactaacccattccatgtaagcacacgcgttgtggacaagtgcaatgatggagctctacttctacaggtgatattgtgttctgaagtgaaggccacactgcatgtaaaggatgtacggttagatcttcaatctggatttgagcacttgggcaaaggagatggacggccagctttgagtttattccctctggttattgctccttcttccaaagctggaattttattcatgatacggttaagtggtacaaaggatgcagatgaggcagaaaatgcagacagcatgctgaatatcacttatgggatatctggtgacagaacaactggagcacattctcctgtacctgtcaaatctggtgactctgaagagcttctgttcaagattgcacttagactgaagcgacctgtcctggatccatgtctagcagttggattccttccattttctactgactgcctgagggttgggcaattagttaatatgaggtggagggtcgaaaggctgaaaaccccggaggatgcatccatatctgtcgacgaactactttatcaggttgaggcaaacccgcagaactggatggttgctgggaggaaatgtggtcacgtatcgttgtcaaatgagcaaggttcaaggatggagatcatggtgacatgtgtgccgctggtgtctgggtacgtccacccaccgcagctgggcctgccggaggtgggcgaggcaaatattagctgcaacccagcagggcctcacctggtgtgcgtccttcctccagccctcagcacctcctactgtatacctgcggcatga

SEQ ID NO: 21451 - protein, 800 aa, Sorghum bicolor
  misc_feature: Ceres ANNOT ID no. 8722876
  misc_feature: Up-regulated in shoot tissues in response to salicylic acid treatment
MVLQVKSREKLFSIHRKPLPLEPSLLLREANRRRAFLSVGNLSELYDSSDASGLDANSKLPPNRPASNLMTRTMSGPATSETSLPVDRPMRLSEIHVAAEHALKQTISDPDFMTSLSSLEEFEKRYMELTKGAADNYHRSWWKRHGVVLDGEIAALFFKHGNYDLAVKSYEKVCALYSAEGWEELLADVLPDLAECQKILNDEAGYLSSCVKLLSLDSGLFSSKERQAFQSEVVRLAHSEMKHLVPLDVSSLITFAGNAGPPLELCDGDPGTLSVAVWSGFPDDITLESLSLRLSASSSADEGIKAIKSSDSHVLVPGRNIISFNIPPQKPGSYVLGALTGQIGKLSFRSHGFSQDGPVETDEFMSFEKPTRPVLKVRKPRALVDITPAVSSALLMNELQWIGLIVKPIDYSLKGGILHIDAGAELKIEESQMIEIEIYGSDVECANSANGSIEAGKVEKIPIENGKIKLPDWASDVTTLVWFPVRAIDDTIARGESPVSQKQSVVDGMRMIALKLEFGVFHNQVFERTIAVHFTNPFHVSTRVVDKCNDGALLLQVILCSEVKATLHVKDVRLDLQSGFEHLGKGDGRPALSLFPLVIAPSSKAGILFMIRLSGTKDADEAENADSMLNITYGISGDRTTGAHSPVPVKSGDSEELLFKIALRLKRPVLDPCLAVGFLPFSTDCLRVGQLVNMRWRVERLKTPEDASISVDELLYQVEANPQNWMVAGRKCGHVSLSNEQGSRMEIMVTCVPLVSGYVHPPQLGLPEVGEANISCNPAGPHLVCVLPPALSTSYCIPAA

SEQ ID NO: 21452 - DNA, 1683 bp, Sorghum bicolor
  misc_feature: Ceres ANNOT ID no. 8722923
  misc_feature: Up-regulated in shoot tissues in response to methyl jasmonate treatment
  misc_feature: Encodes the peptide sequence at SEQ ID NO 21453
atgtcttcgccggcgccggcggaagaggacggccgtgcgccgaccaagtacgtgctgatcacgggcggcgtcgtcagcggcctcggcaagggcgtcaccgccagcagcatcggcgtcgtcctcaaggcctgtgggctccgcgtcacctgcatcaagatcgatccatacttgaacacagatgctggtacaatgtccccctttgagcatggtgaggtgtttgttcttgatgatggtggagaggttgatttggatttggggaattatgagcgtttcatagatgtaactctgacgagggataacaacattaccactggaaagatataccagtctgtcattgagaaggagagaaggggtgattatcttggaaagactgtacaggttgttcctcatgtcactgatgaaataaaacagtggatacagtccgtgtcttcagttcctgtggatgggcagactcgtccagctgatgtttgtgttattgaattgggaggcactgtaggcaaggagaatttctgcctcatacacgttagccttgttccagtattgggtgtagttggtgagcagaaaactaaaccaacacaacacagtgtacgagaactgagagcgttgggtctgactcctgatcttctagcatgccggtcagcacagccactaataggatctgttaaggagaagctgtcacaattttgccatgtcccggttgagaacatactcaacatccatgatgttccaaatttatggcatgtcccacttattcttagaaaccaaaaggctcatgaagctataatcaaacaactgaaccttgctaggtccgctggaccacctgagttacgagattggacagatatggctgagtcgtatgataacctcaagaactctgttaaagttgctttggttgggaagtatactaatctgacagattcttacctatcagtggtgaaggctctcctacatgccagtgttgcctgttcgttaaagccatctatccagtggattgcagcttcggatcttgaagatgcaactgcaatatctgcaccagatgcccatgctgaagcctgggaaactcttaaaggttcatcatgcattttgatacctggaggattcggggatcgtggaatctcagggatgatattggctgcaaaatatgctcgtgagaataaagttccatatcttggtatttgcttgggcatgcagatatcagtgattgagatgtccagacatgtcctgggcctgggagatgcagacagtgaagagtttaacaaggatacaccaaatcatattgttatgtacatgcctgaggtttcaaaaacacatatgggaaacacaatgaggttgggctgcaggagaacattcttcaggaaacctgattgccttacatcaaaactgtatggaagtcctccacatgtagatgagcgtcatcgtcatagatacgaggtcaatccctcttttgttcccatgcttgaaagtgctggtcttcattttgttggttgtgacgaaagtcgaaagcggatggagattgtggagctacaagatcatccattctatgtaggtgttcagttccatccagagttcaaatcaaggccccgaagaccttcacctccttttacaggtctaataatggcagccactaaacaactgggaacaatttcgaatagctcgaatggctatgttggagcttctggctaa

SEQ ID NO: 21453 - protein, 560 aa, Sorghum bicolor
  misc_feature: Ceres ANNOT ID no. 8722923
  misc_feature: Up-regulated in shoot tissues in response to methyl jasmonate treatment
  misc_feature (165)..(541): SWISSPROT Homolog: EC 6.3.4.2 CTP synthase
  misc_feature (15)..(279): Pfam ID: CTP_synth_N Pfam Description: CTP synthase N-terminus
  misc_feature (303)..(540): Pfam ID: GATase Pfam Description: Glutamine amidotransferase class-I
MSSPAPAEEDGRAPTKYVLITGGVVSGLGKGVTASSIGVVLKACGLRVTCIKIDPYLNTDAGTMSPFEHGEVFVLDDGGEVDLDLGNYERFIDVTLTRDNNITTGKIYQSVIEKERRGDYLGKTVQVVPHVTDEIKQWIQSVSSVPVDGQTRPADVCVIELGGTVGKENFCLIHVSLVPVLGVVGEQKTKPTQHSVRELRALGLTPDLLACRSAQPLIGSVKEKLSQFCHVPVENILNIHDVPNLWHVPLILRNQKAHEAIIKQLNLARSAGPPELRDWTDMAESYDNLKNSVKVALVGKYTNLTDSYLSVVKALLHASVACSLKPSIQWIAASDLEDATAISAPDAHAEAWETLKGSSCILIPGGFGDRGISGMILAAKYARENKVPYLGICLGMQISVIEMSRHVLGLGDADSEEFNKDTPNHIVMYMPEVSKTHMGNTMRLGCRRTFFRKPDCLTSKLYGSPPHVDERHRHRYEVNPSFVPMLESAGLHFVGCDESRKRMEIVELQDHPFYVGVQFHPEFKSRPRRPSPPFTGLIMAATKQLGTISNSSNGYVGASG

SEQ ID NO: 21454 - DNA, 2520 bp, Sorghum bicolor
  misc_feature: Ceres ANNOT ID no. 8722977
  misc_feature: Up-regulated in root tissues in response to methyl jasmonate treatment
  misc_feature: Down-regulated in shoot tissues in response to methyl jasmonate treatment
  misc_feature: Down-regulated in shoot tissues in response to salicylic acid treatment
  misc_feature: Encodes the peptide sequence at SEQ ID NO 21455
atgccgacgcacgtgcagcccggaccagccgcactcggggcttcaggcccgcgggcattgtgcacacgccgcaacatcctcgcagcaggcgtccccggccgtttcatcatcgggcactccgcggcgtggcccgcccagccagcagcacccatcttcgtcgggcccggcgcaccgtgggcgcggcagcagccccagcgcaccgcggcgtcggcggcagcgctcggcccggagttccgacgcgcgcgcaccaccaagaccatctccaagcgcacccgcggcggcggcgggggcgcgcaggaccgcgggcgcgtggcatcggccgccgcgggccgctgcgtcgagaagctgctccgcgtcgcgcctgaagataggcgagggcttggttcggccctctcgtccttccggggcgacctacttggtcctgaggactactgccaggtcctccgggagctcggcgacagggataaatctgcactccgtgcgttcgaggtgttctatgccgcgctacccttagttgggggtggtgctgttgacaagggaaaacttctgactgctgccatcggtgcacttggcaagatgggcaggccagacctcgcgaggagggcttttgatagtggcattgcagataggtatggcaatacggtgtttgcgcactctgcgctcatctcagcttatgccaggagcgggcttgcaactgaggcaatgggggtgcttgagtcgatgaaaggtgcaggattgcggcctaccacggtatcatacaatgcggtgattgatgcatgtggaaaagggggtgttgatcttaggttcacactcgggtatttccgtcagatgctgcaggatgggctctgtccggatcgtaagacgtttaattcacttcttgctgcatgtagccgggctgggcatttggaagatgctcgcactgtctttgatgaaatgatccatcttggtagtgggcgtgacatttacacttacaacacatttgtcgatgctatttgcaagtgtggcaacatggagctggctacgcaagttgtattggatatggaagcaaacaacatcaagccaaatgttgttacatatagtacgcttatggatggattctccaaactggagaagtatgatgaggcactcaagttgcgtgaaaagatgaagtctttgggaattcaactggaccgagtttgctacaacaccttactggccatatatgtgaagacagggaagtatgatgaaatagctactgtgtgtgaagatatggagaatttgggtattgagaaggatactgttacttacaattccttgattaatggatacggaaagcaaggacgcttggacatggtcgctttccttgttcaagatatgcgggcgcaaggcgtagctcctagtgtgctgacatattcaactttgatagatatttattcaaaggcgggaatgcatggagatgcatttaatgtctatttggattttaaggagtctggtctaaaagcagacgttgttctgttcagctcttttattgatacattggccaagaatggtttggttgagtgtgctttgtctttgcttgatgagatgatcaagatgggtatcaagccaaatgttgtaacctacaacacaattattgatgcatttggcaagtcgaagattcttactgaggaggatcctggtaacatgggtattgttggggtttatggtggccagattgtaagggccactaatccagtgacaagaggagggcgctctgcaactgatgttcggatgaggaggtcacaggaattatttttcattctggaattattccagaagatggtccagcagggtgtacggccaaatgttgtaacattttctgcgatcctgaatgcttgcagtcgctgtaataattttgaagatgcagcccttttactggaacagcttcgcttatttgataactctgtgtacggggttgcatatgggcttttgatgggccatctggaagcttggtctcaagcacggtccctctttaatcagctgggccgcatggattctccaacatcctctgccttttataatgctcttacagatgtgctatggcattttggccagaggcaaggagctcagcaagttgtgcttgaaggggtaaaccgtcgtgtttgggagaacacatggggtgatttctgcttggacctgcaccttatgtcatgtggtgcagcccaagcaatggtacatgcatggctcctgaatgtgcgctctattgtctttgaaggtcgagctatgcctgaatttttaagcattctgacaggttggggaaagcatagcaagatagctggttcaagcactctccgtcgtgtcattgaagcattactcctttcaattggagcgccatttcaggtcgagcgcttcaacatcggaaggttcgtgtcacccagtgctttggtggctgcctggttgagagaatctggcaccgttaacatcctcctcctccgcaatgagcgagtgcaacatgcaaacccgtccaatctggtgccgatgttacaggcgttgcagttgtag

SEQ ID NO: 21455 - protein, 839 aa, Sorghum bicolor
  misc_feature: Ceres ANNOT ID no. 8722977
  misc_feature: Up-regulated in root tissues in response to methyl jasmonate treatment
  misc_feature: Down-regulated in shoot tissues in response to methyl jasmonate treatment
  misc_feature: Down-regulated in shoot tissues in response to salicylic acid treatment
  misc_feature (357)..(391): Pfam ID: PPR Pfam Description: PPR repeat
  misc_feature (497)..(531): Pfam ID: PPR Pfam Description: PPR repeat
  misc_feature (427)..(461): Pfam ID: PPR Pfam Description: PPR repeat
  misc_feature (216)..(250): Pfam ID: PPR Pfam Description: PPR repeat
  misc_feature (322)..(356): Pfam ID: PPR Pfam Description: PPR repeat
  misc_feature (462)..(496): Pfam ID: PPR Pfam Description: PPR repeat
  misc_feature (287)..(321): Pfam ID: PPR Pfam Description: PPR repeat
  misc_feature (392)..(426): Pfam ID: PPR Pfam Description: PPR repeat
MPTHVQPGPAALGASGPRALCTRRNILAAGVPGRFIIGHSAAWPAQPAAPIFVGPGAPWARQQPQRTAASAAALGPEFRRARTTKTISKRTRGGGGGAQDRGRVASAAAGRCVEKLLRVAPEDRRGLGSALSSFRGDLLGPEDYCQVLRELGDRDKSALRAFEVFYAALPLVGGGAVDKGKLLTAAIGALGKMGRPDLARRAFDSGIADRYGNTVFAHSALISAYARSGLATEAMGVLESMKGAGLRPTTVSYNAVIDACGKGGVDLRFTLGYFRQMLQDGLCPDRKTFNSLLAACSRAGHLEDARTVFDEMIHLGSGRDIYTYNTFVDAICKCGNMELATQVVLDMEANNIKPNVVTYSTLMDGFSKLEKYDEALKLREKMKSLGIQLDRVCYNTLLAIYVKTGKYDEIATVCEDMENLGIEKDTVTYNSLINGYGKQGRLDMVAFLVQDMRAQGVAPSVLTYSTLIDIYSKAGMHGDAFNVYLDFKESGLKADVVLFSSFIDTLAKNGLVECALSLLDEMIKMGIKPNVVTYNTIIDAFGKSKILTEEDPGNMGIVGVYGGQIVRATNPVTRGGRSATDVRMRRSQELFFILELFQKMVQQGVRPNVVTFSAILNACSRCNNFEDAALLLEQLRLFDNSVYGVAYGLLMGHLEAWSQARSLFNQLGRMDSPTSSAFYNALTDVLWHFGQRQGAQQVVLEGVNRRVWENTWGDFCLDLHLMSCGAAQAMVHAWLLNVRSIVFEGRAMPEFLSILTGWGKHSKIAGSSTLRRVIEALLLSIGAPFQVERFNIGRFVSPSALVAAWLRESGTVNILLLRNERVQHANPSNLVPMLQALQL

SEQ ID NO: 21456 - DNA, 2601 bp, Sorghum bicolor
  misc_feature: Ceres ANNOT ID no. 8723127
  misc_feature: Down-regulated in shoot tissues in response to salicylic acid treatment
  misc_feature: Encodes the peptide sequence at SEQ ID NO 21457
atgtcacttgacgttactcaagttctcttaagtgcgcaatctgctgatggtgcaattaggaagcatgctgaagaaagtcttaagcagttccaggagcagaacctccctggattcttgctttccctctcaagcgagttggccaatgaagagaaacctgaggagagccgaaggttagctggcttgattcttaagaatgcactggatgcaaaggagcagcacaggaagaatgagcttttccagagatggctggcactggatgctggtgccaaggcacaaattaaaggattgttgctgcaaactctcacatctcctgttgcaagtgccagatccactgcttcccaagttattgccaaggttgctggtattgagattccgcagaagcaatggccagagcttataggatcattgcttataaacatacatcaggtccagccaaatgtcaagcaagcaacgcttgagactcttggctatttatgtgaggaagtttctccagatgctgtagaccaagaccaagtcaataaaatacttacagctgttgttcagggtatgaatgcttctgaggcaaactctgatgtgaggcttgcagctacacgggcattgtataatgctttgggctttgctcaggtgaacttctcgaatgacatggagcgtgactatatcatgagagtagtttgtgaagcgacgcagtctccggaggtgaagataaggcaggctgcctttgagtgtttggtggctatatcgtctacttactatgataagctggcaacatacatgcaggatatatttaatataactgcaaaagctgtgaggggagatgaggagtcagtagcactccaggctattgaattctggagttccatatgtgatgaggaaattgacattctggatgagtacagcagtgagtttacagctgattctgatgttccttgctactactttatcaagcaggctcttcctgccttagtgccgatgttgttggaaactctcctcaagcaagaggaagaccaagacttggatgaaggtgcttggaatcttgcaatggctgggggaacttgtttgggcctggtggcaaggactgttggtgatgacattgttcctcttgtaatgcctttcgtggaggagaacataaccaagtctgaatggagacagagagaggctgcaacatatgcctttggctctatcttggagggcccatcagctgataaactggctcctcttgttaatgttgcattgggcttcatgctgtctgcactgacgaaggatcccagtaaccatgtaaaggacacaactgcctggacacttgggagaatctttgagttccttcatggttcagcacttgaaactcctcctatcatcacggctgagaattgtcagcaaatacttactgtgctgcttcacagcatgaaggatgtcccaaatgtggctgaaaaggcatgtggagccctctatttccttgcacaaggctatgtggatgctggatctgcatcgccattatcccctttctttcaagatattgttcagaaccttcttatggtcactcacagggaggatgctggagaatctcggctgcgaacagcagcatatgagaccctaaatgaagttgtcaggtgctccactgaggcagcagcccctattgttatgcagttagtacctgtgatcatggtggagctccatcagacacttgaaactgaaaagctgtcaactgatgagcgggagaagaggagcgaactgcagggcctcctttgtggttgcttgcaggtcattatccaaaagttgggagggatggagtcaactaagtactctttcttgcagtatgctgatcagatgatggatctgtttttgagagtttttgcatgtcgaaatgccacagtgcacgaggaggctatgcttgctattggagcattggcatatgcagctggtccaaactttgcaaagtacatggcacagttttatcagtatttggagatgggacttcagaactttgaggagtatcaggtgtgtgccattaccgtgggcgttgttggtgatctctgcagagcactggaagacaaaattttacccttctgtgatggcatcatgactcagctcctgaaggacctgtccagtaaccagttgcacagatctgtgaagccaccgatattttcttgctttggtgatattgcactggcaattggggaaaactttgagaagtatttgatctatgcgatgcctatgctgcaaagtgctgctgatttgtcggcccataccacagcaactgatgatgagatgctcgactacaccaaccagctaaggaatggaatcttggaagcctactctggtatcctgcaaggattcaagagttcacctaagacacaactactgatgccatatgctccacatattattcagttccttgatgctctggatgatactgtgatgaagactgcaataggtgtcttgggagatctggctgacacattgggtgtccatgctggccctttgatcaatcaatccacctcaagccaggcatttttagaggaatgcttggcatcagatgatccattggtgaaagaatctgccgattgggcaaggatagcaatcagccgtgcagtttcgggttga

SEQ ID NO: 21457 - protein, 866 aa, Sorghum bicolor
  misc_feature: Ceres ANNOT ID no. 8723127
  misc_feature: Down-regulated in shoot tissues in response to salicylic acid treatment
  misc_feature (23)..(103): Pfam ID: IBN_N Pfam Description: Importin-beta N-terminal domain
MSLDVTQVLLSAQSADGAIRKHAEESLKQFQEQNLPGFLLSLSSELANEEKPEESRRLAGLILKNALDAKEQHRKNELFQRWLALDAGAKAQIKGLLLQTLTSPVASARSTASQVIAKVAGIEIPQKQWPELIGSLLINIHQVQPNVKQATLETLGYLCEEVSPDAVDQDQVNKILTAVVQGMNASEANSDVRLAATRALYNALGFAQVNFSNDMERDYIMRVVCEATQSPEVKIRQAAFECLVAISSTYYDKLATYMQDIFNITAKAVRGDEESVALQAIEFWSSICDEEIDILDEYSSEFTADSDVPCYYFIKQALPALVPMLLETLLKQEEDQDLDEGAWNLAMAGGTCLGLVARTVGDDIVPLVMPFVEENITKSEWRQREAATYAFGSILEGPSADKLAPLVNVALGFMLSALTKDPSNHVKDTTAWTLGRIFEFLHGSALETPPIITAENCQQILTVLLHSMKDVPNVAEKACGALYFLAQGYVDAGSASPLSPFFQDIVQNLLMVTHREDAGESRLRTAAYETLNEVVRCSTEAAAPIVMQLVPVIMVELHQTLETEKLSTDEREKRSELQGLLCGCLQVIIQKLGGMESTKYSFLQYADQMMDLFLRVFACRNATVHEEAMLAIGALAYAAGPNFAKYMAQFYQYLEMGLQNFEEYQVCAITVGVVGDLCRALEDKILPFCDGIMTQLLKDLSSNQLHRSVKPPIFSCFGDIALAIGENFEKYLIYAMPMLQSAADLSAHTTATDDEMLDYTNQLRNGILEAYSGILQGFKSSPKTQLLMPYAPHIIQFLDALDDTVMKTAIGVLGDLADTLGVHAGPLINQSTSSQAFLEECLASDDPLVKESADWARIAISRAVSG

SEQ ID NO: 21458 - DNA, 2187 bp, Sorghum bicolor
  misc_feature: Ceres ANNOT ID no. 8723200
  misc_feature: Up-regulated in shoot tissues in response to methyl jasmonate treatment
  misc_feature: Down-regulated in root tissues in response to methyl jasmonate treatment
  misc_feature: Encodes the peptide sequence at SEQ ID NO 21459
atggccagcggactggagcaagagcagaactcccagccccaaagccttgggcacattgatgagaaatggccagaagttatgttcatcaacgactatgcggtgttcataggctacctgtcgatggctgtgacggggacaggtttcctggtccttacgtggtccacagtcgtcctgctcggtggattcgtcaccatgctagccaagaaggacttttggtgtctcacggtgattactctcgttcagacaagggtatttgacgtttttctgaacggaaatataagctacattggctactcgttcaagcgcttgtgggaggctgcactctccattgctttgccacataatcccttccgaaaatggagtgcaaggggtcttatccgagtgctggtgttcaccactgtgctgtgcccgctgttcgcgctgtacatgtttgggctgtttatttccccagggatctcgctgtggcgtctactgcaacaggactatggcgacatggcaggagacagcagcaaggcaaacctgaagccagcgctagtggtactgtactcgttggctctcgtccagggcgtgctcttctattacagggccatatcttctttggaggagcaacggctgttgaagctagtggcccaagcataccggttagacaaggacgacaaggcacgcggatcgatttcagactatctgcgcgagatcagggtcggatgcgagaaggacccatcgtttgccagaggcaggaacctcgtcacatacgctgcgggcctgatgctctccaattctccagacaactatctttcgggggcaaggattatcgacacgctaatagtctggttcagcagggagccggatcagtctgtggtagagagtcagcgtatgctgatgaacaacatgattgggtcggcgtcatctagtgccatcaagaaattcgttcagatgctagattcgaagggccagtctgacagtgaagagattaggtcgcgtgccatgaggatagtggcgcattttgccagtgagatccgtctgaacaagatcccgtacggtatccaatgcatatcatcgttcctcgagagtcttgaagcatcgatatctcaccatcgacacaaagaaacaatcatagatatccttaagaaactcaccgatgacgaggaaaacttaaggctgatgagcaacgcgaatggtctcgccttgaagatcatcaagatgcttgtagattctgatggcggagaactccatgatagtaagcatgatagatggtgctcaaacatagcagtgcccgggatggaagtgataaagcggttcacctctgtcatcaaaagatccaacaatgttcagctaccacgtgatatcttagagagccctaatgccatcagcaccctggagagtatgctaaaatgtccaaaatgcaaagtgcaagaggagctgcagaaatcagtcataatggttctaacgcaaataacatcgaaggaaacatctttggctgcgggcgaggaaatcaagaagagactcgatgaagtcaagaatagactcatcttgtcgctgatagccattttcctcgacggcggcaatggcaagagttccgtgaaaaaattggcagctggtgaatcgctggcaaagatgtcccgtataaatgagaatagtgccacgatcctgggagcagaggatggtcgcattgttagtggactcactcaagttgttctagacaagaacagcgagtacagaaagagtgcggcagatatcctgaaccatctgtgtagtcattacaccacgaatgaagacagtcgtttccaaaagctgaagaaagcaatgatcgatgacgtgattctgccggtgctgagggaagtgcttggctgtaggccgacagcagaacccaggccacccccctggtacctgtacctagaagacaacgtcgaagagcaggaggcgttgtcatccctttgtgcaaccgtacacgacatactgatcagacaagatcctaatttggccactcagttcgaccaaaaagccgaggagatcggccaggagatggagacgaaggaggtgatgaccttcgctgacctcgtgaaaaaggcccaagacgttgtggacaacaaaaggcggcggcagtcctgggtagtgcatccgtacccgccgccgcagtatgttgtttgttctgctgaggaagatcccaattcgtgctgtatctcgtga

SEQ ID NO: 21459 - protein, 728 aa, Sorghum bicolor
  misc_feature: Ceres ANNOT ID no. 8723200
  misc_feature: Up-regulated in shoot tissues in response to methyl jasmonate treatment
  misc_feature: Down-regulated in root tissues in response to methyl jasmonate treatment
MASGLEQEQNSQPQSLGHIDEKWPEVMFINDYAVFIGYLSMAVTGTGFLVLTWSTVVLLGGFVTMLAKKDFWCLTVITLVQTRVFDVFLNGNISYIGYSFKRLWEAALSIALPHNPFRKWSARGLIRVLVFTTVLCPLFALYMFGLFISPGISLWRLLQQDYGDMAGDSSKANLKPALVVLYSLALVQGVLFYYRAISSLEEQRLLKLVAQAYRLDKDDKARGSISDYLREIRVGCEKDPSFARGRNLVTYAAGLMLSNSPDNYLSGARIIDTLIVWFSREPDQSVVESQRMLMNNMIGSASSSAIKKFVQMLDSKGQSDSEEIRSRAMRIVAHFASEIRLNKIPYGIQCISSFLESLEASISHHRHKETIIDILKKLTDDEENLRLMSNANGLALKIIKMLVDSDGGELHDSKHDRWCSNIAVPGMEVIKRFTSVIKRSNNVQLPRDILESPNAISTLESMLKCPKCKVQEELQKSVIMVLTQITSKETSLAAGEEIKKRLDEVKNRLILSLIAIFLDGGNGKSSVKKLAAGESLAKMSRINENSATILGAEDGRIVSGLTQVVLDKNSEYRKSAADILNHLCSHYTTNEDSRFQKLKKAMIDDVILPVLREVLGCRPTAEPRPPPWYLYLEDNVEEQEALSSLCATVHDILIRQDPNLATQFDQKAEEIGQEMETKEVMTFADLVKKAQDVVDNKRRRQSWVVHPYPPPQYVVCSAEEDPNSCCIS

SEQ ID NO: 21460 - DNA, 1545 bp, Sorghum bicolor
  misc_feature: Ceres ANNOT ID no. 8723414
  misc_feature: Up-regulated in shoot tissues in response to salicylic acid treatment
  misc_feature: Encodes the peptide sequence at SEQ ID NO 21461
atggcagccgccgcctcagcctgcggcggcgccggctgcgggccgcagtgctcctcctctgcaggcggcgagggggatgcttcctcggagagcatgggacgcctttcgatctcctctgccgccgccgccgccgccacgtgcggcaagtgcgacggcggcggcgcggccgtcgcggtggccgggggcgttggcatgtgcgtcgattgctttcgggctcatctcttcgggaagttcaagctcgctgtcacgagcaacgccatggtgcgccccacagacgccgtcctcctcgccttctccggcggtcccgcctccagggtggctctgcaattcatacacgaaatgcagtccaaggcgatccaaagctgggagacgagtaactcccaggccctgccggccttcagacttggcgtcgcattcgtcgacgagagtgtcctttcagtgaggccggggcacgaaatcgacacggcgatcgaagatatcaagtcgattgtgtcgagtttgtcaccaggggataagcaattgcacgtcgcccctcttgaggacgtgatctcatctggatcagatgacaaggcggccaggctgaaggagctggtcggcgtgatcaatgatgagacgggtagggacgactttattcggtgcttgcgcatgctttcactgcagaagattgcactggaaaatggctacaccaagattatgctgggaacgtgtgcttctggaatagcatgccatgtgctatccgcaactgtgaaggggcaaggctatgctttaccagctgatgtccagtatgttgatacacggtgggaagtacccgttgttcttccacttcatgattgcttggcccaagagcttaacttgctctgtgaacttgatagtttgaagacacagcaacttctcgataggccttgcagtggcatcaatggcttagttgcatcctttgtttcacggctaagggaagagaacccgtcccgagagcataccattttaagaactgcacaaaagcttaagccattctcttttaacaagttctcagcaaacggctaccatgatttcctcccgtcacggcttcgtcccaagtttcagaacattgatgccaacgagtctactttctctgagattctttgcctgatatgtggaagcccgttcagtgaatcagaactgcagaatttggaaaacacaaagcacaaggctcagaagaaaactgatctgtatgctgctcattgttgtcaaagctgccatttccagattctcccagcagctacagatatgcatggacatttcttttcactactaccgaagttttggactgagaaagtggacactgcatctgctagccatagctcactaagctcctgctattctcagactcatctgacctctgggatctgtatagtgatgaggcaaaccatcacttgccagcaaatttccactgattctataaagacagcacaggttggagagctgaatgtttcccacttacatgtgatctcagatcaattggtctcatctcccgtgctgtgccagctattctgccagcaaacattgtaa

SEQ ID NO: 21461 - protein, 514 aa, Sorghum bicolor
  misc_feature: Ceres ANNOT ID no. 8723414
  misc_feature: Up-regulated in shoot tissues in response to salicylic acid treatment
MAAAASACGGAGCGPQCSSSAGGEGDASSESMGRLSISSAAAAAATCGKCDGGGAAVAVAGGVGMCVDCFRAHLFGKFKLAVTSNAMVRPTDAVLLAFSGGPASRVALQFIHEMQSKAIQSWETSNSQALPAFRLGVAFVDESVLSVRPGHEIDTAIEDIKSIVSSLSPGDKQLHVAPLEDVISSGSDDKAARLKELVGVINDETGRDDFIRCLRMLSLQKIALENGYTKIMLGTCASGIACHVLSATVKGQGYALPADVQYVDTRWEVPVVLPLHDCLAQELNLLCELDSLKTQQLLDRPCSGINGLVASFVSRLREENPSREHTILRTAQKLKPFSFNKFSANGYHDFLPSRLRPKFQNIDANESTFSEILCLICGSPFSESELQNLENTKHKAQKKTDLYAAHCCQSCHFQILPAATDMHGHFFSLLPKFWTEKVDTASASHSSLSSCYSQTHLTSGICIVMRQTITCQQISTDSIKTAQVGELNVSHLHVISDQLVSSPVLCQLFCQQTL

SEQ ID NO: 21462 - DNA, 1659 bp, Sorghum bicolor
  misc_feature: Ceres ANNOT ID no. 8723409
  misc_feature: Up-regulated in root tissues in response to salicylic acid treatment
  misc_feature: Encodes the peptide sequence at SEQ ID NO 21463
atgagggaggcggtgacggtgcaggtcggcggcttcgcgaacttcgtcggctcccacttctggaacttccaggatgagctgctcgggctcgccgacgaccccggcgctgacccggtattcaggaccgccgcgctggacttggacgtcctgtatcgcgccggcgagacacagcagggcgtcgccacctactgccctcgcttggtgtcagttggttctcgagggtctcttggctcgttaagttcctctggtactctaggttcgagcagtagtgctgcagatcagcccaacatcttcacatggtctggaaatgtaacgaaatcagtagcaaaacctcatgagcggaacttgttcctacaaagtttatctgaaggagaaagcaacccaagctctagcaatggccgaaacaatgccagagaaaatattgaagataaggacctggttgaaaatctagagaatggagtcattttttggactgattattcaaaagttcagtatcaccctcagagcttgtatgagttatatggatcatggacagactttgacaagtttgataactatgggactgcaaaggaggtggtttcagaatggtctcaaatggaggagatgaatgagaggctaaggttctttgttgaagaatgcgaccatatccagggcatccagtttcttgtggatgattctggaggctttgccagtgtagctgcacagtttttggagagtatcgctgatgattacacaaatacccctgtaatgctgtactgtgtgcgcaatccagactcctctgggtcttccagaaatcagcgcgaaaccatcataagatctttgcacgatgctgtgtcattgtcgaaactttcatactcctgcaatctgatggtaccaataggactgccttctctaagttacttgtcacctttgctttctataaaagatgataaacacttccactccagtgccatttgtgcagcagcaatacattcattgtctgttccatttaggctacaacatgtgggcccggccacagattcggcacattcatctggcaagcttgatatcggtgagcttgtgcacatattatctgatcaaggaaggcagaatatgatcactgcgctggatgtagcaatgcctgccccttctttgacagatagaaaagatctgaggaacatacagaggagcttgcattctctgacccctgaaatcagcaacaatgatgaagatccttacgctgttgaatccttggtggttcatggagctctagatgcaggcgggaaaagggcttccatatcccaggtgaaggatgccatccgttcaggtctggaaggcagggaaacaaaaccaaagttctcccatctctctgtatcgccgtgcccccttccgatcccactcccattcccatcaatcttcagcggctccataggtcagcagggcgagatcctcagcaacagccacccagaaggatctcggccaaagggttcgctcgatgttgtctcggtgccgatggcagcacgcctgaggtcgagcagcgccatagtgcctttcatcgagaggaggtcgacgagcctccagaggtcctccgcgactggggctttgggaaggaggaggtcgaggacatgggcgagcacctggcgaagatgctgcgcccattttaccctgagatggatctga

SEQ ID NO: 21463 - protein, 552 aa, Sorghum bicolor
  misc_feature: Ceres ANNOT ID no. 8723409
  misc_feature: Up-regulated in root tissues in response to salicylic acid treatment
MREAVTVQVGGFANFVGSHFWNFQDELLGLADDPGADPVFRTAALDLDVLYRAGETQQGVATYCPRLVSVGSRGSLGSLSSSGTLGSSSSAADQPNIFTWSGNVTKSVAKPHERNLFLQSLSEGESNPSSSNGRNNARENIEDKDLVENLENGVIFWTDYSKVQYHPQSLYELYGSWTDFDKFDNYGTAKEVVSEWSQMEEMNERLRFFVEECDHIQGIQFLVDDSGGFASVAAQFLESIADDYTNTPVMLYCVRNPDSSGSSRNQRETIIRSLHDAVSLSKLSYSCNLMVPIGLPSLSYLSPLLSIKDDKHFHSSAICAAAIHSLSVPFRLQHVGPATDSAHSSGKLDIGELVHILSDQGRQNMITALDVAMPAPSLTDRKDLRNIQRSLHSLTPEISNNDEDPYAVESLVVHGALDAGGKRASISQVKDAIRSGLEGRETKPKFSHLSVSPCPLPIPLPFPSIFSGSIGQQGEILSNSHPEGSRPKGSLDVVSVPMAARLRSSSAIVPFIERRSTSLQRSSATGALGRRRSRTWASTWRRCCAHFTLRWI

SEQ ID NO: 21464 - DNA, 3822 bp, Sorghum bicolor
  misc_feature: Ceres ANNOT ID no. 8723441
  misc_feature: Up-regulated in shoot tissues in response to salicylic acid treatment
  misc_feature: Up-regulated in root tissues in response to salicylic acid treatment
  misc_feature: Encodes the peptide sequence at SEQ ID NO 21465
atgactcaaaccctgcaagggaaagttatggcctacacaccaagcagctttcctgttcagcaacagatcttgccggaggatattgaaatgcttcagctggataacatgaaccagaatacctctccgattcgggccatcattattgaaaaaatgcttgcgttgttctatggttccatgaatgtaaatgcactccagaagatcgtatgtgaagcatgcctgagaaacatggaagaattttgtgacttgtgcccagattcatgtctgaaagcttcaagaatcattgacaacatgctctacaaaaatgctccacagctccatttttacttggatcttgaaacagtagaaggcagggtgaatgatttgctcagatcttttccgtatagaaagcaaagagatccatgtatatcttcagcagttccatcaacaaaagatttgcggcagctgcctgggatacagatgacagactctagtgtctatcataatagagttgcccctgcttttactaatttgcctgcacattcaggagatgtacctccacatactgtgttcacttctcagagatatgtaccacagaatcacaacatggctgctgctaatttagctctagttgaaaggcctgaaagctttatgagcaccgtagttgctccatctgtgtcaggacttcctaactgtatttcaggccttggtgggattgatagtgctggattgcaaaatggctatttgaaggaccattttccaggtgatgcttaccatgttgatagtccacaaccgtctatgtctgggagttccagtcctttatcagccgtgtgtgatccaaccacaagttcgggtgcaatgataagatcatcagtggactctgtctctaaagcaagtgggcaaaaactctttacccgtgaagaacaattgtttcaacaatacagagaatatgagaaagagttagatggtgcatggagccacccagcagagaaggcagttcattcaaataggacaactcaaagcaatgaaatatatttcaaagaagaatgtcgacctgacacattcatggaaatgaaagaaaactattggcacacctcggactctagagattcgtgcagggagatatactcaaatttaagcacacccaatgctcagtatcagtgcttcatgtctgattgtgatcctcgtgaccctgagagagaaattgttgagagatctgaacagacatcaaatagcacagtatcaaagccaacttcacctatttcagatgaatcttctggcaagcgtccagcaaaacgcctgaaggctgatgctcccactcttgtcaatgtcaatcaagtagagagttcaaaggatcaaaaacctgttacgaatgagaatcatgtatctggtggtgaaacagtacaatcagaaatcacagaattacctgcaaaatcaccttgcagttcattgggagacattaatactgacagcaataatatgcttgaacagggcagtgaagatgcacctaacacggagcttgttaaggaagaggaattgtactgtgcaaagggtgacattgagatgaatgaggctaatactgttgcatttgatcagacaccaagaggggtcagtttaagtacaaggagaaagagaggggcttctatactatatgcattaactgctgaggagcttagagatcacatgagtagtctaataaaccagcatacttgtctgggcaaagtgatatctcaagaattcccatcaattgacggattgcctgatcagaatacatgcagtttgtgtgggatggagaggcttctttttgaacctcctccacgattttgtggtctctgtttcaaaataataaattctgcagggtgctattatgttgaagttgaaaatggaattgagaaaacttctatatgtagcaaatgccaccatcttagcagttcaagagctaaatatcagaagaaatttaattatgcagaaacagatgctgaggctgaatggtgggtccagtgcgacaagtgcaaagcttggcagcatgaaatctgtgctctttttaacagaaagtgtgaaggggcaaaggctgagtatacttgcgcaaaatgttttttgaatgaaaaggatagcggagatattcaggcactggagtcatccactgttcttggggcacaggagttaccaagaactaagttaagtgatcatattgagcaaagactttcagagaggcttgagcaggacaggcaacagagggcgagcgcctctggaaaagttgctgaagaggtaccaggtgtgaaaggtcttacagttagagtagtttcttcagctgaaagaatactacaagtccaaccacgttttcgtgatttttttaaacaagaaaagtatcctggggagtttccatacaaatcgaaggccattctgttgtttcaaaagattgaaggtgtggatgtttgcctgttcgccatgtatgtacaagagtacggttcggattgcccatcaccaaatcagagacatgtttatcttgcgtatatcgattctgtcaaatatttccggcctgaaatcaaatctgcaagtggagaagctctccgcacctttgtgtatcatgaaattttgattggttatctggactactgcaagaaacgaggatttgtaagctgttccatatgggcttgcccatctacgaagcgtgatgattatgttttatattgtcatccaacagtacaaaagatgcccaagtctgacaagcttcgaagctggtaccagaacttggtcaagaaggccgttaaggagggcgtggttgtggagcgtaatacactctccgatttcttccttcagcctacaaatgagtgcaaggccaatatttcagcagcatgcttgccatattgtgagaatgatttctggcctggagaagcagagaggctccttgagaagaaagatgataatacttcacagaagaaagagacacaggtaggaaggctcttgcgtgttgccaaacgcgatgacagaaaaggaaatcttgaggatattttgcttgtgcacaagcttggggaaaggatgcgcaccatgaaagaagatttcattatgctttgtctgcaacagttttgcaagcactgtcaccagcctatcatatctggcaaaagttgggtttgcactagctgtaaaaatttccatctttgtgacaagtgtcatgcagaggagcagaatacggcacaaaaggacaggcatccggccaccacaaaacagaagcatgcatttcaaagaatggaggtagaacctcttccggagactgatgatggagatccgacaatggaaagtaagtattttgacagcaggatcgatttcttgaagcactgccaagacaatcaattccagtttgataccctccggcgggcaaagcactctacaatgatgattctgtattatctacacaattcgacctgctctgcttgccatcgtgctgtggaccaatgcttggtgtggcggtgcctagagtgcctgggctgcaccttttgtgatcaatgctataaacaaaatggtcaaagtttgcatagtcatgaattgaggcagattcacactagtgaaactttgcagaagcacactctacaggattacattgatggtcttctgcatgcatcgaggtgctatgatccacgtaactgcacccatccagtctgtttaaccctgaagaaattgttcttccatggtgtacgatgtgatatccgtgcccgcaactggagtggttgcaataagtgtgtctttatgtggaaacttctgctctgccactcaaaagattgcaacgatgtaaactgttcagttcctagatgcaggccatctggtcagaagccgtcttgtataatctag

SEQ ID NO: 21465 - protein, 1273 aa, Sorghum bicolor
  misc_feature: Ceres ANNOT ID no. 8723441
  misc_feature: Up-regulated in shoot tissues in response to salicylic acid treatment
  misc_feature: Up-regulated in root tissues in response to salicylic acid treatment
  misc_feature (537)..(1263): SWISSPROT Homolog: EC 2.3.1.48 Histone acetyltransferase
  misc_feature (627)..(693): Pfam ID: PHD Pfam Description: PHD-finger
MTQTLQGKVMAYTPSSFPVQQQILPEDIEMLQLDNMNQNTSPIRAIIIEKMLALFYGSMNVNALQKIVCEACLRNMEEFCDLCPDSCLKASRIIDNMLYKNAPQLHFYLDLETVEGRVNDLLRSFPYRKQRDPCISSAVPSTKDLRQLPGIQMTDSSVYHNRVAPAFTNLPAHSGDVPPHTVFTSQRYVPQNHNMAAANLALVERPESFMSTVVAPSVSGLPNCISGLGGIDSAGLQNGYLKDHFPGDAYHVDSPQPSMSGSSSPLSAVCDPTTSSGAMIRSSVDSVSKASGQKLFTREEQLFQQYREYEKELDGAWSHPAEKAVHSNRTTQSNEIYFKEECRPDTFMEMKENYWHTSDSRDSCREIYSNLSTPNAQYQCFMSDCDPRDPEREIVERSEQTSNSTVSKPTSPISDESSGKRPAKRLKADAPTLVNVNQVESSKDQKPVTNENHVSGGETVQSEITELPAKSPCSSLGDINTDSNNMLEQGSEDAPNTELVKEEELYCAKGDIEMNEANTVAFDQTPRGVSLSTRRKRGASILYALTAEELRDHMSSLINQHTCLGKVISQEFPSIDGLPDQNTCSLCGMERLLFEPPPRFCGLCFKIINSAGCYYVEVENGIEKTSICSKCHHLSSSRAKYQKKFNYAETDAEAEWWVQCDKCKAWQHEICALFNRKCEGAKAEYTCAKCFLNEKDSGDIQALESSTVLGAQELPRTKLSDHIEQRLSERLEQDRQQRASASGKVAEEVPGVKGLTVRVVSSAERILQVQPRFRDFFKQEKYPGEFPYKSKAILLFQKIEGVDVCLFAMYVQEYGSDCPSPNQRHVYLAYIDSVKYFRPEIKSASGEALRTFVYHEILIGYLDYCKKRGFVSCSIWACPSTKRDDYVLYCHPTVQKMPKSDKLRSWYQNLVKKAVKEGVVVERNTLSDFFLQPTNECKANISAACLPYCENDFWPGEAERLLEKKDDNTSQKKETQVGRLLRVAKRDDRKGNLEDILLVHKLGERMRTMKEDFIMLCLQQFCKHCHQPIISGKSWVCTSCKNFHLCDKCHAEEQNTAQKDRHPATTKQKHAFQRMEVEPLPETDDGDPTMESKYFDSRIDFLKHCQDNQFQFDTLRRAKHSTMMILYYLHNSTCSACHRAVDQCLVWRCLECLGCTFCDQCYKQNGQSLHSHELRQIHTSETLQKHTLQDYIDGLLHASRCYDPRNCTHPVCLTLKKLFFHGVRCDIRARNWSGCNKCVFMWKLLLCHSKDCNDVNCSVPRCRPSGQKPSCII

SEQ ID NO: 21466 - DNA, 1398 bp, Sorghum bicolor
  misc_feature: Ceres ANNOT ID no. 8723489
  misc_feature: Down-regulated in root tissues in response to methyl jasmonate treatment
  misc_feature: Down-regulated in shoot tissues in response to salicylic acid treatment
  misc_feature: Encodes the peptide sequence at SEQ ID NO 21467
atgccgtcgaagccgaacgccgcgtggcgcctcgtcctcctcgcgttcctcctcggcaccatcagcgccgccgcgggccacgatgacgcggcggcgcggcggacgatggagcagttcgccggcttcgccgccgcctcaggcgacggcgacggcggcccttccagcgacttccacgtcgactccgagggcctccagcggcagattgatgagctggcctcgttctccgactcgcccgcgccgtccgtcacccgcgttctgtacaccgacaaggatgtgcaggctcgaaggtatataaaagggataatgaatcaacttggccttgccgttcgggaagatgctgttggtaacatatttggccgctgggagggttctgagcctgaactaggggcagttgcaactggatctcatgttgatgccattccattctcaggaaaatttgacggtgttgttggagttctgggtgctcttgaggcgattagtttgctgaaaaggtctgctttccttccaaaaaggtctttggaggttatcatgtttacatcagaggagcctacacgattcggaattagctgcttgggaagccgcttaatggcagggattgaagaactagctcaatccctcagaaatgttgttgacaatcagaatgtgtcattttcggatgctgcaggatctgctggctataaattgcatctagaggacttgcatagcgtatttttaaagaaagacagctactctgcttttatagaactgcacattgagcagggtcccatcttagaaaaggaaggtatccctattggcattgttactgctattgctgctcctgcaagtcttaaggtggactttgaagggaatgggggtcatgctggagcagtgcttatgcctgcaagaaatgatgctggtctggcagcagctgaattagcattagcagtcgagaaacatgtcctggaatcaggatcaattgataccgttggcaccgttggagcaatcaatagcatcccaagcaaatcacacctagaaattgatgtaagagatattgatgagaagagaaggaatgatgtcattgagaagattcgccggtctgcaacacagatttcaaagaaccgtggagtagagctttcagaatttaagatcatcaaccaggacccacctgctctatctgacaaatcagttgttgatgcaatggaatttgctgcaaaacagttgaacctggagtacaaaaagatgattagcagagcttaccacgattcactcttcatggccagagtatcaccaatgggtatgatcttcattccctgttacaaaggttacagccacaagccggaggagtatgcatcaccggaggacatggcgaatggggtgaaggttctagccttgacaatggctaagctgtcgctggagtga

SEQ ID NO: 21467 - protein, 465 aa, Sorghum bicolor
  misc_feature: Ceres ANNOT ID no. 8723489
  misc_feature: Down-regulated in root tissues in response to methyl jasmonate treatment
  misc_feature: Down-regulated in shoot tissues in response to salicylic acid treatment
  misc_feature (59)..(463): SWISSPROT Homolog: EC 3.5.1.87 N-carbamoyl-L-amino-acid hydrolase
  misc_feature (132)..(461): Pfam ID: Peptidase_M20 Pfam Description: Peptidase family M20/M25/M40
MPSKPNAAWRLVLLAFLLGTISAAAGHDDAAARRTMEQFAGFAAASGDGDGGPSSDFHVDSEGLQRQIDELASFSDSPAPSVTRVLYTDKDVQARRYIKGIMNQLGLAVREDAVGNIFGRWEGSEPELGAVATGSHVDAIPFSGKFDGVVGVLGALEAISLLKRSAFLPKRSLEVIMFTSEEPTRFGISCLGSRLMAGIEELAQSLRNVVDNQNVSFSDAAGSAGYKLHLEDLHSVFLKKDSYSAFIELHIEQGPILEKEGIPIGIVTAIAAPASLKVDFEGNGGHAGAVLMPARNDAGLAAAELALAVEKHVLESGSIDTVGTVGAINSIPSKSHLEIDVRDIDEKRRNDVIEKIRRSATQISKNRGVELSEFKIINQDPPALSDKSVVDAMEFAAKQLNLEYKKMISRAYHDSLFMARVSPMGMIFIPCYKGYSHKPEEYASPEDMANGVKVLALTMAKLSLE

SEQ ID NO: 21468 - DNA, 2259 bp, Sorghum bicolor
  misc_feature: Ceres ANNOT ID no. 8723633
  misc_feature: Up-regulated in shoot tissues in response to salicylic acid treatment
  misc_feature: Encodes the peptide sequence at SEQ ID NO 21469
atggcctcccgcctcctccacctccacctgcgccgcgggcgcgtgcgcgtgcgcggcgggagcccggcgggcagccccgtgcccgcgcccgcgcccgcgcggctcctctcctcctcgcctcctccaaccgcgtcctcggcctcggcgggcggtggcgggggcatcgagaaggtgctggtggcgagccggggcgagatcgcgtgccgggtcatgcgcaccgcgcgccgcctcggggtcgccaccgtcgccgtgtacagcgacgccgaccgcggcgcgctgcacgtgcgcgccgccgacgaggccgtcaggatcggcccgccccccgcgcgccagagctacctcaacgccggggccatcatcgacgccgcactccgcaccggcgcacaggctatccatccaggatacggttttctctcagagagtgctgattttgcgcagctctgtgagaccgaggggctcaaattcattggaccaccagcatctgcgatcagagatatgggcgataagagtgcatccaagaggatcatgggtgctgctggcgtgccgctggttccaggataccatggggctgaccaagacattgagctgctgaaacttgaagctgataaaattggttatcctgttttaatcaagcccacccatggtggagggggcaaggggatgagaatagtcgaaaggcctgatgaatttgtggatgctgtactgagcgctcaacgggaagctgcagcatcatttggtgtaaacacactactgattgagaagtacattactcaaccaagacacgtagaagtccaggtatttggcgaccaacatggaaatgcaatatatctctatgagagagactgcagtctacaaagaaggcatcagaagattattgaggaagctccagctccaaatgtgacagctgagtttcggtctcatattggtggagctgctgtatctgccgcaaaggcagttggttactacaatgctggaacagtggagtttattgtggatactctttctggagagttttatttcatggagatgaatactcgactccaggttgaacacccagtgacagagatgattgttggtcaagatcttgtggagtggcaaatacgtgttgcaaatggagaacgactgccattatctcaggagcagattccattaaatggacatgcatttgaagcacggatatatgctgaaaatgttccaagagggtttctccctgcaacaggaaccttacatcactaccgaccagtcccttctgatccaacagtaagagttgaaactggagtcgaagaaggagatacagtcagcatgcattatgatccaatgatagccaaacttgtagtatggggtgaaagtcgcactgctgcactagtcaagctaaagaactgtttatcaaactttcagattgcaggtttgccaaccaatattggtttcctccaagaactcgcaagccatagtgcctttgaaaaaggcctagttgacactcacttcattgaacgttataaagatgatcttttgagtatttctacgaagtcctcagaagaatctcatggtgtagctgtgcttggtgcaattttggctgctgcatgcatttgcaagaaggatcacattacatttaaagaatcacaacgagccaacaacacactatctgtatggtacaataatccacctttcaggatgcatcactttgctaggcatcccctggatcttgagttggaagagaatgatggattcagtgagaaacttcttaaactgttcattactcataaatctgatggaagctacttcatcgagacagaagatggcacttctggtttagatgtcaaagttgatcacaagggtgaccatgattttcgtgtcgatgtttctggtctgcaaactgatgtgactctagcatcttattcgaagggcaacagcaaacatatacatgtctggcatgggaagcatcatcaccattacagacagactgtaagagctgagcatgcagttgatgatagctcccaaccttgtcatgcttctgaagggaagtcacatccaaaagggagtgttctggcaccaatggctggcttggttgtgaaagttttgcttgaagatggggcacaggtggaggcagggcagcctgtcatggttatggaagcaatgaagatggagcatgttgtcaaagcacctcgtgccggatatgtagatggcctgaaggttactgctggccaacaagtttttgactccagtgtccttttcacaatcaaggacaatattgcaaactga

SEQ ID NO: 21469 - protein, 752 aa, Sorghum bicolor
  misc_feature: Ceres ANNOT ID no. 8723633
  misc_feature: Up-regulated in shoot tissues in response to salicylic acid treatment
  misc_feature (55)..(752): SWISSPROT Homolog: EC 6.4.1.4 Methylcrotonoyl-CoA carboxylase
  misc_feature (168)..(383): Pfam ID: CPSase_L_D2 Pfam Description: Carbamoyl-phosphate synthase L chain, ATP binding domain
  misc_feature (390)..(497): Pfam ID: Biotin_carb_C Pfam Description: Biotin carboxylase C-terminal domain
  misc_feature (54)..(166): Pfam ID: CPSase_L_chain Pfam Description: Carbamoyl-phosphate synthase L chain, N-terminal domain
  misc_feature (679)..(746): Pfam ID: Biotin_lipoyl Pfam Description: Biotin-requiring enzyme
MASRLLHLHLRRGRVRVRGGSPAGSPVPAPAPARLLSSSPPPTASSASAGGGGGIEKVLVASRGEIACRVMRTARRLGVATVAVYSDADRGALHVRAADEAVRIGPPPARQSYLNAGAIIDAALRTGAQAIHPGYGFLSESADFAQLCETEGLKFIGPPASAIRDMGDKSASKRIMGAAGVPLVPGYHGADQDIELLKLEADKIGYPVLIKPTHGGGGKGMRIVERPDEFVDAVLSAQREAAASFGVNTLLIEKYITQPRHVEVQVFGDQHGNAIYLYERDCSLQRRHQKIIEEAPAPNVTAEFRSHIGGAAVSAAKAVGYYNAGTVEFIVDTLSGEFYFMEMNTRLQVEHPVTEMIVGQDLVEWQIRVANGERLPLSQEQIPLNGHAFEARIYAENVPRGFLPATGTLHHYRPVPSDPTVRVETGVEEGDTVSMHYDPMIAKLVVWGESRTAALVKLKNCLSNFQIAGLPTNIGFLQELASHSAFEKGLVDTHFIERYKDDLLSISTKSSEESHGVAVLGAILAAACICKKDHITFKESQRANNTLSVWYNNPPFRMHHFARHPLDLELEENDGFSEKLLKLFITHKSDGSYFIETEDGTSGLDVKVDHKGDHDFRVDVSGLQTDVTLASYSKGNSKHIHVWHGKHHHHYRQTVRAEHAVDDSSQPCHASEGKSHPKGSVLAPMAGLVVKVLLEDGAQVEAGQPVMVMEAMKMEHVVKAPRAGYVDGLKVTAGQQVFDSSVLFTIKDNIAN

SEQ ID NO: 21470 - DNA, 1293 bp, Sorghum bicolor
  misc_feature: Ceres ANNOT ID no. 8724102
  misc_feature: Up-regulated in root tissues in response to salicylic acid treatment
  misc_feature: Up-regulated in shoot tissues in response to salicylic acid treatment
  misc_feature: Encodes the peptide sequence at SEQ ID NO 21471
atggactcggatcaggactccgtcgacgactgggtcgtgctggcgtcgtcgtcgtcatcctccgacgacgagggcgtcatcgcgctctcatccggctgcaccacccccaacttctcctcccgttcgggctccgccacccccaactccgaccccgaccacgaccacgccaccaccaagttcctcctcgcctacgaggccgccgcggccgaccccgacgacccggagggcatgtacgacctgtcggacgcggaggacacgtacgcgacgccaccaccgtccccgccgctacccaagccgctctcgggcctcttccaccacacgctaaccggggacgtggcgtacgccgccttcgacccggtcgtcctccccgcctccgcctccgccgccctctcgcgcggccactacgtcggcaagcagctggtcccggaccccacgttcgcctccttcatcccgcacgagcccgtgtccgcgctggcttccacgcggggactcgtctgcctccgcggcaccgtctccaacgcctactacgtcgcgaacccggccaccttcgagcacgagcggctcccgaagccggccagcgtccacaccgccaaaggcgagcccgcggttgtcatcgcgttcgacctcgacccgcgcgactccgaccccgagcgcgccgacgccgggtacaagccgttctaccgccactaccacgtcgtcgtcgcgttccccatcggggacggcatctactccttcgagtccttctcgtccaggacggggaagtggaccatgagcgcggacgtcaccgacgccggtttcgtacaccagggatccggcgtcggcgtgctcggatgcgcgttctggcgcacctccatgggcctgttcctctgctacgagcccgtctcccgctgcgcggacctcgtccatgcgcccgaagaggtgatgcagtggcattactgggagctcggcgagatggagggcacgctctgcgtcacgtgcatggacgagctcgtcgaggccgtcgtcgtgatccgcctcgaattcgcacgccacggcgccatctcgtgggctctgacggggcacttcgagggcggctgcctcaggggacgcaaggacgtcaagctgctccgctcgcagggcaaggcagaggtcgtcatgtgggaccccagctccgagacggtggtggccatggacatcgagggccgcaccacacgcaccatcaggttcacccctggcagcgcctactacgccgatttcatcccctacgtcaggtccttggctgccgtctctgccaacgggggtatgtttggctag

SEQ ID NO: 21471 - protein, 430 aa, Sorghum bicolor
  misc_feature: Ceres ANNOT ID no. 8724102
  misc_feature: Up-regulated in root tissues in response to salicylic acid treatment
  misc_feature: Up-regulated in shoot tissues in response to salicylic acid treatment
MDSDQDSVDDWVVLASSSSSSDDEGVIALSSGCTTPNFSSRSGSATPNSDPDHDHATTKFLLAYEAAAADPDDPEGMYDLSDAEDTYATPPPSPPLPKPLSGLFHHTLTGDVAYAAFDPVVLPASASAALSRGHYVGKQLVPDPTFASFIPHEPVSALASTRGLVCLRGTVSNAYYVANPATFEHERLPKPASVHTAKGEPAVVIAFDLDPRDSDPERADAGYKPFYRHYHVVVAFPIGDGIYSFESFSSRTGKWTMSADVTDAGFVHQGSGVGVLGCAFWRTSMGLFLCYEPVSRCADLVHAPEEVMQWHYWELGEMEGTLCVTCMDELVEAVVVIRLEFARHGAISWALTGHFEGGCLRGRKDVKLLRSQGKAEVVMWDPSSETVVAMDIEGRTTRTIRFTPGSAYYADFIPYVRSLAAVSANGGMFG

SEQ ID NO: 21472 - DNA, 3576 bp, Sorghum bicolor
  misc_feature: Ceres ANNOT ID no. 8724210
  misc_feature: Down-regulated in shoot tissues in response to salicylic acid treatment
  misc_feature: Encodes the peptide sequence at SEQ ID NO 21473
atggccgatccgtacggcgacggcaagggcccatcactcaagaaccagcagccgcgccccggcccccgtctcaagcccgccatcgagatggaggacctcatcaacctcctccacggatccgatccagtccgggtcgagctcacccgccttgagaacgagctgcagttcaaggagaaggagctgggcgatgcgcaggcggagatcaaggctctccgcctgtcggaccgcgcgcgcgagaaggccgtacaggatcttaccgaagaattggcaaaggtggatgagaagctgaagctcacagagtctctcctcgaaagcaaaaaccttgaagcaaagaagatcaacgacgaaaaaaaagcagcacttgccgcacagtttgcagctgaggcaaccttacgaagggttcatgcggcacagaaggacgatgacatgcctcctattgaggccattctcgcaccactggaagctgagctgaaactggcccgtcaagagattgcaaaattacaagatgacaacagggcattggatcgtcttacaaagtctaaggaagcagctctgcttgaagcggaaaggacggttcagatggcactggcaaaagcttctttggtggatgatctgcaaaacaaaaaccaagaattgatgaaacagattgagatatgccaggaagagaacaaaatcttggatagaatgcaccgccagaaagttgctgaggttgaaaagctcactcagactgtcagagaactagaagaatctgttcttgctggtggtgcagctgcaaatgctgtcagagactatcagcggaaagttcaggagatgaatgaggaaatgaaaactcttgatcgtgagctagctcgtgcaaaggtttcagcaaatagggttgctgttgtggtggcaaatgagtggaaagacggcaatgataaagtaatgcctgttaaacaatggctcgaggaacgaaggattctgcaaggagaaatgcagcaactccgggacaaacttgctattgcagaaagggctgcaagatcagaagctcaactgaaagagaagttccagctacgacttaaggtacttgaggaaggattgagaatgcctacatcgcgaaccaatgtcagtggcacacgccgccagtctattggtggtgctgatggtttgtctaaggccaatggcttcctgtccaaacgcccatcattccagatgagatcatcagtgtctaccacaacaactctagttaaccatgcaaaaggagcgtccaagtcatttgatggaggctgtagatcacttgaacgctataagggtcttgtaaatgggaacggtatgaacatatctaccgattccagtgaagataaggagtcaagcaactcagatgagaagtgtaatgagtttgcatctgctgagtcggaggactcggtgtcaggtgttctatatgatatgctgcaaaaggaggtcattgctctaaggaaggcatgccatgaaaaggatcaaagcctgaaagacaaggacgacgcagttgagatgttggcaaagaaagtagatactttgacaaaagctatggagtcagatgccaagaaatcgaggcgtgagttagctgctatggagaaggagttggcagctgtgcgcatggagaaagagcaggataacagagcgaaacgctttggtagttcaagtggttctggtagcagttcgcagctcccatctggcagatttgggtgcaacggcatccgcatccgcgattccgtccgcggcgccatcgcctcccccaatcagatcaatccatcccctcgccctcctcggctcctcttcctcgtcctccgaatcgctggaaggcggagctgcagagaccggagccgccggcgctccaccaaaactaaagtccaggtcggaggatctcccgagtacaaggtcgagaggaagctgggcaaaggtggcttcggccatgtctttcttggccgacgtctgactgctgcccatgctggacgctctgcggcgtctgctgcccaagaggttgccatcaaatttgagcacactaccagcaagggctgtacctacggccctccagctgaatggcaagtctacaccgctctaggaggcacgcacggtgtgcccaaggtgcattataaaggtcgccagggtgactactatgtcatgattatggatatgctggggcctagcttgtgggattcatggaattcattaggccaatccatgtcatcggaaatggtggcttgcattgccatggagtccatttccatcttggaaagcatgcattctaaaggatatgtgcatggagacgtcaaacctgagaactttcttctggggcagccttcaacgcctcaagaaaagaaactttatcttgtggatcttggattagcaacaaagtggagagatactgccagtggacaacatgttggttatgatcaacgtcctgatgcctttagaggaacagtcagatatgctagtgtccatgcacatttaggaagaaccgctagcaggagagatgatttggagtcacttgcctatacactagtattccttcaccggggcaggttgccatggcagggataccagggagataataaatcatttttggtgtgcaagagaaagatgagtacctcacctgagaccctttgcggcatatgtcctcaacctttcaagcagtttcttgagatcgttgtcaacatgaagtttgatgaagagccaaactattctaagttgatttcattatttgacagtttaattggaccaatcccttccattagaccaatcaatactgatggagctcaaaaggtagggcagaagcgtgccaggttgcttaatgatgatgacgaccatgtaaaaaagaagattcggctgggtgcccctgcaacccagtggatttcagtatacaattcaaggcaacctatgaagcagaggtaccactataatgtggctgacgcaaggttagcgcaacatgtggagaaaggaaatgaggatggtttgttgataagttcaatatcatcatgctcaaatctttgggcaatcattatggatgcaggaactggcttctcagctcaagtctatgagctatcttcacactttcttcataaggaatggattatggagcaatgggataaaagttactacatcagttctgttgctggctccaacaatggaagttctattgtagtgatgtcaaaaggcacaccatatacacagcaatcttacaaagtcagtgattcctttccatttaagtggataaacaagaagtggaaggaaggttttcatgtgacttcaatggcaacatcaggcaatcgatgggctatagtcatgtcccgcagtgctggtttttctgagcaggttgtggagttggacttcttgtacccaagtgagggcatccatagacgctgggacaatggctttcgtatcactgcaatggctgccacaatggatcagtctgcgctgatcctaagcaagccaaggcgtcgtccgagagacgagacacaagagactctgcggaccacacagtttcccagtcaacatgtcaaggataagtgggccaagaatctctaccttgctgggatatgctatgggcgaaccgtggcctaa

SEQ ID NO: 21473 - protein, 1191 aa, Sorghum bicolor
  misc_feature: Ceres ANNOT ID no. 8724210
  misc_feature: Down-regulated in shoot tissues in response to salicylic acid treatment
  misc_feature (630)..(910): SWISSPROT Homolog: EC 2.7.11.1 Non-specific serine/threonine protein kinase
  misc_feature (201)..(532): Pfam ID: Myosin_HC-like Pfam Description: Myosin II heavy chain-like
  misc_feature (630)..(906): Pfam ID: Pkinase Pfam Description: Protein kinase domain
MADPYGDGKGPSLKNQQPRPGPRLKPAIEMEDLINLLHGSDPVRVELTRLENELQFKEKELGDAQAEIKALRLSDRAREKAVQDLTEELAKVDEKLKLTESLLESKNLEAKKINDEKKAALAAQFAAEATLRRVHAAQKDDDMPPIEAILAPLEAELKLARQEIAKLQDDNRALDRLTKSKEAALLEAERTVQMALAKASLVDDLQNKNQELMKQIEICQEENKILDRMHRQKVAEVEKLTQTVRELEESVLAGGAAANAVRDYQRKVQEMNEEMKTLDRELARAKVSANRVAVVVANEWKDGNDKVMPVKQWLEERRILQGEMQQLRDKLAIAERAARSEAQLKEKFQLRLKVLEEGLRMPTSRTNVSGTRRQSIGGADGLSKANGFLSKRPSFQMRSSVSTTTTLVNHAKGASKSFDGGCRSLERYKGLVNGNGMNISTDSSEDKESSNSDEKCNEFASAESEDSVSGVLYDMLQKEVIALRKACHEKDQSLKDKDDAVEMLAKKVDTLTKAMESDAKKSRRELAAMEKELAAVRMEKEQDNRAKRFGSSSGSGSSSQLPSGRFGCNGIRIRDSVRGAIASPNQINPSPRPPRLLFLVLRIAGRRSCRDRSRRRSTKTKVQVGGSPEYKVERKLGKGGFGHVFLGRRLTAAHAGRSAASAAQEVAIKFEHTTSKGCTYGPPAEWQVYTALGGTHGVPKVHYKGRQGDYYVMIMDMLGPSLWDSWNSLGQSMSSEMVACIAMESISILESMHSKGYVHGDVKPENFLLGQPSTPQEKKLYLVDLGLATKWRDTASGQHVGYDQRPDAFRGTVRYASVHAHLGRTASRRDDLESLAYTLVFLHRGRLPWQGYQGDNKSFLVCKRKMSTSPETLCGICPQPFKQFLEIVVNMKFDEEPNYSKLISLFDSLIGPIPSIRPINTDGAQKVGQKRARLLNDDDDHVKKKIRLGAPATQWISVYNSRQPMKQRYHYNVADARLAQHVEKGNEDGLLISSISSCSNLWAIIMDAGTGFSAQVYELSSHFLHKEWIMEQWDKSYYISSVAGSNNGSSIVVMSKGTPYTQQSYKVSDSFPFKWINKKWKEGFHVTSMATSGNRWAIVMSRSAGFSEQVVELDFLYPSEGIHRRWDNGFRITAMAATMDQSALILSKPRRRPRDETQETLRTTQFPSQHVKDKWAKNLYLAGICYGRTVA

SEQ ID NO: 21474 - DNA, 1179 bp, Sorghum bicolor
  misc_feature: Ceres ANNOT ID no. 8724344
  misc_feature: Up-regulated in root tissues in response to methyl jasmonate treatment
  misc_feature: Up-regulated in shoot tissues in response to methyl jasmonate treatment
  misc_feature: Up-regulated in shoot tissues in response to salicylic acid treatment
  misc_feature: Encodes the peptide sequence at SEQ ID NO 21475
atggcggtggaggcggcgctggcctggtacgaagagttgcgacagaaggacgagatgcagaagaagatcagtaatgagatcaaccagctcagattgagtacgaggaacaaggaattctcacaaggcttgagcaaggcggagctccggaagaagcgggccgagctcgagaaaaagtgccatgccttgtcgcagaggcactggcaggtcatttttgagacggggtcgaagccggatttctcaggcatgaccgaggccgagcgagcggagacggcggagaagctgaggagcgacgagctgcggtatgcgcgccgccttatggaagaaggcgaccccagggctctgagcattgaagcctttgttcccatcctcgacttcgatcctccacccattggtcccatgcaatttactgattccccccacaaagtaatcgagaacgactactgcaaactgtctggggctgtaaacttcttgtctgtcaagatagcctcttcagatattggcttcccgatccatgtgtatggcactgtcattgtcggggacagcatcgatgagaagtgtgtttatcacttccgccgcgaccctgaccattgccaactcatcaattctgaggctgaatcgttgatcttgactgggccgaaacgtgggctcgaattgtgtggttacatgtatgtggagattgatttaaagatcaaggatcatctaggacagcccagagaatttagtaaaggactcttaagcatcagtgacccaacaaattgtgcatcgatggtatctatggtcgaaactatatcccttgctaccaggctcagtactgtggacgtgacttatgcagttgtgaatcaggcagctgagggatttattgcagttgaagttctgcagggaggttttcatggaaaaatcactgcatacaccaccagtgtcaaggacatacttgtgctttatgacagcaaagaggctgatgctacgacctttgatgattgcggagatatcctgcagcttatgcggcctgtcgtatctgtccacgttgaggattttctgataattcttttccacaccagtgacggtaaattagagagcatacaattcactccaatgttcaacggcagagatgaaggtcaaattactgttggtgctaccaagatgcgtgtgaagcttgcttggtcggtacactacccttga

SEQ ID NO: 21475 - protein, 392 aa, Sorghum bicolor
  misc_feature: Ceres ANNOT ID no. 8724344
  misc_feature: Up-regulated in root tissues in response to methyl jasmonate treatment
  misc_feature: Up-regulated in shoot tissues in response to methyl jasmonate treatment
  misc_feature: Up-regulated in shoot tissues in response to salicylic acid treatment
MAVEAALAWYEELRQKDEMQKKISNEINQLRLSTRNKEFSQGLSKAELRKKRAELEKKCHALSQRHWQVIFETGSKPDFSGMTEAERAETAEKLRSDELRYARRLMEEGDPRALSIEAFVPILDFDPPPIGPMQFTDSPHKVIENDYCKLSGAVNFLSVKIASSDIGFPIHVYGTVIVGDSIDEKCVYHFRRDPDHCQLINSEAESLILTGPKRGLELCGYMYVEIDLKIKDHLGQPREFSKGLLSISDPTNCASMVSMVETISLATRLSTVDVTYAVVNQAAEGFIAVEVLQGGFHGKITAYTTSVKDILVLYDSKEADATTFDDCGDILQLMRPVVSVHVEDFLIILFHTSDGKLESIQFTPMFNGRDEGQITVGATKMRVKLAWSVHYP

SEQ ID NO: 21476 - DNA, 1248 bp, Sorghum bicolor
  misc_feature: Ceres ANNOT ID no. 8724350
  misc_feature: Up-regulated in root tissues in response to methyl jasmonate treatment
  misc_feature: Up-regulated in shoot tissues in response to methyl jasmonate treatment
  misc_feature: Up-regulated in shoot tissues in response to salicylic acid treatment
  misc_feature: Encodes the peptide sequence at SEQ ID NO 21477
atggcggtggaggcggcgctggcctggtacgaagagttgcgagagaaggacgatatgcaggagaagatcagtaatgagatcaaccaactctggttgggtacgaggaacaaggaattctcacaaggcttgagcaaggcggagctccggaagaagcgggccgagctcgagaaaaagtgcgatgccttgtcgcagaggtactggcaggtcgtttttgagatggggtcgaagccggatttctcaggcatgaccgaggccgagcgagcggagacggcggagaagctgaggagcgacgagctgcggtatgcgcgccgccttacggaagaaggcgaccccagggctttgagcattgaagcctttgttcccatcctcgacttcgatcctaagcaagggggtcgctactacaaccgctacaccctcgtcgacctcaccacattcgacctcgatgaagagtcacccattggtccgatgcaatttactgattccccccacaaagtaatcgagaccgaccacttcaaactgtctggggctgtaaacttcttgtctgtcaaggtagcctcttcagatattggcttcccaatccatgtgtatggcactgtcattgtcagggacagcatcgatgagaggtgtgtttatcacttccgctgcgaccctgaccattgccaactcatcaattctgaggctgaatcgttgatcttgactgggccgaaacgtgggctcgcattgtgtggttacatgtatgtggagattgatctaaagatcaaggatcatctaggacagtccagagaatttagtaaaggactcttaagcatcagtgacccaacaaattgtgcatcgatggtatctatggtcgaaactatatcccttgctaccaggctcagtactgtggatgtgacttatgcagttgtgaatcgtgcagcggagggatttattgcagttaaagttctgcagggaggtttccatggaaaaatcaccgcatacaccaccagcgtcaaggacatacttgtgctttatgacagcaaagaggctgatgctatgacctttgatgattgtggagatatcctgcagcttatgcggcctgtcgtatctgtccacgttgaggatttcctgataattgttttccacaccagtgacggtaaatcagagagcatacaattcgctccaatgttcaacggcagagacgaaggtcaaattactgttggtgctaccaagatgtgtgtgaagcttgcttggtcagtaatgaaaccttga

SEQ ID NO: 21477 - protein, 415 aa, Sorghum bicolor
  misc_feature: Ceres ANNOT ID no. 8724350
  misc_feature: Up-regulated in root tissues in response to methyl jasmonate treatment
  misc_feature: Up-regulated in shoot tissues in response to methyl jasmonate treatment
  misc_feature: Up-regulated in shoot tissues in response to salicylic acid treatment
MAVEAALAWYEELREKDDMQEKISNEINQLWLGTRNKEFSQGLSKAELRKKRAELEKKCDALSQRYWQVVFEMGSKPDFSGMTEAERAETAEKLRSDELRYARRLTEEGDPRALSIEAFVPILDFDPKQGGRYYNRYTLVDLTTFDLDEESPIGPMQFTDSPHKVIETDHFKLSGAVNFLSVKVASSDIGFPIHVYGTVIVRDSIDERCVYHFRCDPDHCQLINSEAESLILTGPKRGLALCGYMYVEIDLKIKDHLGQSREFSKGLLSISDPTNCASMVSMVETISLATRLSTVDVTYAVVNRAAEGFIAVKVLQGGFHGKITAYTTSVKDILVLYDSKEADAMTFDDCGDILQLMRPVVSVHVEDFLIIVFHTSDGKSESIQFAPMFNGRDEGQITVGATKMCVKLAWSVMKP

SEQ ID NO: 21478 - DNA, 2646 bp, Sorghum bicolor
  misc_feature: Ceres ANNOT ID no. 8724427
  misc_feature: Up-regulated in root tissues in response to aminocyclopropane carboxylic treatment
  misc_feature: Up-regulated in root tissues in response to methyl jasmonate treatment
  misc_feature: Up-regulated in shoot tissues in response to methyl jasmonate treatment
  misc_feature: Up-regulated in shoot tissues in response to salicylic acid treatment
  misc_feature: Encodes the peptide sequence at SEQ ID NO 21479
atggcggcgcagctgacgaccggcgcggtggcggcggtgtcggagcacgcggacggcaacgggacgctgcaacccgtgctgcaggtggtggacgtgcggatagtccccaacgtcaagagcgccaccaaccaagagcgcttccggatgctgctctccgacggcacccacaccatgcagtccatgctctccacctccgagaacgcgcgcatccgggacggcatcatcaagaagggctccatcgtccacctccacgagttcacctgcagcaccatccagcaccgcaggatcattatcattatcaaacttgatgttctgcaaactgagtgtgctataattggagaccctaaaccctatgatgtgagaatccaacctaataatgagcagggcaccaacattccggccaattctgctcaagctaatacaggaacatattccagcggccctggtatgctgggatcttctgctgctccaaggccaggtacggtggtccctccagttggtcgtgcagtagaatctgttcccaatgtggcatctggtgtatcttatggtacgactttggcacataataatacaatgaatgtgggcatggtgcagtcaaacttgcagcagccttcactggattctcatcagaaccaaaggtttgcagttccttccatggctggtggcagtggtgctcctgggaatacatacggccaacctgcacagtccttttatcagcaaccgcctccagggcatatgaatagaaaccctgtgtctaagaatgatgcaagtcgtcttgtcccagtggctcatttgaacccctatcaaaacacatggacaatcaaggctagggtgactgcaaaaactgatctcaggcactacaacaacaagaatggtgctggaaaagtcttctcctttgatatccttgatggacagggtggagaaatccgtgtaacatgcttcaatgcgcaggctgatcagttttttgacctcattgaggttgataaggtgtacctgatatctaaagggtcagtgaaagcagcacagaagaagtttaactctttgaatcacgagtatgaaatagctctggatttcagatcatctatcgaagtatgtgttgatgatgatagcaacatccctaggccgcattataatttccggcagataagcgaaattgagaaccttgaggcaggtactattgtggacttgattggaattgttacatcagttggcccttctggcacaataatccgaaagcttgataactcggaagtccagaaaagaaatcttcaactaaaagacatgtctggtcgaagcatagaacttaccttatggggaaagttctgtgatgctgaaggccagcagctgcagttgcagtgtgattctggtctgaatcctgttctagctttgaaaggtgctcgagttactgaattcagtggtaaatctgtcaacacaaccggctcaactcatgtaaaagtagacccagactttcctgaggctgagagtctgcggcgatggtatgcaactgaagggaagacagctgcttgtgtttctttgtcagtggtaagtatgggcaggactgatgtccggaaagcagtggctcagatcaaggatgaagatctgggtcgatcagagaagccagactttatcactgttaaaggtgcaatttcacatctgaccactgataatttttgttatcctgcttgcaccttggaggtgaacggtaaggtgtgcaacaaaaaggtaataaataatggtgatggaacatggcagtgtgacaaatgcgacaagagcttaccaaattgtgagtatagatacttgttgcagtgccaggtccaggaccacactggggtcacctatgctactgcattccaagaggctggtattgagattgttggccacagcgcctacgagctctacaacataagagaagaagacccagaaagatttgctgagatcttacagggggttcgctggcagcagtttctattcaaactgaaagtctatgaggagacctataacgatgagcaccgtgtcaagtgcaacattttgagagcggagaagctggatccagcaaaagagagttcttaccttctgggggtaatcaatggcctattgcaggatgatactggctcaccttctgaggcgcaaggccccatggcctataatgctggtcttagcaacactggcgccggacgaagcgtgccaacctccaacagtgcctacactaccaatatgagtggtcctaggtatggggagtcagcgaaccagtttgcgcagcaagcaaacacgtatattggggcgtccactccagtgtcggcgacacggaatgtgcagacctgcatgtcttgcgggtcaagtggacacaatgcgcaaaactgccctgcaggcatgtataagcagcaacctgcggcaagcacagcaagctcctatggctcttcgcaacctcgcaacactggccccagaccgtgtttcaaatgcaatcagatcgggcactttgcggactcttgcccacttctggcccctgctccccagcagcagcagcagcagtatcggagcggtggcgcttcatcaggtggttatggtcagcagcagtatcggagcggcggcgcttcgtcaggtggttatggtcagcagcagtcctatcttggagctaccaactactga

SEQ ID NO: 21479 - protein, 881 aa, Sorghum bicolor
  misc_feature: Ceres ANNOT ID no. 8724427
  misc_feature: Up-regulated in root tissues in response to aminocyclopropane carboxylic treatment
  misc_feature: Up-regulated in root tissues in response to methyl jasmonate treatment
  misc_feature: Up-regulated in shoot tissues in response to methyl jasmonate treatment
  misc_feature: Up-regulated in shoot tissues in response to salicylic acid treatment
  misc_feature (542)..(691): Pfam ID: Rep_fac-A_C Pfam Description: Replication factor-A C terminal domain
  misc_feature (4)..(107): Pfam ID: Rep-A_N Pfam Description: Replication factor-A protein 1, N-terminal domain
  misc_feature (815)..(832): Pfam ID: zf-CCHC Pfam Description: Zinc knuckle
  misc_feature (272)..(356): Pfam ID: tRNA_anti Pfam Description: OB-fold nucleic acid binding domain
MAAQLTTGAVAAVSEHADGNGTLQPVLQVVDVRIVPNVKSATNQERFRMLLSDGTHTMQSMLSTSENARIRDGIIKKGSIVHLHEFTCSTIQHRRIIIIIKLDVLQTECAIIGDPKPYDVRIQPNNEQGTNIPANSAQANTGTYSSGPGMLGSSAAPRPGTVVPPVGRAVESVPNVASGVSYGTTLAHNNTMNVGMVQSNLQQPSLDSHQNQRFAVPSMAGGSGAPGNTYGQPAQSFYQQPPPGHMNRNPVSKNDASRLVPVAHLNPYQNTWTIKARVTAKTDLRHYNNKNGAGKVFSFDILDGQGGEIRVTCFNAQADQFFDLIEVDKVYLISKGSVKAAQKKFNSLNHEYEIALDFRSSIEVCVDDDSNIPRPHYNFRQISEIENLEAGTIVDLIGIVTSVGPSGTIIRKLDNSEVQKRNLQLKDMSGRSIELTLWGKFCDAEGQQLQLQCDSGLNPVLALKGARVTEFSGKSVNTTGSTHVKVDPDFPEAESLRRWYATEGKTAACVSLSVVSMGRTDVRKAVAQIKDEDLGRSEKPDFITVKGAISHLTTDNFCYPACTLEVNGKVCNKKVINNGDGTWQCDKCDKSLPNCEYRYLLQCQVQDHTGVTYATAFQEAGIEIVGHSAYELYNIREEDPERFAEILQGVRWQQFLFKLKVYEETYNDEHRVKCNILRAEKLDPAKESSYLLGVINGLLQDDTGSPSEAQGPMAYNAGLSNTGAGRSVPTSNSAYTTNMSGPRYGESANQFAQQANTYIGASTPVSATRNVQTCMSCGSSGHNAQNCPAGMYKQQPAASTASSYGSSQPRNTGPRPCFKCNQIGHFADSCPLLAPAPQQQQQQYRSGGASSGGYGQQQYRSGGASSGGYGQQQSYLGATNY

SEQ ID NO: 21480 - DNA, 1398 bp, Sorghum bicolor
  misc_feature: Ceres ANNOT ID no. 8724456
  misc_feature: Down-regulated in root tissues in response to salicylic acid treatment
  misc_feature: Encodes the peptide sequence at SEQ ID NO 21481
atggggcacggcgtcagctgcgcccgcaccggcgacgagcacgactacttccgcgcggcgcaggtcggggacctcgacgccctgggcgcgctcctcgccgctgacccctccctcgcccgccgcgccaccctctacgaccgcctctccgcgctccacatcgccgccgcgaatggccgcctcgaggtgctgtccatggtcctggatcacggggtgccgccggacgcggtgaatcggcacaagcagactccgctgatgcttgcggcgatgcacggcaagatcgactgcgtgctcaagctcctgcaggccggcgccaatatcctgatgttcgactccctgcacgggcggtcctgcctgcaccacgcgtcctacttcggcaacgtcgactgcctgcaggccatcctcacggcggcgcggaccacgccggtggccgactcatggggtttcgcccggttcgtcaacgtcagggacgaccacggcgccacgccgctgcacctcgccgccaggcagggccgacccggctgcgtgcaggtgctgctggagaacggcgccattgtctccgccctcaccggctcctacgggttccccggcagcacgtcgctgcatctggccgctcgcagcgggaacctggattgcatccggaagctgctcgcctggggcgcagatcgtctccagagggactcagcagggaggattccatatgccgttgcgctgaagcgcaatcacgaggcgtgtgcggcgctgctgaacccttcgtcggcagagcccatggtgtggccttccccgctcaagttcatcagcgagctagacccggaggcgaaggctctcctggaagcggcactgatggaagccaacagggagagggagaagaagatcctgaagggcacaaagtattctccgccatcatcgccaccttccacttgcgagcatgagattgatgccgatgccattgatgatgtgtcgtcagagacgagcgacacggagctgtgctgcatctgcttcgaccaggcgtgcacgatcgaggtgcaagactgcggtcaccagatgtgcgcgccatgcacactagccctgtgctgccacagcaagcccaacccgacgacgctgacactgccgtcgccggcctgcccattctgccgcggcaacatctcacggctactggtggcccgagcaagcaccgcgtcgttggacgccgacaccgacaaggctgctgcggcggcggcctcctcacctcagctggtccggcggcggtcccggcggtctcacaacctcagtgacggcgggagcagcagcttcaaggggctgtcgtccgccgtggccgggtccttctccaagatcgggcgcgggtcgagccggatggccgacagcgacaatggcatggacaagcccgagcacgacctgtga

SEQ ID NO: 21481 - protein, 465 aa, Sorghum bicolor
  misc_feature: Ceres ANNOT ID no. 8724456
  misc_feature: Down-regulated in root tissues in response to salicylic acid treatment
  misc_feature (47)..(255): SWISSPROT Homolog: EC 2.4.2.30 NAD(+) ADP-ribosyltransferase
  misc_feature (158)..(190): Pfam ID: Ank Pfam Description: Ankyrin repeat
  misc_feature (79)..(111): Pfam ID: Ank Pfam Description: Ankyrin repeat
  misc_feature (46)..(78): Pfam ID: Ank Pfam Description: Ankyrin repeat
  misc_feature (195)..(227): Pfam ID: Ank Pfam Description: Ankyrin repeat
MGHGVSCARTGDEHDYFRAAQVGDLDALGALLAADPSLARRATLYDRLSALHIAAANGRLEVLSMVLDHGVPPDAVNRHKQTPLMLAAMHGKIDCVLKLLQAGANILMFDSLHGRSCLHHASYFGNVDCLQAILTAARTTPVADSWGFARFVNVRDDHGATPLHLAARQGRPGCVQVLLENGAIVSALTGSYGFPGSTSLHLAARSGNLDCIRKLLAWGADRLQRDSAGRIPYAVALKRNHEACAALLNPSSAEPMVWPSPLKFISELDPEAKALLEAALMEANREREKKILKGTKYSPPSSPPSTCEHEIDADAIDDVSSETSDTELCCICFDQACTIEVQDCGHQMCAPCTLALCCHSKPNPTTLTLPSPACPFCRGNISRLLVARASTASLDADTDKAAAAAASSPQLVRRRSRRSHNLSDGGSSSFKGLSSAVAGSFSKIGRGSSRMADSDNGMDKPEHDL

SEQ ID NO: 21482 - DNA, 1281 bp, Sorghum bicolor
  misc_feature: Ceres ANNOT ID no. 8724476
  misc_feature: Down-regulated in shoot tissues in response to salicylic acid treatment
  misc_feature: Encodes the peptide sequence at SEQ ID NO 21483
atggcggcggccgccgtgggaggcgacgacgccgtcgtcatgcagctggccgccgccgagggcgaggagactgtcatcaccgtcaactgccccgaccaggctggcctcggctgcgacctctgccgcaccatcctcgagttcggcctccgcatcacccgcggcgacgtgtctacggacggacactggtgcttcgtggtgttctgggtggtgccccgctcctcgtccatcaaaatccggtgggcgagcctcaagaaccggctcatgtcaatgtgcccttcctcctactccatcccgttctacccggacatcagccagccaggtccctcgcagtactacctcctgaagctcttgtcgccagaccgcaaagggttgctgcatgatgtgacgcacatactatcagatttagagcttataatccacagagtgaaggtgtgtaccacaccggatggaagagttgtggacctcttctttatcaccgacggcatggaactgctgcacaaaaaggaaaggcaagaggagacttgctcgacgttaattgctaccctgggtccttccataagctgtgaggttctgtcagcagaagggttccagcagggattctcttctcttccaccgaaaattgctgaggaactcttcagggtggaactagctgacagcgagatctgctcgagttcgcttagcgtggagttgaagaaggttcagacggccactattaactttgacaattccctgagccctgcacacacgctagttcaaattatctgtgctgatcagaaggggctcatttacgacatattgaggacgatgaaggactgcaacattcagatattttacgggcggttcagatcagacaagaaagggtcagtcagtaaaggttgtcgagaggttgacctttttgttaaacaagtagatggcaaaaaggttatggatcctgagaaacaggatgctctgcggtcgcgcctgagatctgagatgctccatcctcttagggttatgattgtcagtcgtggacctgatacagaactccttgttgccaacccagttgagctctctgggaagggacggccacgcgtattctacgatgctactcttgctttgaaagcacttgggatctgcatcttctctgctgaaattgggagacaagcagcatccgagcgccaatgggaggtctacaggttcctcctggatgacagcaaagagttccccttggcaaacagcctcactaacaggaaccgtgttgtcgatagggtaaggaagacactgatgggatgttacaactaa

SEQ ID NO: 21483 - protein, 426 aa, Sorghum bicolor
  misc_feature: Ceres ANNOT ID no. 8724476
  misc_feature: Down-regulated in shoot tissues in response to salicylic acid treatment
  misc_feature (112)..(176): Pfam ID: ACT Pfam Description: ACT domain
MAAAAVGGDDAVVMQLAAAEGEETVITVNCPDQAGLGCDLCRTILEFGLRITRGDVSTDGHWCFVVFWVVPRSSSIKIRWASLKNRLMSMCPSSYSIPFYPDISQPGPSQYYLLKLLSPDRKGLLHDVTHILSDLELIIHRVKVCTTPDGRVVDLFFITDGMELLHKKERQEETCSTLIATLGPSISCEVLSAEGFQQGFSSLPPKIAEELFRVELADSEICSSSLSVELKKVQTATINFDNSLSPAHTLVQIICADQKGLIYDILRTMKDCNIQIFYGRFRSDKKGSVSKGCREVDLFVKQVDGKKVMDPEKQDALRSRLRSEMLHPLRVMIVSRGPDTELLVANPVELSGKGRPRVFYDATLALKALGICIFSAEIGRQAASERQWEVYRFLLDDSKEFPLANSLTNRNRVVDRVRKTLMGCYN

SEQ ID NO: 21484 - DNA, 1902 bp, Sorghum bicolor
  misc_feature: Ceres ANNOT ID no. 8724549
  misc_feature: Up-regulated in shoot tissues in response to salicylic acid treatment
  misc_feature: Encodes the peptide sequence at SEQ ID NO 21485
atgctgcctccaaaccccatctacgtagcggtagcactagctgctgcgctcatcttcttctcttcgctgcacacttcagctgctgctgacggcgacactctcgcggcaggccaggcgctcgccgccggtgacaagctcgtctcccgcaacggcaagttcgcgctcggcttcttccagttccggcaaaccctgccaggcggtggcagcgacgacggcatcaccaacagcacaataatctcttcccccggctggtaccttggcgtatggttcaacaagatcccggtctgcaccccggtctggatcgccaaccgggacagacccatcactgagtccgagctcaaggtatcccagctcagaatctcaacatcagacggcaacaagctcatcgtcaccaacaacaccagcactgatgaatccccaatctggtcctcagctgtgactgtgactgtcaccaacagcaccacaaacgctagcagcgtccatgccgtcctcatgaacaccggcaaccttgccctgctaccagcagaaaccatatcggcatccactgcagcagcacccaccagcagctcctacttgtggcaaagcttcgactacccaacggacgtcggccttcccggcgccaagatcggctggaacaaggtcgccggcggcaagccggatttcgaccgccagttcatctccaagaagagcctcatcgatccgagtcccggctcatactccatcaacatcgatcccaacgggttcatgcagctcacaactcgcaacgccccgttcgtgacgtactggtcatggacgtccgggagactagaggagctcgtgccggcgctgactgctctgatcaacatggatctgaggaccaagggactgctggtaccggactacgtcgaaaccgccgacgaggtgtactttacctacagtatcaccaacgagtcggcctccgtgttcgtccccatcgacatcaccggccagctcaagctgatgctctggtcggaagccaagcagtcttgggagaccatctacgcccagccttctgatttctgcctcacgtttggcgtttgtggacctttcacggtctgcaatggcaattcaggttcaggcacgtcgtcgagctgtggatgcatggagacattctctctgacgtcgcctcgggattgggggcttagtgatctgacaggagggtgtgcaagaagaactcccttggactgcaaaggtagcaccaacagaagcagttcatcatcaggttcgacagatgtgttccaccctatagctcaagtggcgttgccctataatccccggggaatagaaggcgccgccgcacaaagcgattgcgcagaagcttgccttggggattgcaattgcactgcttattcctatagcaataatggtaaatgctctgtctggcatggggacctgcttagcgtaaacaaggccgacaacaattctattagctctcaagatgttctttaccttcgccttgccaaaagtgattttcagagtttgaacaaaaccaacaagaaaacaccagctgttgctattgctgcaagtgctgttggttctggattactagtgctcatgctagtgtttctgatttggaggaatagattcaggtggtgcaatgctcacagcatccaagatggtggtggtggaattatagcctttaaatacactgatttgtctcgtgctactaagaatttcagtgagaggattggaggaggtggttttggttctgtgttcaagggagtgctaagtgactcaaccgctatcgcagtgaaaagacttgatgatgcccgccaaggagagaagcagtttcgtgctgaggtgagctcgattggaatgatccaacatattaatcttgtcaaattgattggtttctgctgcgaaggtgataagagctactcgtga

SEQ ID NO: 21485 - protein, 633 aa, Sorghum bicolor
  misc_feature: Ceres ANNOT ID no. 8724549
  misc_feature: Up-regulated in shoot tissues in response to salicylic acid treatment
  misc_feature (544)..(630): SWISSPROT Homolog: EC 2.7.11.1 Non-specific serine/threonine protein kinase
  misc_feature (402)..(474): Pfam ID: PAN_2 Pfam Description: PAN-like domain
  misc_feature (95)..(235): Pfam ID: B_lectin Pfam Description: D-mannose binding lectin
  misc_feature (249)..(385): Pfam ID: S_locus_glycop Pfam Description: S-locus glycoprotein family
MLPPNPIYVAVALAAALIFFSSLHTSAAADGDTLAAGQALAAGDKLVSRNGKFALGFFQFRQTLPGGGSDDGITNSTIISSPGWYLGVWFNKIPVCTPVWIANRDRPITESELKVSQLRISTSDGNKLIVTNNTSTDESPIWSSAVTVTVTNSTTNASSVHAVLMNTGNLALLPAETISASTAAAPTSSSYLWQSFDYPTDVGLPGAKIGWNKVAGGKPDFDRQFISKKSLIDPSPGSYSINIDPNGFMQLTTRNAPFVTYWSWTSGRLEELVPALTALINMDLRTKGLLVPDYVETADEVYFTYSITNESASVFVPIDITGQLKLMLWSEAKQSWETIYAQPSDFCLTFGVCGPFTVCNGNSGSGTSSSCGCMETFSLTSPRDWGLSDLTGGCARRTPLDCKGSTNRSSSSSGSTDVFHPIAQVALPYNPRGIEGAAAQSDCAEACLGDCNCTAYSYSNNGKCSVWHGDLLSVNKADNNSISSQDVLYLRLAKSDFQSLNKTNKKTPAVAIAASAVGSGLLVLMLVFLIWRNRFRWCNAHSIQDGGGGIIAFKYTDLSRATKNFSERIGGGGFGSVFKGVLSDSTAIAVKRLDDARQGEKQFRAEVSSIGMIQHINLVKLIGFCCEGDKSYS

SEQ ID NO: 21486 - DNA, 2718 bp, Sorghum bicolor
  misc_feature: Ceres ANNOT ID no. 8724654
  misc_feature: Down-regulated in shoot tissues in response to methyl jasmonate treatment
  misc_feature: Down-regulated in shoot tissues in response to salicylic acid treatment
  misc_feature: Encodes the peptide sequence at SEQ ID NO 21487
atgtcggacctcgcttccacctgcaaggataaacttgcgtattttagaataaaggagctcaaggatatcttaaatcagctggggttaccgaagcaaggaaagaagcaggaccttgttgacagggtattggcaatattatcagacgagcaaggtcaacgccatcatggatggggaaggagaaatgctgttacaagggagacagtggcaaaagttgttgatgaaacatacaggaaaatgcaagtatgtcctcctgaccttccctccaggagccacagtggatcagatttcaatcatttcaggcccaaagaggaatccactgacttctaccatgtagagactaaggtccgctgcctttgcaatagcacaatgctaaatgacaatatgatcaagtgcgaagatggcaaatgccaggtgtggcagcatattacctgcgtactcattccagataagcccacggagggtggtggccctgatattccacctcatttttattgtgaattgtgccgactgaaccgggcagacccgttttgggtgactacaggaaatccattactacctgtgaaatttatgtcatctggtgttggaaatgatggagcaagtgtacctcaaattgtggagaagaccttccagctttcccgagcagatagagaaacagtccagagacctgaatacgatctccaggtttggtgcattcttataaatgacaaagtccagttcaggatgcaatggcctcaatatgcagaattgcaagtgaatggtattcctgtacgagtaatgaccaggcctggttctcagttactagggataaatgggcgggatgatggaccactggtaaccacatgcagtagagaagggatcaataaaattagcttatcaagagttgatgcccgaaccttttgctttggagttcgaattgttaggaggaggactgttcctcaggtattaaacttgatcccaaaggaaggtgaaggggagtcttttgaggatgctcttgctcgtgtccgtcgctgtcttgggggtggaggtgctacagacaatgctgatagtgatagcgatctggaagtggttactgaatctgttacagtcaaccttcgttgccctaatagtggatccagaatgaggattgctggaaggttcaagccttgtgttcacatgggctgttttgatcttgaaacttttgtggaattgaatcaacgctcacgcaagtggcaatgcccaatatgtttaaagaattactctctcgagaacttgatgatcgatgcttatttcaatcggattacttctttgttgcaaaattgcagtgaagatgttaatgagcttgatgttaaacctgatgggtcttggcgtgtgaagggtgatgccgctaccagagatctatctcagtggcatatgcctgatggtactctttgtgactcaaaggaagatacaaaccctggtgtcacaagtgttaatgagttcaagagagagggtacttctgatggacatagaactttgaaaattaaaaaaaaccctaatggatcatggcaggttagcagtaaagcagatgataaaaaacctgtggttagacatcacatccaaaacaacaatgggttctcaacaccaaacatgcctattatcagtagccccactgggagttatcgagatggcgaagatgcaagtgtgaaccaagaagggggtggtattcaatttgatatagcattgaaccaagagtttgacagttttgcacataactttggtcagacatacaatacagaggatagacaacagccacaacataatgctgcagatgtcattgttcttagtgattctgatgaagaaaatgacccgattgttcgcccgccagctgtctatgcaaatgcaactacaaatggtgacagttttcctttcgtcactgatgctgctggaactggatatcctgaaaggtaccaggaggatgctggcgttggtacaagtggccttggtttattgaacaacaatactggtgattttgaaataaataactggcaaatgcattcttatccacaaccggagcaagggttccagttttttgggactgatactgatgttggcaatccttttgttggtccacataattccttcaatattgcaccagaagactactcgcttgactgtaatgttggcatagaggatccctctgcagctcacgatgtttcaatttgccgaaacagtaatgatgtgcatggaagcttggttgataacccattggctttagcaggcgacgatccatctttgcaaatttttcttccaagtcaaccttccactgttccccttcaggaagaattgagtgagcgtgctaatactccaaatggagtccaccctgacgattggaggatatctcttacgcttgcggccggtggagggggtaatgaagagtctacaagtgttgatggtctaaaatcacagccaaaagttccatcgaaagaggcaggagtcgaacctttgcttgatgctgcttctgctctcccaagcatgaacagatgtaatggatctaatctaaatccaagaaggattgaaaatatattttctcaccctcgccaaccgcgcgcttataataaactagagggcgacaggaaattgtggtccaatatttggaactgccaaataccatccaaggtgagaattttcacatggaaacttgggcgtgacattctgccaacaaagcaaaaaaaaattagaagaaatctggaatatctctag

SEQ ID NO: 21487 - protein, 905 aa, Sorghum bicolor
  misc_feature: Ceres ANNOT ID no. 8724654
  misc_feature: Down-regulated in shoot tissues in response to methyl jasmonate treatment
  misc_feature: Down-regulated in shoot tissues in response to salicylic acid treatment
  misc_feature (362)..(411): Pfam ID: zf-MIZ Pfam Description: MIZ/SP-RING zinc finger
  misc_feature (12)..(46): Pfam ID: SAP Pfam Description: SAP domain
  misc_feature (116)..(171): Pfam ID: PHD Pfam Description: PHD-finger
MSDLASTCKDKLAYFRIKELKDILNQLGLPKQGKKQDLVDRVLAILSDEQGQRHHGWGRRNAVTRETVAKVVDETYRKMQVCPPDLPSRSHSGSDFNHFRPKEESTDFYHVETKVRCLCNSTMLNDNMIKCEDGKCQVWQHITCVLIPDKPTEGGGPDIPPHFYCELCRLNRADPFWVTTGNPLLPVKFMSSGVGNDGASVPQIVEKTFQLSRADRETVQRPEYDLQVWCILINDKVQFRMQWPQYAELQVNGIPVRVMTRPGSQLLGINGRDDGPLVTTCSREGINKISLSRVDARTFCFGVRIVRRRTVPQVLNLIPKEGEGESFEDALARVRRCLGGGGATDNADSDSDLEVVTESVTVNLRCPNSGSRMRIAGRFKPCVHMGCFDLETFVELNQRSRKWQCPICLKNYSLENLMIDAYFNRITSLLQNCSEDVNELDVKPDGSWRVKGDAATRDLSQWHMPDGTLCDSKEDTNPGVTSVNEFKREGTSDGHRTLKIKKNPNGSWQVSSKADDKKPVVRHHIQNNNGFSTPNMPIISSPTGSYRDGEDASVNQEGGGIQFDIALNQEFDSFAHNFGQTYNTEDRQQPQHNAADVIVLSDSDEENDPIVRPPAVYANATTNGDSFPFVTDAAGTGYPERYQEDAGVGTSGLGLLNNNTGDFEINNWQMHSYPQPEQGFQFFGTDTDVGNPFVGPHNSFNIAPEDYSLDCNVGIEDPSAAHDVSICRNSNDVHGSLVDNPLALAGDDPSLQIFLPSQPSTVPLQEELSERANTPNGVHPDDWRISLTLAAGGGGNEESTSVDGLKSQPKVPSKEAGVEPLLDAASALPSMNRCNGSNLNPRRIENIFSHPRQPRAYNKLEGDRKLWSNIWNCQIPSKVRIFTWKLGRDILPTKQKKIRRNLEYL

SEQ ID NO: 21488 - DNA, 1971 bp, Sorghum bicolor
  misc_feature: Ceres ANNOT ID no. 8724732
  misc_feature: Up-regulated in root tissues in response to methyl jasmonate treatment
  misc_feature: Up-regulated in shoot tissues in response to methyl jasmonate treatment
  misc_feature: Up-regulated in shoot tissues in response to salicylic acid treatment
  misc_feature: Encodes the peptide sequence at SEQ ID NO 21489
atgcaggttaagatcgaagaccatgccgaggacggcggcatagatgctgatgtcaggggcctcggggaggctgctgtggatccgctgcctggctcggtgcatgccaccttcaaggaggaggagggtgaaccgagttcttcatctggtaaactaagatcagagttcattggaatgggtttctcatccaagctggtagacaaggttctccagagacatggtgatgatgattctaacacaattttggaatctcttctgtcctattctgaccttaagcaatctggatccgagtcatcgggttctcttggaagtttatttgattctgataatgaagagaacaattcttctttagagtctaggaaagtaatcaaccaagacatcaagccagagcttgattctttctcagagaagtggtcatttttactcagaacaatgaacttttcacaacaagaagttgatttagccttcaagcaactaggtgatgaagcgccattagaacagctcgtggacttcattgtcaatgctcaatcaggagtatcgtctggaggaccggaaaatggtgatgctacaaatgaggggaagactgaattactctatggtgtgatggaaaaaacacttagcttgcttcagatgggctttaccgaggaagaggtatcatcagtgcttgagaattctgaccagagagcaactattcaggagctggctgactcaattttggcaaggcgaatagccaatagcattgagcagaaagaggtaaaaattgaatctgactttctaggcgaggcagaacctgattattcttcataccagccctcatactctgctgcaagctattatgacgatgacaacaacaatatacgggttaaaagggctaagcatgtatttatcgatgacacaggtgcctccagtagtcaccttggcaatccatggtctatggggacaagtgatatgcctgttaaggtagaacttgaggcaatgacaccaggccgccgtgcaaatgtacaaggtgaccttgctaaacccccatttttcttgtatggaaatatggtagacatcccaaaagacacatggtatcaactcacacagttcttatacaatgtggagcctgagtttgtgaacagtcagtccttctctgctctgactcgaaaggaaggttacattcacaaccttccagtggagaaaagacgtgtcgtggttccaaagtctccaatgactattgaagaagcacttccgttcaccagacagtggtggccctcttgggatacaaggaaacatatcagtgtagttactatagaggttggagagattgagcagacatgtgaaagattggggagcatggttagagagtcaagaggtgtgctttcagaagcaagacagatgcagattatacaccagtgcagggtttcaaaccttatttgggttggccagaacaagttaggccctttggagcctcgtcaagtggaaaggatactaggctacccacataaccatacaaatctgtttgaattaaaccaatctgatagatttggtgccatgaaatttgcatttcagactgatacattgtcatattttctatcagtcctgaaaggcatgtatccagatggaataagagtgctatccatctacagtggcattggaggtgcagaagtaacacttcatcggctaggcattcctttaaaatgtgtaatatctgttgaggaatctgaggtgaataggaaaattctaagaaggtggtggtcaaaaactgaacaaactggagtgctaaggcagcatccgggaatctggaagctcaaaacacacgtgattgaagacttggtgaaagagtttggtggttttgatctgattatcggtgggaattatacttcttgcaaaggtggtaatacagtaaatacgacaatgggcttggattccaaccgcttctatgagtatgcccgtgttgttaaaagagtaaggactgcagttggactcagttga

SEQ ID NO: 21489 - protein, 656 aa, Sorghum bicolor
  misc_feature: Ceres ANNOT ID no. 8724732
  misc_feature: Up-regulated in root tissues in response to methyl jasmonate treatment
  misc_feature: Up-regulated in shoot tissues in response to methyl jasmonate treatment
  misc_feature: Up-regulated in shoot tissues in response to salicylic acid treatment
MQVKIEDHAEDGGIDADVRGLGEAAVDPLPGSVHATFKEEEGEPSSSSGKLRSEFIGMGFSSKLVDKVLQRHGDDDSNTILESLLSYSDLKQSGSESSGSLGSLFDSDNEENNSSLESRKVINQDIKPELDSFSEKWSFLLRTMNFSQQEVDLAFKQLGDEAPLEQLVDFIVNAQSGVSSGGPENGDATNEGKTELLYGVMEKTLSLLQMGFTEEEVSSVLENSDQRATIQELADSILARRIANSIEQKEVKIESDFLGEAEPDYSSYQPSYSAASYYDDDNNNIRVKRAKHVFIDDTGASSSHLGNPWSMGTSDMPVKVELEAMTPGRRANVQGDLAKPPFFLYGNMVDIPKDTWYQLTQFLYNVEPEFVNSQSFSALTRKEGYIHNLPVEKRRVVVPKSPMTIEEALPFTRQWWPSWDTRKHISVVTIEVGEIEQTCERLGSMVRESRGVLSEARQMQIIHQCRVSNLIWVGQNKLGPLEPRQVERILGYPHNHTNLFELNQSDRFGAMKFAFQTDTLSYFLSVLKGMYPDGIRVLSIYSGIGGAEVTLHRLGIPLKCVISVEESEVNRKILRRWWSKTEQTGVLRQHPGIWKLKTHVIEDLVKEFGGFDLIIGGNYTSCKGGNTVNTTMGLDSNRFYEYARVVKRVRTAVGLS

SEQ ID NO: 21490 - DNA, 2706 bp, Sorghum bicolor
  misc_feature: Ceres ANNOT ID no. 8724907
  misc_feature: Down-regulated in shoot tissues in response to salicylic acid treatment
  misc_feature: Encodes the peptide sequence at SEQ ID NO 21491
atggggacggcggggaagggtgcgtgggtggtgccggcgccggcgtacagggaggtggaggggtgggagggcgtcggggatgacgcgccgggcttcaggtgcggccactcgctcaccgccgtcgcgcccaccaagggccacggcccgcggctcatcctcttcggcggcgccaccgccatcgaggccggcgcgtcctcgggcctccccggcatcaggctcgcgggggtgacgaactcggtgcactcgtacgatgtggagaagcgcaagtggactagattacatcctgctggagagcctccatctccgagggccgcgcacgctgcagctgcagtgggcaccatggttgttttccagggtgggattggaccagcagggcactcaacagacgatctctatgtccttgacctcacaaacgacaagtttaaatggcacagggtcgttgttcaaggggcaggccctggtcctcgctatggtcactgcatggatttggtagcccagcggtatcttgtcactgtttcgggaaatgacggaaagcgggtattgtcagatgcttgggctttggacacagcacagaaaccatataggtggcagaaacttaaccctgaaggtgataaaccttcactgtatgctactgccagtgcacgctctgatggcatgcttttactttgtggtggaagggatgcttctggcacgccactttctgacgcctatggactattgatgcatacaaatggtcagtgggaatggactctagccccaggggtatctccatctccaagatatcagcatgcagccgtttttgttggtgctcggttgcatgttactggaggtgtccttagaggaggtagagctattgaaggagagggcgcaatagcagtcctggacactgctgctggagtttggttggatagaaatggcattgtgacctctcgtactttgaagtcatccaatgagcatgatgctgcttcggatctgcttcggcgctgtcggcatgctgctgcctcagttggttctcagatttacatttatggcggactcaggggagatatcctccttgatgatttcctggttgctgagaatgcacctttccaatcagaaatcacttcatctatgtacaatgttgatagagtccctaggggggaatctcaaaatagaaacaatagttttcatccagattcacctgtccatcaatctgcaaataacaggcaagagacagcttctggtttcagtgcggacaagaagtcaattgacatgttgatagaggcctcaactgcggaagctgaagctgtcagcgctgtatggcgagctgctaaggaagcatctgcagcatcttcggaagacagtctttcggagggaataggatctgagtccccactgagtgaaacttcaccaatgcctgaagatttcgatgatgggggatccctagaaccagatgtgaaactacattctagagcagttgtggttgctaaagaagcagtaggagatttaggatgcttggtcagacagctctcactggatcaatttgagaatgaaagcagacggatgcatccttcaaacaatgaccaatcttatccaggcagaagaacattaaatagacaacgatctccacaaggtttgcataagaaggttatttcgttcttacttaagccaaggaattggagagcacctgctgatagaaccttttttctggattcttacgaagttggcgagctatgctatgctgccgagcagatttttatgcaagaaccaactgttttacaattaaaagcaccaattaaagtatttggtgatcttcatgggcagtttggggacttaatgcgcctttttgatgagtatggttatccgtcaactgcaggtgacataacgtatattgattatctcttcttgggagactatgttgaccgaggtcagcatagtttggagacaataactttacttcttgctcttaaaattgagtaccctgaaaacgtacacttgatcagaggaaatcatgaagctgctgacatcaatgctctttttggcttccgtcttgaatgcattgagagaatgggtgaaagtgatgggatatgggcttggacaagattcaatcaactgttcaattatctcccacttgcggccatgatagaaaagaaaataatctgcatgcatggtggcataggaaggtcaataaacaccgtagagcaaattgagaaacttgaaaggcctatcacaatggatgttggttccattatcctcatggacctcttatggtctgatcctacagaaaatgatagtgtggagggtttgagacctaatgcacgagggcccggcttagtgacatttgggcctgatcgagtaaccgaattctgtaaacgaaacaaattgcaattgattataagagcccatgagtgtgttatggatgggtttgaacgttttgctcatggacaattgatcactttattttcagcaacaaattactgtggtactgcgaacaatgcaggggcgatacttgttgttggcaggggtttagttatcgtgccaaagttaattcatccacttccaccccctgttaattcacctgagtcctcccctgaacgtggggatgccacatggatgcagaaatttatttaccagtttcaaggtacatatggtatagccaagaagaacaaccaacaggacatcatggatacacttgtgatcagttccctggatgaggtcgaccactag

SEQ ID NO: 21491 - protein, 901 aa, Sorghum bicolor
  misc_feature: Ceres ANNOT ID no. 8724907
  misc_feature: Down-regulated in shoot tissues in response to salicylic acid treatment
  misc_feature (1)..(871): SWISSPROT Homolog: EC 3.1.3.16 Phosphoprotein phosphatase
  misc_feature (590)..(799): Pfam ID: Metallophos Pfam Description: Calcineurin-like phosphoesterase
MGTAGKGAWVVPAPAYREVEGWEGVGDDAPGFRCGHSLTAVAPTKGHGPRLILFGGATAIEAGASSGLPGIRLAGVTNSVHSYDVEKRKWTRLHPAGEPPSPRAAHAAAAVGTMVVFQGGIGPAGHSTDDLYVLDLTNDKFKWHRVVVQGAGPGPRYGHCMDLVAQRYLVTVSGNDGKRVLSDAWALDTAQKPYRWQKLNPEGDKPSLYATASARSDGMLLLCGGRDASGTPLSDAYGLLMHTNGQWEWTLAPGVSPSPRYQHAAVFVGARLHVTGGVLRGGRAIEGEGAIAVLDTAAGVWLDRNGIVTSRTLKSSNEHDAASDLLRRCRHAAASVGSQIYIYGGLRGDILLDDFLVAENAPFQSEITSSMYNVDRVPRGESQNRNNSFHPDSPVHQSANNRQETASGFSADKKSIDMLIEASTAEAEAVSAVWRAAKEASAASSEDSLSEGIGSESPLSETSPMPEDFDDGGSLEPDVKLHSRAVVVAKEAVGDLGCLVRQLSLDQFENESRRMHPSNNDQSYPGRRTLNRQRSPQGLHKKVISFLLKPRNWRAPADRTFFLDSYEVGELCYAAEQIFMQEPTVLQLKAPIKVFGDLHGQFGDLMRLFDEYGYPSTAGDITYIDYLFLGDYVDRGQHSLETITLLLALKIEYPENVHLIRGNHEAADINALFGFRLECIERMGESDGIWAWTRFNQLFNYLPLAAMIEKKIICMHGGIGRSINTVEQIEKLERPITMDVGSIILMDLLWSDPTENDSVEGLRPNARGPGLVTFGPDRVTEFCKRNKLQLIIRAHECVMDGFERFAHGQLITLFSATNYCGTANNAGAILVVGRGLVIVPKLIHPLPPPVNSPESSPERGDATWMQKFIYQFQGTYGIAKKNNQQDIMDTLVISSLDEVDH

SEQ ID NO: 21492 - DNA, 1596 bp, Sorghum bicolor
  misc_feature: Ceres ANNOT ID no. 8725019
  misc_feature: Up-regulated in root tissues in response to methyl jasmonate treatment
  misc_feature: Up-regulated in shoot tissues in response to methyl jasmonate treatment
  misc_feature: Up-regulated in root tissues in response to salicylic acid treatment
  misc_feature: Encodes the peptide sequence at SEQ ID NO 21493
atggcggcgaagaagcagctgccgcaggccgtcgcggccgcctccggccacaccaagatgggggaggagaagctgatcatccggtcggagaaggtgagctacgcgttcgtggaggccggcgaccggaccgccgccgacttcggcagcacgccgggcgactggctcgtcgcgctcacgcagctcatccagaaggcgctcgacgccgcctactacccggcgctcgtcatcggcgccgtcgtcgagttcctcctcaacttcgtcgccctcaacaatggcatactcggcatctttctcaacatcttcagatgtaagctggtgatcccacaccgtgacgcgcccaacttccggtccatgatcgggctcatcgacggcaggacggagctgaagccgctgccggccggcggcggccctgaagaccggcggctgcaggtggtgggcgtctccgccgctggcagcgacgactactacgtcgacgtggagagcggcggcggcggcggcagcagcacgggcacggcggcggtgccgctggtgcagcagcagtacgtgaacgggcggctgatccggctgcgcaccttctcggtgttcgaggtgagcatgatggccgccaagatcgcctatgagaacgccgcctacatcgagaacgtcgtcaacaacgtctggaagttccacttcgtggggttctacaactgctggaacaagttcgtgggggaccacacgacgcaggcgtttgtgttcaccgacaaagcgaacgacgcgagcgtgatagtggtatcattccgtggcacggagcccttcaacatgcgtgactggtccacggacgtgaacctgtcatggctaggcatgggcgttctgggccacgtccacgtcggcttcctcaaggctctcggcctccaggaggaagacggcaaggacgccgccaaggcgttcccgaaagccgcgccgaacgccgtcgccggcaagcccttagcctactacacgctccgcgaggagctccgcgcgcagctgaagaagcacccgaacgccaacgtggtgatcacgggccacagcctgggcggcgcgctggcggcgatcttcccggcgctgctggcgttccacggcgagcgcgacatcctggacaggctcctgtccgtggtcacctacgggcagcctcgcgtcggcgacaaggtgttcgcggcgtacgtgcgcgggaacgtgcccgtggagccgctccgcgtggtgtaccgctacgacgtcgtgccccgggtgcccttcgacgcgccgcccgtcgccgagttcgcgcacggcgggacatgcgtctacttcgacgggtggtacaagggacgggagatcgccaacggcggcgacgcgccgaacccgaactacttcaacccgaggtacctgctgtccatgtatgggaatgcgtggggggatctgttcaagggcgcgttcctgtggaccaaggagggcaaggattacagggagggcgccgtctcgttgctctaccgtgccactggactgctcgtgcccggcatcgcgtcgcatagccctagggactacgtcaacgccgtccgcctcggcagcgtcgtcgtcgccggcaaggaggaggaggtcgtctga

SEQ ID NO: 21493 - protein, 531 aa, Sorghum bicolor
  misc_feature: Ceres ANNOT ID no. 8725019
  misc_feature: Up-regulated in root tissues in response to methyl jasmonate treatment
  misc_feature: Up-regulated in shoot tissues in response to methyl jasmonate treatment
  misc_feature: Up-regulated in root tissues in response to salicylic acid treatment
  misc_feature (326)..(394): SWISSPROT Homolog: EC 3.1.1.3 Triacylglycerol lipase
  misc_feature (256)..(420): Pfam ID: Lipase_3 Pfam Description: Lipase (class 3)
MAAKKQLPQAVAAASGHTKMGEEKLIIRSEKVSYAFVEAGDRTAADFGSTPGDWLVALTQLIQKALDAAYYPALVIGAVVEFLLNFVALNNGILGIFLNIFRCKLVIPHRDAPNFRSMIGLIDGRTELKPLPAGGGPEDRRLQVVGVSAAGSDDYYVDVESGGGGGSSTGTAAVPLVQQQYVNGRLIRLRTFSVFEVSMMAAKIAYENAAYIENVVNNVWKFHFVGFYNCWNKFVGDHTTQAFVFTDKANDASVIVVSFRGTEPFNMRDWSTDVNLSWLGMGVLGHVHVGFLKALGLQEEDGKDAAKAFPKAAPNAVAGKPLAYYTLREELRAQLKKHPNANVVITGHSLGGALAAIFPALLAFHGERDILDRLLSVVTYGQPRVGDKVFAAYVRGNVPVEPLRVVYRYDVVPRVPFDAPPVAEFAHGGTCVYFDGWYKGREIANGGDAPNPNYFNPRYLLSMYGNAWGDLFKGAFLWTKEGKDYREGAVSLLYRATGLLVPGIASHSPRDYVNAVRLGSVVVAGKEEEVV

SEQ ID NO: 21494 - DNA, 2571 bp, Sorghum bicolor
  misc_feature: Ceres ANNOT ID no. 8725015
  misc_feature: Up-regulated in root tissues in response to salicylic acid treatment
  misc_feature: Encodes the peptide sequence at SEQ ID NO 21495
atgaagggcgtcgacgatgcgttcctcggcgtcggcgacaagccagggctggacatttggtgcattgttgggagcagtctggtcccggttgcaaaaccccagcacggcaagttctacaccggcagcacctacatcatactgaatacaaccgagctgaaatccggggctcgtcgacacaatgtgcattactgggttggggaggaggccaaagaggacgattgcctcatggcctcagacaaggctgttgagttggacgcggcactgggctccagcacggtccagtacagggaaacacagggtgaagaatctgacaagttcttgtcatacttcaaaccgtgtgtcatcccagtacaaggctgcttcttttcacacctgaaaggatctggtgatagatccaacgcgaccacgatgtttagatgccaaggagagcacattgctcgcgtcacacaaattccatttacgcggtcctctctggatcacaaatcggtttttatagtggacacgccgtcgaagatcttccttttcagtggctgtaattctagtttgcaaacaagggcgaaagcgttggatgttgttaagcatctgaaggagaaccgacacttgggcagatgtgagatcgcggcaatagaggatggaaagcttgttggtgattctgatgctggtgagttctggaacctgtttggaggctatgcacctattcctcgtgatttacctgacacagtcaaggaagagccactgactgcaccatccaagaaacttttttggatcaataagagaaaccttgttccattggaggcacatttgttggatagagaaatgctgaactcagacagaagttacatgctggactgtagcactgaaatattcttatggatggggatgacaacactagtttcggagaggaagtcatctgttactgtcttagaagattatatgcactcccagggcaggtcattcaatgttcgcacatttataatgacagaaggtcatgaaactgttgactttaagctgcactttcagcattggcccaggaatgttgaactaaagttatatgaggctggccgagagaaagtggcagctattttcaagcatcagggttatgatgtcacagaaattccagaggataaacctcagcagctcatcagttgtaatggcagtctgaaggtgtggttggtggaccatggctgtacaaacctccttagcactgaggaccaggagcagttgtacactggagactgttatatcatacggtacagctatgttgaagatggaaaagattaccatcttttctttgcttggtctggtaagaatagtgtaaaggacgatagcatgttggcaacatcgttaatgtctagcatggctgattcagtcaaagggcatccagttgtggcaaaagttttcgagggcagagaaccagaattgtttttctcggtgttcaagtcactaatcatattcaaggggggcaggagtgctgcatataagagttctgttctacagaaaaatcctagaaatggatatcatcagaaggaaggagtcgccctgttccgtgttcaaggccttaaacatgattgtgtgcaagccattcaagttgatctggctgcaagttcacttaattcctcgcactgttatattttggaagacaatggtttgttccttacctggttaggaagcctctcttcaccaaacgatcataatattcttgacttgatgatgaacaagttgtgtgtaaggagaatacggcatgcaaatccttcttttcttctcagtgaatcgccaatgaaacagtccttgctagtcagagaaggctctgagccggatcacttctggatagctttgggaggacgatcagagtactcgaaagaaaagcgcgtgaagggttggccagcagatccacatctgtatgcttgtagatttgaacaaggtttgctcaaggtcaaggaggtattcagcttctgtcaggatgacctggcaactgaagcgacattgattctggactgcgatgaagaaatctacgtttgggttgggctacactcagacattacatccaaggagcaagccctgaatattggcaagatgttccttcaggatggcatttttcacagtggaagatcgattgaaacgacggtgtatacagtcacagaaggggacgagcctgtatttttcaccaatttcttcaacaactgggacaattccaagcaatcatctatggttggcaactcatttgagaggaagctggccgtcctgaaaggagtctctccaaaactagagacaccggacagaagcatgcgcaggccgccatcgaggaggcccggggtatcgtcggagccgaccacgccggagcaccaacaccagcagccgacggcgaggagggcctttggctccgcgtctgccgggaggtttggcagggagcgctcaccagctgccgcaccgccaatgtcatcgccatctcccaaaagccgctcgacgtcgtccacgcccaccgcggtggcacggcggctcttccctgcctcggtgcacgcatcggaggccgtgcacgtcgtctccacggggacgacagctcgacgacggtga

SEQ ID NO: 21495 - protein, 856 aa, Sorghum bicolor
  misc_feature: Ceres ANNOT ID no. 8725015
  misc_feature: Up-regulated in root tissues in response to salicylic acid treatment
  misc_feature (24)..(107): Pfam ID: Gelsolin Pfam Description: Gelsolin repeat
  misc_feature (260)..(336): Pfam ID: Gelsolin Pfam Description: Gelsolin repeat
  misc_feature (144)..(224): Pfam ID: Gelsolin Pfam Description: Gelsolin repeat
MKGVDDAFLGVGDKPGLDIWCIVGSSLVPVAKPQHGKFYTGSTYIILNTTELKSGARRHNVHYWVGEEAKEDDCLMASDKAVELDAALGSSTVQYRETQGEESDKFLSYFKPCVIPVQGCFFSHLKGSGDRSNATTMFRCQGEHIARVTQIPFTRSSLDHKSVFIVDTPSKIFLFSGCNSSLQTRAKALDVVKHLKENRHLGRCEIAAIEDGKLVGDSDAGEFWNLFGGYAPIPRDLPDTVKEEPLTAPSKKLFWINKRNLVPLEAHLLDREMLNSDRSYMLDCSTEIFLWMGMTTLVSERKSSVTVLEDYMHSQGRSFNVRTFIMTEGHETVDFKLHFQHWPRNVELKLYEAGREKVAAIFKHQGYDVTEIPEDKPQQLISCNGSLKVWLVDHGCTNLLSTEDQEQLYTGDCYIIRYSYVEDGKDYHLFFAWSGKNSVKDDSMLATSLMSSMADSVKGHPVVAKVFEGREPELFFSVFKSLIIFKGGRSAAYKSSVLQKNPRNGYHQKEGVALFRVQGLKHDCVQAIQVDLAASSLNSSHCYILEDNGLFLTWLGSLSSPNDHNILDLMMNKLCVRRIRHANPSFLLSESPMKQSLLVREGSEPDHFWIALGGRSEYSKEKRVKGWPADPHLYACRFEQGLLKVKEVFSFCQDDLATEATLILDCDEEIYVWVGLHSDITSKEQALNIGKMFLQDGIFHSGRSIETTVYTVTEGDEPVFFTNFFNNWDNSKQSSMVGNSFERKLAVLKGVSPKLETPDRSMRRPPSRRPGVSSEPTTPEHQHQQPTARRAFGSASAGRFGRERSPAAAPPMSSPSPKSRSTSSTPTAVARRLFPASVHASEAVHVVSTGTTARRR

SEQ ID NO: 21496 - DNA, 1104 bp, Sorghum bicolor
  misc_feature: Ceres ANNOT ID no. 8725118
  misc_feature: Down-regulated in root tissues in response to salicylic acid treatment
  misc_feature: Up-regulated in root tissues in response to salicylic acid treatment
  misc_feature: Encodes the peptide sequence at SEQ ID NO 21497
atggcgtcccctcagatctcccgcagagccctgggcctcctgctcgtcctcgccaccgctgccgccgcggtcgtctcgccggccgccgccgacgatgtggtggccctgacggaagccgacttcgagaaggaggtcggccaggaccgcggtgctctcgtcgagttctacgcgccatggtgcggccactgcaaaaagcttgcccccgagtatgaaaaacttggtgcaagcttcaagaaggctaaatctgtattaatcgcaaaggttgactgcgatgagcacaagggtttgtgcagcaagtatggagtttctgggtaccccacaattcaatggtttcccaaaggttccttggagccgaagaagtatgagggtcagcgttctgtggaagcccttgcagaatatgttaacagtgaagcaggtaccaatgtcaagatagttgccattccttcaagcgtcgtggttctgactccagagacttttgactctattgtccttgatgaaaccaaagatgtccttgttgagttctatgccccatggtgtggtcactgcaagcatcttgctccggtttatgagaagctggcttcagttttcaagcaggatgacggtgttgtgattgccaatcttgatgctgacaagcacactgacttggctgaaaagtatggtgtttctggtttccctacattgaagttcttccctaagggaaacaaggctggtgaagattatgatggtggcagggacttggatgattttgtcaagttcattaatgagaagtgtggcaccagccgggattcaaagggccaactgaattcagaggctgggcttgtggcaagcttgaatcctcttgtgaaggagtttctcaatgctgctgctgacaaacggaaggaagtcatctctaaaatagaagaggatgttgctaagctcagcggttctgctgccaagcacggaaagatatatgtgacagctgcaaagaagattatggacaagggctctgactacactaagaaggagactgagaggcttcaccgcttgctggagaagtcgatcagtccttccaaagctgatgaattcatcattaagaagaacattctttcgacattctcttcttga

SEQ ID NO: 21497 - protein, 367 aa, Sorghum bicolor
  misc_feature: Ceres ANNOT ID no. 8725118
  misc_feature: Down-regulated in root tissues in response to salicylic acid treatment
  misc_feature: Up-regulated in root tissues in response to salicylic acid treatment
  misc_feature (49)..(365): SWISSPROT Homolog: EC 5.3.4.1 Protein disulfide-isomerase
  misc_feature (150)..(256): Pfam ID: Thioredoxin Pfam Description: Thioredoxin
  misc_feature (32)..(137): Pfam ID: Thioredoxin Pfam Description: Thioredoxin
  misc_feature (272)..(366): Pfam ID: ERp29 Pfam Description: Endoplasmic reticulum protein ERp29, C-terminal domain
MASPQISRRALGLLLVLATAAAAVVSPAAADDVVALTEADFEKEVGQDRGALVEFYAPWCGHCKKLAPEYEKLGASFKKAKSVLIAKVDCDEHKGLCSKYGVSGYPTIQWFPKGSLEPKKYEGQRSVEALAEYVNSEAGTNVKIVAIPSSVVVLTPETFDSIVLDETKDVLVEFYAPWCGHCKHLAPVYEKLASVFKQDDGVVIANLDADKHTDLAEKYGVSGFPTLKFFPKGNKAGEDYDGGRDLDDFVKFINEKCGTSRDSKGQLNSEAGLVASLNPLVKEFLNAAADKRKEVISKIEEDVAKLSGSAAKHGKIYVTAAKKIMDKGSDYTKKETERLHRLLEKSISPSKADEFIIKKNILSTFSS

SEQ ID NO: 21498 - DNA, 1689 bp, Sorghum bicolor
  misc_feature: Ceres ANNOT ID no. 8725128
  misc_feature: Down-regulated in shoot tissues in response to salicylic acid treatment
  misc_feature: Encodes the peptide sequence at SEQ ID NO 21499
atgcagtccaccgcggccgtctccgtctccgcctcggcgaccgcgtcccgcggcggcgccagatccgaggccgcgcggcggccaggtggggtccgggtctgcggactccggggcgaggccctagcgtgcccctcgctgcggatctcgcaggtgccagcgaggctggcggtggcgagggccgcggcggcgaccaatggcgcggtggcggggagcggcggcttcgattacgacctcgtcatcatcggcgcgggcgtcgggggtcacggcgccgcgctccacgccgttgaagagggtttgaaaacagccataattgagggagatgttgtgggtgggacttgtgtaaacagaggttgtgtcccatcgaaagcactccttgctgtcagtggtcgaatgcgggagcttcatgatgaacatcatttgaagtctatgggtctacaggtttcttctcctggatatgacaggcaaggtgttgctgatcatgcaagcaatcttgcctcaaaaatccgtagcaacttgactaactcaatgaaagctctgggagtggatatattgacaggtgttggcactattgtgggaaagcaaaaggtacgatatggaaaagccggttctccagataaagaaatcactgccagaaacatcataattgccactggttcagttccttttgttcccaaagggattgagattgatgggaaaactgtatttaccagtgatcatgcactgaaacttgagtcagttccagactggatagctattgttggaagtggttacattggacttgagttcagtgatgtatacacagctcttggaagtgaggttactttcgttgaagctcttgaccagctgatgcctggatttgatcctgaaattgcaaaattagcccagagagttcttatcaatcctcggaaaattgactatcacactggtgtttttgcaagcaagattactccagcaaaggacggaaaacctgtgctcatcgagcttattgatgcgaagacaaaggaacacaaagaaacccttgaggttgacgcagctcttattgccacaggaagggcgccattcaccaaagggcttggcttggaaaacatcaatgtcgttacacaacgtggttttgtgcctgttgatgaacggatgcgagtcatggatgcagatggcaatgtggtacccaatttatattgcattggagatgccaatggcaaactcatgcttgcccatgctgccagtgcacaaggaatttcagttgttgaacaaatctctggaaaggatcacatcctaaatcatttaagcatcccggccgcatgttttactcatccagagattagtatggttgggctgacagagccacaagccagggagcaggcagacaaagaaggatttgaggtaaatgttgtgaagactagctttaaggctaacactaaagctttggcagaaaatgaaggagatgggattgctaagttgatttaccgacctgacacgggtgaaattcttggggttcacattttgggtttgcatgctgctgatctcatccacgaggcctccaatgccattgccctaggaacacgtgtacaagacatcaagtttgctgttcacgctcaccccacattatccgaggtcctggatgaactcttcaaagcagcaaaggttaattccggtgtttctcattctgtaaatgaaccagttgcagcctag

SEQ ID NO: 21499 - protein, 562 aa, Sorghum bicolor
  misc_feature: Ceres ANNOT ID no. 8725128
  misc_feature: Down-regulated in shoot tissues in response to salicylic acid treatment
  misc_feature (74)..(546): SWISSPROT Homolog: EC 1.8.1.4 Dihydrolipoyl dehydrogenase
  misc_feature (430)..(543): Pfam ID: Pyr_redox_dim Pfam Description: Pyridine nucleotide-disulphide oxidoreductase, dimerisation domain
  misc_feature (77)..(401): Pfam ID: Pyr_redox_2 Pfam Description: Pyridine nucleotide-disulphide oxidoreductase
  misc_feature (249)..(350): Pfam ID: Pyr_redox Pfam Description: Pyridine nucleotide-disulphide oxidoreductase
MQSTAAVSVSASATASRGGARSEAARRPGGVRVCGLRGEALACPSLRISQVPARLAVARAAAATNGAVAGSGGFDYDLVIIGAGVGGHGAALHAVEEGLKTAIIEGDVVGGTCVNRGCVPSKALLAVSGRMRELHDEHHLKSMGLQVSSPGYDRQGVADHASNLASKIRSNLTNSMKALGVDILTGVGTIVGKQKVRYGKAGSPDKEITARNIIIATGSVPFVPKGIEIDGKTVFTSDHALKLESVPDWIAIVGSGYIGLEFSDVYTALGSEVTFVEALDQLMPGFDPEIAKLAQRVLINPRKIDYHTGVFASKITPAKDGKPVLIELIDAKTKEHKETLEVDAALIATGRAPFTKGLGLENINVVTQRGFVPVDERMRVMDADGNVVPNLYCIGDANGKLMLAHAASAQGISVVEQISGKDHILNHLSIPAACFTHPEISMVGLTEPQAREQADKEGFEVNVVKTSFKANTKALAENEGDGIAKLIYRPDTGEILGVHILGLHAADLIHEASNAIALGTRVQDIKFAVHAHPTLSEVLDELFKAAKVNSGVSHSVNEPVAA

SEQ ID NO: 21500 - DNA, 1950 bp, Sorghum bicolor
  misc_feature: Ceres ANNOT ID no. 8725150
  misc_feature: Down-regulated in root tissues in response to methyl jasmonate treatment
  misc_feature: Encodes the peptide sequence at SEQ ID NO 21501
atgcccatggatgtcgatgttaaaattaatcttgatgttgatttggaaagacagataactgtagcaattgattcaaagctccttcaacatttggtgaatgccctcttcagaggtacattaagcacaaatgattctgatctgtctggaccatcagatgctgaagtggatgctgtaggatctatttgtgcttttcttcatgtcacattcaatacattccctctagagcgaattatgactgtactggcctaccggactgaaattgttcctgcactatggaacttcataaagcggtgcaatgcaaaccgaagatggccatttttttctaagtttgcatcttcattacctgctgatgttcctggttggctccttcccatgtctgtattctgtcccatatacaggcacatgttgaagataattgataatggggagttctatgaacaggagaaacccctttcccttaaagatttgaagtccttggttctcattttaaagcaggcgttatggcaacttctttgggttattccatcctcttctcctcagaaagtgtcacccaacccttcaggccttaaaaagttgtcagtggagaatgtcaagaccagagctagggttgggttatctgaactactcacacagttgcaagattggaacaaccgactcccatttacttctgcaagtgatttctattctcaagaagcaacaagcgaaaattttgtgtctcaggcgatacttggtaatactcgagcatcagagatcataaagcttactccttttttggctccatttaccagtcgagtcaaaatattcaataaccaattaacgagctctagacaatcaacatcacattctgcattgacaagacaacggttcaaaataagaagaaatcgacttctggaagatgcttttgatcagctaagtttgctttctgaggaagatctcaaaggaccgattcgagtttcgtttattaatgagcatggtgaagaagaggctggaatcgatggtggtggaattttcaaggatttcatggaaaatattactcgcgctgcttttgatgtgcagtacggtctcttcaaggagacggctgatcatcttttgtacccaaacccaggatctggattggttcatgaactacatctgcaatatttccattttcttggaagtctacttgggaaggcaatgtatgaaggcatacttgttgatttgccatttgcaacgttcttcttgagcaagttgaaacaaaagtacaattttttaaatgatcttccttcattggatccggaattgtaccgtcatcttctatttttaaagcattacaatggtgatatctcagagttggaactatactttgttattgtaaataatgaatatggtgaacaatgtgaagaagaacttctccctggtgggagggaaatgcgtgttacgaatgataatgttattacttttatccatcttgtcgccaatcatcggttaaactaccagatccgtgcacaaagtacacacttcttgagaggttttcaacagcttataccaaaagactggattgatatgttcaatgaacatgaaattcaggttcttatatctggctctttagaaagcttggatatcgatgacttgcggtcgaacaccaactattctgcaggatatcatccggatcatgagcttattgagatgttttgggaggtcttgaagagcttaagttcagacaaccagaaaaaatttctcaagtttgtgaccggatgttctcgtggtcccctcctcggatttcagtacctcgaaccaaaattttgcattcagagagctggtgttccaggactggaggagcatgcagatcgcttgcctacatcagctacctgcatgaaccttctgaagcttcccccttataaaagcaaggagcagatgcaaaccaaactgttgtacgcgataaattcagaagctggttttgatctaagttga

SEQ ID NO: 21501 - protein, 649 aa, Sorghum bicolor
  misc_feature: Ceres ANNOT ID no. 8725150
  misc_feature: Down-regulated in root tissues in response to methyl jasmonate treatment
  misc_feature (342)..(649): Pfam ID: HECT Pfam Description: HECT-domain (ubiquitin-transferase)
MPMDVDVKINLDVDLERQITVAIDSKLLQHLVNALFRGTLSTNDSDLSGPSDAEVDAVGSICAFLHVTFNTFPLERIMTVLAYRTEIVPALWNFIKRCNANRRWPFFSKFASSLPADVPGWLLPMSVFCPIYRHMLKIIDNGEFYEQEKPLSLKDLKSLVLILKQALWQLLWVIPSSSPQKVSPNPSGLKKLSVENVKTRARVGLSELLTQLQDWNNRLPFTSASDFYSQEATSENFVSQAILGNTRASEIIKLTPFLAPFTSRVKIFNNQLTSSRQSTSHSALTRQRFKIRRNRLLEDAFDQLSLLSEEDLKGPIRVSFINEHGEEEAGIDGGGIFKDFMENITRAAFDVQYGLFKETADHLLYPNPGSGLVHELHLQYFHFLGSLLGKAMYEGILVDLPFATFFLSKLKQKYNFLNDLPSLDPELYRHLLFLKHYNGDISELELYFVIVNNEYGEQCEEELLPGGREMRVTNDNVITFIHLVANHRLNYQIRAQSTHFLRGFQQLIPKDWIDMFNEHEIQVLISGSLESLDIDDLRSNTNYSAGYHPDHELIEMFWEVLKSLSSDNQKKFLKFVTGCSRGPLLGFQYLEPKFCIQRAGVPGLEEHADRLPTSATCMNLLKLPPYKSKEQMQTKLLYAINSEAGFDLS

SEQ ID NO: 21502 - DNA, 4488 bp, Sorghum bicolor
  misc_feature: Ceres ANNOT ID no. 8725243
  misc_feature: Up-regulated in root tissues in response to salicylic acid treatment
  misc_feature: Up-regulated in shoot tissues in response to salicylic acid treatment
  misc_feature: Encodes the peptide sequence at SEQ ID NO 21503
atgcagacgaatcatcagaataccaaatatggggaacttgcccgtaatatccgagaaaaccagcttggaggggtgatctttggctgcaagcatgatacaattgaagaatgcttcagaaaacagctattcggtctgccttcagtccactattcatatgttagaaatgtcaaacctggcatgcctttatttctattcaattatagtgacagaaagctccatggaattttcgaagctgcaagtcctggtgagatgtatattgacccatatgcttggagtaatgatggttctttaaggacagcttttcctgcgcaggttcgtatttgcacaaagactcagtatccacctctactggagagccaattcaaaacattgcttggtgacaactattacaaccatcaccacttctattttgagctcgaccatgcacagacaagagccttgatttctttgttcaaatcacttgctcctgctaatcaagttcaagctgtttcaagcaaaaggaatattgcagtatcatcaccaccaactagaatgaagctatcagctgttcctgacccaaagaaggtcacagcaaattctaaggacaccaatccatttagtgttctatcaaatacagccgctccatttaactgggctgatgatgtggaaagtgctagtaacactgatgacaagaaatctgatgattcagtttctgattttgacaatttgggtgacaatcttcttcaagaccaattcagtcctcattcaaatccagatgaggtcagtcaaacttcctcaggcaaaactcttggccaaggactggagcttactgaatgcaatcatccagttgtcaatcctgtgaatggtgaaagaatcataactgatggatcaatgcttttgaattcacacaatggtgctgtggaagttgatgaaatagagattgaagttcaaaataatccaggtggtggtgttgggatacagccagaaagacagactgtactagaaaaactgaaagaattatcttccctacgacagcaagcggccatatcttcccaggattgtactgattctggttcagatcaatgcgtacctgatgaaaaccagaccaacccaaatctttcctgtggcctgtttgatgctacaatggaagataaaacctcatttgacgagtgccatggaaatgctgaggtgatgcaaatcatcactcatttacagatgagaactgaagcattggagaagaagctgattgggtcagatagagaaatactttcgttgagggaagtagttaaagactcaggaagaaaagttcagcaactggaataccttgtagatgagttacaattcaaatttgactcttcgctgtctcttcttggaagcatgtgcaatactctagccaagccatcaatattcctgattggtggttataatggtgtgacctggttatcatctcttgattcttttactcctgagaaagatgcagtcctgggtctcacaccaatgagttctccccgctcatatgcatctgctgctgtattagatggtcacatatttgctgttggtggtggtgatggcatgtcatggtataacacagtggaatgctatagctcgagaaataatgagtggacggaatgcccctccttgaaccggaagaaaggaagtcttgctgggatctgtctaaatgagaaaatatacgctattggtggaggagatggaaatgaaacttattcagaagttgagatgtttgatccgtaccttgggaaatggatatgtagcccatctatgctgctctctcggtttgctcttgcagcgtccgtactaaatggagtcatctatacatctggtggctatgatggagacatgtacttggaacttgcgcagataactaagagcatcttttctgaacagatagctaagagcatcttgttcttaaatcttggaaagaaacttagttgcagtgctgacttgttttccagatatgccatgggagggtatgatggggacaaaatggtttctagcgtcgagatctatgaccctcgtcttaatgcctggaggatgggtgatccaatgaacaccccaagaggatatgcagctgccgtttatcttgatgatagcttattcgtaattggtggcatgcagtccagtgtgcagatcttggatactccaaacagccagcctgggctccagattcgtaatctcccagtaaaaaagcttggaggggtgatctttggatgcaagcctgaaacaattgaagaatgcttcaaaaaacagctctttggtcttccttcagtccattattcatatgtgaagaatgtcaaacctggcatgcctttgtttctattcaattatactgacagaagactccatggtatttttgaggctgcaagtcttggtcagatgtctattgatccatatgcttggagtaatgaggactcattaacaacaccttttcctgctcaggttcgtattcgcacaaggactcggtatataccaatgctggagagccaatacaaaacagtgcttggtactaactattatgatcgtcatctgttctactttgagctggaccatacacagacaaaagctttaatttctttgttcaaatcacttctccctattaatttcaatcaagttccagctgcttcaagcaaaaagagtattgttgtgtctttaccaccaactaaaaggaaggcaccagttctacctgacccaaaaaaagttaaagcaaattcaaaggatatcaatccatttagtgttttatcaaatgcaagtgatggtgttctacaaaactgggttgattctgatgtggaaaatgctagcatcaatgaaaattcacacagtgatactgatgagaaggaatttgaggagccagtttctgattgggaggatttggatgacaatgctctgcaataccagtttagtcctcattcaaatccagatgagagtcaaaactcctcatacaaaacagtttgccaaggaatggagcttcctgaatgtattcatccagttgtcaatcctgtgaatgaagaaaaacacaccatgcttgtacataatgagcataaagctgctgtgagtattgacaaaatagagagtgaagttaataatatcccgggtggtgttgggctacagcctgaaaggcacactatcctgaaaaagctgaaagagttgttttccatacgacagcaggcggcactgtcttcccaggattgtgttaattcaagcccagatcaatgtgtacctgaagaaacaaaggtcaatgcaaacctgtcctgtggcccatttgatggcactgtggaagataaaccctcctttgaggaacaccgtggagaatttgctgagctccgacaaatcattgctgatttatccaggagggctgaagcattggagaaaaagcagaaagggtcagatcaagatatactatttttgagggaagttgttaaagattcaggaagaaaagtacagcagctggaatatcttgtagatgagttacaattccgatttgactcttcattgcctcttcttggaagcacgcgcaagccatcgatattcctgataggtggttacaatggcgtgacctggttaccatctcttgattccttttctcctgagaaagacacactgatgggtcttgcaccaatgagtgtcgcccgctcatatgcatctgctgctgcattggatggtcacatatttgctttcggtggtggaggtggcaactcatcatggtataacacagtggaatgctatagttcaaggaataacgagtggatagaatgcccctcattgaaccaaaagaaaggaagtcttgctggtatcagtcttaatagcaaaatatatgctattggtggaggagatggaaatgaaactttttcagaagttgagatgtttgatccatatctcgggaaatggatatgtggtccatctatgctgatttctcgatttgctcttgccgtagctgaattgaatggcaccatctacgcaactggtggatatgatggaagcacgtacttacaatcagcagaacggtacgaccaaagggagggtgtctgggcccgtcttccaagtatgagcacaaagaggggatgccatgccctaactgtcctgggagaaagcctatacgcaatgggaggatacaatggggacaagatggtttctagcgttgagatcttcgaccctcgcctcaatgcctggaggatgggagatcccatgagcaccccaagaggatacgctgctgcagttactctggatggaagcgcgtatttaatcggtggcctgaagtccaatgtgcagatcctggataccgtggaggtttataacgcgagctccggctggtcagctctcggtttcagttcactcgggaagaggacctttgcatctgccgtggccatggtaaatcatccgaatggtatgggagactggccggtcgcgctgtaccttatctgtgctgaaactcggcctccaggctccaaccacagcagacgtaataaaacatcagcgatgtggcgcaaagggtaa

SEQ ID NO: 21503 - protein, 1495 aa, Sorghum bicolor
  misc_feature: Ceres ANNOT ID no. 8725243
  misc_feature: Up-regulated in root tissues in response to salicylic acid treatment
  misc_feature: Up-regulated in shoot tissues in response to salicylic acid treatment
  misc_feature (496)..(541): Pfam ID: Kelch_1 Pfam Description: Kelch motif
  misc_feature (543)..(588): Pfam ID: Kelch_1 Pfam Description: Kelch motif
  misc_feature (640)..(683): Pfam ID: Kelch_1 Pfam Description: Kelch motif
  misc_feature (1208)..(1254): Pfam ID: Kelch_1 Pfam Description: Kelch motif
  misc_feature (1256)..(1301): Pfam ID: Kelch_1 Pfam Description: Kelch motif
  misc_feature (1303)..(1348): Pfam ID: Kelch_1 Pfam Description: Kelch motif
  misc_feature (1350)..(1395): Pfam ID: Kelch_1 Pfam Description: Kelch motif
  misc_feature (1397)..(1442): Pfam ID: Kelch_1 Pfam Description: Kelch motif
MQTNHQNTKYGELARNIRENQLGGVIFGCKHDTIEECFRKQLFGLPSVHYSYVRNVKPGMPLFLFNYSDRKLHGIFEAASPGEMYIDPYAWSNDGSLRTAFPAQVRICTKTQYPPLLESQFKTLLGDNYYNHHHFYFELDHAQTRALISLFKSLAPANQVQAVSSKRNIAVSSPPTRMKLSAVPDPKKVTANSKDTNPFSVLSNTAAPFNWADDVESASNTDDKKSDDSVSDFDNLGDNLLQDQFSPHSNPDEVSQTSSGKTLGQGLELTECNHPVVNPVNGERIITDGSMLLNSHNGAVEVDEIEIEVQNNPGGGVGIQPERQTVLEKLKELSSLRQQAAISSQDCTDSGSDQCVPDENQTNPNLSCGLFDATMEDKTSFDECHGNAEVMQIITHLQMRTEALEKKLIGSDREILSLREVVKDSGRKVQQLEYLVDELQFKFDSSLSLLGSMCNTLAKPSIFLIGGYNGVTWLSSLDSFTPEKDAVLGLTPMSSPRSYASAAVLDGHIFAVGGGDGMSWYNTVECYSSRNNEWTECPSLNRKKGSLAGICLNEKIYAIGGGDGNETYSEVEMFDPYLGKWICSPSMLLSRFALAASVLNGVIYTSGGYDGDMYLELAQITKSIFSEQIAKSILFLNLGKKLSCSADLFSRYAMGGYDGDKMVSSVEIYDPRLNAWRMGDPMNTPRGYAAAVYLDDSLFVIGGMQSSVQILDTPNSQPGLQIRNLPVKKLGGVIFGCKPETIEECFKKQLFGLPSVHYSYVKNVKPGMPLFLFNYTDRRLHGIFEAASLGQMSIDPYAWSNEDSLTTPFPAQVRIRTRTRYIPMLESQYKTVLGTNYYDRHLFYFELDHTQTKALISLFKSLLPINFNQVPAASSKKSIVVSLPPTKRKAPVLPDPKKVKANSKDINPFSVLSNASDGVLQNWVDSDVENASINENSHSDTDEKEFEEPVSDWEDLDDNALQYQFSPHSNPDESQNSSYKTVCQGMELPECIHPVVNPVNEEKHTMLVHNEHKAAVSIDKIESEVNNIPGGVGLQPERHTILKKLKELFSIRQQAALSSQDCVNSSPDQCVPEETKVNANLSCGPFDGTVEDKPSFEEHRGEFAELRQIIADLSRRAEALEKKQKGSDQDILFLREVVKDSGRKVQQLEYLVDELQFRFDSSLPLLGSTRKPSIFLIGGYNGVTWLPSLDSFSPEKDTLMGLAPMSVARSYASAAALDGHIFAFGGGGGNSSWYNTVECYSSRNNEWIECPSLNQKKGSLAGISLNSKIYAIGGGDGNETFSEVEMFDPYLGKWICGPSMLISRFALAVAELNGTIYATGGYDGSTYLQSAERYDQREGVWARLPSMSTKRGCHALTVLGESLYAMGGYNGDKMVSSVEIFDPRLNAWRMGDPMSTPRGYAAAVTLDGSAYLIGGLKSNVQILDTVEVYNASSGWSALGFSSLGKRTFASAVAMVNHPNGMGDWPVALYLICAETRPPGSNHSRRNKTSAMWRKG

SEQ ID NO: 21504 - DNA, 1101 bp, Sorghum bicolor
  misc_feature: Ceres ANNOT ID no. 8726019
  misc_feature: Down-regulated in shoot tissues in response to aminocyclopropane carboxylic treatment
  misc_feature: Down-regulated in root tissues in response to aminocyclopropane carboxylic treatment
  misc_feature: Encodes the peptide sequence at SEQ ID NO 21505
atggcaaccggcggcggcaaggcggcggcgctgctgctcgggctgctcctgctgctgtgcgtgctccggcatggggcggcgcagcggtacaacgccatctggagctttggcgactccatctccgacaccggcaacctctgcgtgggcgggtgcccctcctggctcaccacagggcagtcgccctacggcgagaccttcttcggccgccctacgggcaggtgctccgacggccgcgtcatcatcgacttcctggccgagcactttgggcttcctttgccgccggcgtccaaggccggcggcgacttcaagaagggcgcgaacatggccatcatcggcgccaccaccatgagcttcgacttcttcaactccatcggcctgagcgacaagatctggaacaacggcccactcgacacccaaatccagtggttccggcagctgctgccctccgtgtgcgggaacgactgcaagagctacctgtccaagtcgctgttcgtggtgggcgagttcggcggcaacgactacaacgcggcgctcttcgccgggcggtccatggcggaggtgagggggtacgtgccccgggtcgtcagcaagctcgtccgcggcctggagacgatcgtcaggagcggcgccgtcgacgtggtggtgccgggggtcctgcccatcggctgcttccccatctacctcaccctctacggcacctccaacgccgccgactatgaccgcgacggctgcctccggagctacaacggcctctcctactaccacaacgcgctgctgaagcgcagccttgccagcctgcagcggacgtacccgcacgcccggatcatgtacgccgacttctacacccaggtcacccacatgatccgggcacctcacaacttcgggctcaagtacgggctgaaggtctgctgcggcgccggtgggcagggcaagtacaactacaacaacaaggcgcggtgtggcatgtccggggccagtgcctgcgccgacccgggcaactacctcatctgggacggcatccacctcacggaggcggcctaccgctccatcgccgatggctggctcaagggcacctactgcaaccctcccattcagcactga

SEQ ID NO: 21505 - protein, 366 aa, Sorghum bicolor
  misc_feature: Ceres ANNOT ID no. 8726019
  misc_feature: Down-regulated in shoot tissues in response to aminocyclopropane carboxylic treatment
  misc_feature: Down-regulated in root tissues in response to aminocyclopropane carboxylic treatment
  misc_feature (30)..(352): SWISSPROT Homolog: EC 3.2.1.51 Alpha-L-fucosidase
  misc_feature (33)..(354): Pfam ID: Lipase_GDSL Pfam Description: GDSL-like Lipase/Acylhydrolase
MATGGGKAAALLLGLLLLLCVLRHGAAQRYNAIWSFGDSISDTGNLCVGGCPSWLTTGQSPYGETFFGRPTGRCSDGRVIIDFLAEHFGLPLPPASKAGGDFKKGANMAIIGATTMSFDFFNSIGLSDKIWNNGPLDTQIQWFRQLLPSVCGNDCKSYLSKSLFVVGEFGGNDYNAALFAGRSMAEVRGYVPRVVSKLVRGLETIVRSGAVDVVVPGVLPIGCFPIYLTLYGTSNAADYDRDGCLRSYNGLSYYHNALLKRSLASLQRTYPHARIMYADFYTQVTHMIRAPHNFGLKYGLKVCCGAGGQGKYNYNNKARCGMSGASACADPGNYLIWDGIHLTEAAYRSIADGWLKGTYCNPPIQH

SEQ ID NO: 21506 - DNA, 2496 bp, Sorghum bicolor
  misc_feature: Ceres ANNOT ID no. 8731220
  misc_feature: Down-regulated in shoot tissues in response to methyl jasmonate treatment
  misc_feature: Down-regulated in root tissues in response to methyl jasmonate treatment
  misc_feature: Down-regulated in shoot tissues in response to salicylic acid treatment
  misc_feature: Encodes the peptide sequence at SEQ ID NO 21507
atgccgcacgcgagactcccagtcgcctaccccgcgagccgcgcgcgactttgtgcggcagcggcgctcttcctcgtcgcgagtcgcgactctccgagtctccgcgcggcggggccgggggcagccgccgaggggctacgagcagaagctgctggtgctgaccggggcgacgcgcttagccagcgaagtgcggcggcggtcgtaaggggcaagctgctcctaatcttcggggtgaggtgcggcatggattcaggaagaggaaaggaagacaggattggtttctgcgctggggcaatctttgggctgtccaataatgtgcagcctcggaagatttggggcagacaggagcagggcgaagctggggtggacgggatagttggtcttggcggggcggcgctcctcatggcgatttcagaggggctcgtcctggcaggtctggaggtttcggcaggggacgggatggacagttccctccccctgctgggtggaggtggcagaggcggctctgggaagcaggcacatggtgaaaacatggattacaaccttggtgacacctcccccgatccctacggtggcggtggtggaagcatccacctagtgtgtgatcattgtggcaccagtgacaactacaacactgacgacgctgatgatggccaattcacatgccgtacgtgctctgctgtgcacaccacacaggcaactgctgctgaccctcattacttccctgtcactggcagcatctctgttcgccgtgttgccacccagcccacccccaagcttggtgcccgcacacccaccccctacccgaggacccctcaggctgctcctgtgcctgctgctgccgctttcgacgacttcatggagctgagtgagccgcgggactttgctcctggatctggaacgtggggggagcctgaggatttggcagcgcgggtccgctggcgctatgtacagggtctccaggtgatcctgcagcggcagctggaggtgctggtggagcggcaccaggtaggcgcgtttgtgtgtgctgtcgctggcattgtctgggtgcggtgggttgctgcatccagggtgtttgacggaatctgggtgcaccaggtgctcgaggaccacaaggccacggggagagagaattgttctagcagcagagacaacaagaaacatgatgaggtgaagtatgaatcggatgatgatatgttgctgcaacgaaaagacaggcgcaaggtggagtttgcctttttgcgctcgttgaggatgatgctgccggtttactcaacattggctgtttgtttcttggcctgtcatattgcccgtgaagccatcctgccaagcgacatttacaggtgggcaatggaggggaatatcccttatgtggctgcatttaccgaagtagacaggttccttgggaactctttccaagactgccctttggatgcaaggcagctgttcaggccagtgcgagttatcggagcatggcaactggaagctgcagctggatccatagcacaaaaagtaggcttgaggcttccttcagttaacttctatgcaattgctcaccgttgtttgaaggacttgttactgcctatagatagaatcctcccccacgcatgccgaatttatgagtgggcaatgcctgcagaattatggttgtctagtaatcctgctagagtccctacacgggtttgtgtgatggctatcctaattgtggccctacgacttctttataacatcaacggtcaagggatatgggagaagatttgtgaggaaggaagaaacacaagtgaatctcaccatgatacgaattcatcaacttccaggaagcttgaggctagtaacagtgaggagtttggcacaagagaactgttgtgtgctattgcagctgcctatgataaaatcaatacaacacatgactactcaagtgatctccgctcttatctcaagtactgcaaggaagttatttttactgggattacattttcagatgaagagaatcatctaatagagatattttgggatatgtacaaagccagagaggatgataatccaaaagatcatgtaaaatcccagtccaattctgttgaagacattccaattacaaatggagtgaagaagcactaccgagatggagcttttgttgaagcaagttccttttctgcatcttcaggtcacgatgaaatgcaaatgctcaagtcagagatgcaagatcatggatttcattatatgccacctaggaaaccaaggaaatcagatggttatcttcgttataggaggaagcggctaagcggtggctttgtttatgttgcacatgctgattattacatgttgctacgtgcttttgcaaagcttgcagaaattgatattcgtatcatgcatattagtgtgttaaaacttgagaggagactcgcatgtattgaggagcaaattgagagaagcttgaacaccttacagaacttttctactgcaacaggagatgagctaagatctgtatctgactga

SEQ ID NO: 21507 - protein, 831 aa, Sorghum bicolor
  misc_feature: Ceres ANNOT ID no. 8731220
  misc_feature: Down-regulated in shoot tissues in response to methyl jasmonate treatment
  misc_feature: Down-regulated in root tissues in response to methyl jasmonate treatment
  misc_feature: Down-regulated in shoot tissues in response to salicylic acid treatment
MPHARLPVAYPASRARLCAAAALFLVASRDSPSLRAAGPGAAAEGLRAEAAGADRGDALSQRSAAAVVRGKLLLIFGVRCGMDSGRGKEDRIGFCAGAIFGLSNNVQPRKIWGRQEQGEAGVDGIVGLGGAALLMAISEGLVLAGLEVSAGDGMDSSLPLLGGGGRGGSGKQAHGENMDYNLGDTSPDPYGGGGGSIHLVCDHCGTSDNYNTDDADDGQFTCRTCSAVHTTQATAADPHYFPVTGSISVRRVATQPTPKLGARTPTPYPRTPQAAPVPAAAAFDDFMELSEPRDFAPGSGTWGEPEDLAARVRWRYVQGLQVILQRQLEVLVERHQVGAFVCAVAGIVWVRWVAASRVFDGIWVHQVLEDHKATGRENCSSSRDNKKHDEVKYESDDDMLLQRKDRRKVEFAFLRSLRMMLPVYSTLAVCFLACHIAREAILPSDIYRWAMEGNIPYVAAFTEVDRFLGNSFQDCPLDARQLFRPVRVIGAWQLEAAAGSIAQKVGLRLPSVNFYAIAHRCLKDLLLPIDRILPHACRIYEWAMPAELWLSSNPARVPTRVCVMAILIVALRLLYNINGQGIWEKICEEGRNTSESHHDTNSSTSRKLEASNSEEFGTRELLCAIAAAYDKINTTHDYSSDLRSYLKYCKEVIFTGITFSDEENHLIEIFWDMYKAREDDNPKDHVKSQSNSVEDIPITNGVKKHYRDGAFVEASSFSASSGHDEMQMLKSEMQDHGFHYMPPRKPRKSDGYLRYRRKRLSGGFVYVAHADYYMLLRAFAKLAEIDIRIMHISVLKLERRLACIEEQIERSLNTLQNFSTATGDELRSVSD

SEQ ID NO: 21508 - DNA, 2601 bp, Sorghum bicolor
  misc_feature: Ceres ANNOT ID no. 8731368
  misc_feature: Up-regulated in root tissues in response to methyl jasmonate treatment
  misc_feature: Up-regulated in shoot tissues in response to methyl jasmonate treatment
  misc_feature: Down-regulated in shoot tissues in response to salicylic acid treatment
  misc_feature: Encodes the peptide sequence at SEQ ID NO 21509
atggactcctcgggctccgcctcgtcgtacaagctgcagctcgccctcgcggcgctcgtgggcgcctcctccgccgccgtagcggcctactacctgcactaccgtgccgtcgcgcaggtcgctcgctccgcctccaccaaccgccgcaggacccgcccccccacccccgcccccgccgccagcggccggaagctccctccgccgcgccgcgatgccgtcggctcagcctcgcttcccgacctctctgcgttctatgatgccggcggccacggcggcggcgggctcgcctccagcgggtacctcgtggaggaggaggaggaggatgatgcgcatggggtcgtgggcccgcacgcgaacggtggcgcgctcgaacacgcggagctgctggacatcccccagggattgcctagactgaacgtgggccccgacggcagtaaaccatttgcccgtacagtttcaactagacgagttgaaataattagacctaagtcacccaagtcccctgctgccagtgcaagtgcacttgagagtgcagatggatcaggtgatgctatacaaaatagtgacaatggctacatgaacacaaatggaaacctggaaggcgaacacaaaggaaatgcaattgtggaaaatggggctgccaaaccattagctgcagcaagcttgatgcggtcaaaaagtatatccaatggtcttcatgcagttcaacctgacccagttgctgcagatattctacgaaaagaagctcagcaagaatcatttatcaagatgttaactactccagaggagattccaactgctgacgaaattgaggtgttcaaaatccttcagaagtgcctcgagttaagagactcttatctctttagagaagaggttactccatgggagaaggaggccataaatgacccctgtactccaaaacctaaccccaacccgttcacttatgtgcctgaaccaaagtcagagcatgtcttccaaatggttgatggtgttgtccatgtttatgcggataaagattgtacagagagcatttatcctgtggctgatgccacaaccttcttcacggacctgcattatattctccgagtaacggctgcagggaacacaagaactgtctgccataatcggttaaatcttcttgagcataagtttaaatttcatctgatgttaaatgcggatagggaatttcttgcccagaagaccgcaccgcatcgtgatttttacaatgtcaggaaggttgacactcatgttcatcattcagcatgcatgaatcaaaagcatctgttgaggttcataaaatccaaactaaggaaagaacctgatgaggtggtcattttcagagatggtacttatatgactttaaaagaggtttttgagagcttggacttaactgggtatgatctgaatgttgatttgctagatgtccatgcagacaaaagcacatttcatcgttttgacaaattcaacctaaaatataatccatgtggccaaagtaggctcagagaaattttcctcaaacaagacaatctcattcaaggccgttttcttgccgagttgacaaagcaagttttctctgacctttctgctagcaaatatcagctggcagaatataggatttcaatctatgggaggaaacaaagtgaatgggaccaacttgcgagttggatagtgaacaatgaattgcacaatgaaaatgttgtctggctggttcagattccacgcttatataacgtgtacaagggaatgggtattgttacgtcattccaaaatcttcttgacaacattttccttcctctttttgaggttactattgatccagcttcacacccgcagctccatgtcttcctgaagcaggttgtagggctggacctggttgatgatgaaagtaaaccagaaaggcgtccaacaaagcaccacatgcctacacctgaacagtggaccaatgtgttcaaccctgcattttcatattatgcatactactgctatgctaacttattcaccctaaacaagctgcgtgagtcaaaggggatgaccactatcaaattccgtccacatgctggagaggctggagatatcgatcacttggctgcaacatttcttctttgtcacaacatatcacatggaatcaatctaaggaagtctcctgtgcttcagtacttatactatcttggtcagattggtctggcgatgtcgccattgagcaacaactccttgtttcttgactatcatcgcaacccttttccaacgttcttccaacgaggtctgaatgtctcattatctacggatgaccctttgcaaattcacctgacaaaagaaccattggtggaagaatacagcattgctgcttcgctgtggaagctcagttcttgtgatttatgtgaaattgcaaggaactccgtttatcaatctggattttcacatgctcaaaagtctcactggattggcaagaactacttcaaaagaggacttgctggaaatgacattcacagaacgaatgtaccacacatcagggttcaatttagagaaatgatctggagaaatgaaatgaaactagtttactctgacaatgagatcttaataccagacgagctggatctgtaa

SEQ ID NO: 21509 - protein, 866 aa, Sorghum bicolor
  misc_feature: Ceres ANNOT ID no. 8731368
  misc_feature: Up-regulated in root tissues in response to methyl jasmonate treatment
  misc_feature: Up-regulated in shoot tissues in response to methyl jasmonate treatment
  misc_feature: Down-regulated in shoot tissues in response to salicylic acid treatment
  misc_feature (125)..(864): SWISSPROT Homolog: EC 3.5.4.6 AMP deaminase
  misc_feature (409)..(816): Pfam ID: A_deaminase Pfam Description: Adenosine/AMP deaminase
MDSSGSASSYKLQLALAALVGASSAAVAAYYLHYRAVAQVARSASTNRRRTRPPTPAPAASGRKLPPPRRDAVGSASLPDLSAFYDAGGHGGGGLASSGYLVEEEEEDDAHGVVGPHANGGALEHAELLDIPQGLPRLNVGPDGSKPFARTVSTRRVEIIRPKSPKSPAASASALESADGSGDAIQNSDNGYMNTNGNLEGEHKGNAIVENGAAKPLAAASLMRSKSISNGLHAVQPDPVAADILRKEAQQESFIKMLTTPEEIPTADEIEVFKILQKCLELRDSYLFREEVTPWEKEAINDPCTPKPNPNPFTYVPEPKSEHVFQMVDGVVHVYADKDCTESIYPVADATTFFTDLHYILRVTAAGNTRTVCHNRLNLLEHKFKFHLMLNADREFLAQKTAPHRDFYNVRKVDTHVHHSACMNQKHLLRFIKSKLRKEPDEVVIFRDGTYMTLKEVFESLDLTGYDLNVDLLDVHADKSTFHRFDKFNLKYNPCGQSRLREIFLKQDNLIQGRFLAELTKQVFSDLSASKYQLAEYRISIYGRKQSEWDQLASWIVNNELHNENVVWLVQIPRLYNVYKGMGIVTSFQNLLDNIFLPLFEVTIDPASHPQLHVFLKQVVGLDLVDDESKPERRPTKHHMPTPEQWTNVFNPAFSYYAYYCYANLFTLNKLRESKGMTTIKFRPHAGEAGDIDHLAATFLLCHNISHGINLRKSPVLQYLYYLGQIGLAMSPLSNNSLFLDYHRNPFPTFFQRGLNVSLSTDDPLQIHLTKEPLVEEYSIAASLWKLSSCDLCEIARNSVYQSGFSHAQKSHWIGKNYFKRGLAGNDIHRTNVPHIRVQFREMIWRNEMKLVYSDNEILIPDELDL

SEQ ID NO: 21510 - DNA, 471 bp, Sorghum bicolor
  misc_feature: Ceres ANNOT ID no. 8731594
  misc_feature: Up-regulated in root tissues in response to methyl jasmonate treatment
  misc_feature: Up-regulated in shoot tissues in response to methyl jasmonate treatment
  misc_feature: Encodes the peptide sequence at SEQ ID NO 21511
atgccctttcaggtatgccccatctgtgctacaagggttggaatggacttgataggacatttgacaatgcagcatggaagttatttcaagatatcctttactatgctgcgcagagtccgaaaagtgtctactgggtcccattctttgttatccttgttgagaaaggacttgagaaatggcagtttgcagtcatttctcggtggatcatcctatgtatccaatcctcctgctgcagcaccagatccatttttgtcatctttaatttgtagtttgcctgtggctgaaccatccaaagatttacattccgactcatctgacaataactttttgctaaataaattcccagatgaaaagactgtagagagagctgaaccatcattgtcagagaaggatcagaaggaaaggattcaaaggagcaaattcgtccgtgggcttgtgctctcgacaatatttgatgatgataacttgtaa

SEQ ID NO: 21511 - protein, 156 aa, Sorghum bicolor
  misc_feature: Ceres ANNOT ID no. 8731594
  misc_feature: Up-regulated in root tissues in response to methyl jasmonate treatment
  misc_feature: Up-regulated in shoot tissues in response to methyl jasmonate treatment
  misc_feature (1)..(150): Pfam ID: Di19 Pfam Description: Drought induced 19 protein (Di19)
MPFQVCPICATRVGMDLIGHLTMQHGSYFKISFTMLRRVRKVSTGSHSLLSLLRKDLRNGSLQSFLGGSSYVSNPPAAAPDPFLSSLICSLPVAEPSKDLHSDSSDNNFLLNKFPDEKTVERAEPSLSEKDQKERIQRSKFVRGLVLSTIFDDDNL

SEQ ID NO: 21512 - DNA, 7272 bp, Sorghum bicolor
  misc_feature: Ceres ANNOT ID no. 8731689
  misc_feature: Up-regulated in shoot tissues in response to salicylic acid treatment
  misc_feature: Encodes the peptide sequence at SEQ ID NO 21513
atgaagccctcgccgcacttcccggagatcgggaagaagcctaaagatttgattgctaaggaccacgcatttaacatcgcggcttacatctcgtctggagcggatgttattgctgctgcgctccgtaaacatgttgaggaggaagcccgagatcttagtggtgaagcttttttaaggtttatggatcagctctatgagcagatatctagtttactgcagagcaacgatgtcactgaaaatttactggctctccgtgctattgatgctttaattgatatgccctttggagaaggtgcttccaaagtttctaagtttgccagcttcttgagaaatgtatttgaagtgaagcgcgaccctgaaatcctagttccagcaagtgcagtgctgggtcatttagcaaaagcggggggagcaatgactgcagatgaagtggagcgacaaattaaaacagctttggggtggcttactggtgatcgagtggaatatcgccggtttgcagctgtactcattctcaaagagatggctgaaaatggatcaacagttttcaatgttcatgttcctgagtttgtagatgctatatgggtagcactgagagaccctaaacaggctgttcgtgaaaaagcagttgaagccttgcgtgcttgtctccatgttattgaaaaacgggagactcgttggcgtgtacaatggtattaccgcatgtgtgaagccgcacaagttggacttggcagaaatgcttctgttcatagtattcatggctcattattggctgttggagaattgctgaggaatacgggggagtttatgatgtctcgatacagagaagtggctgatattgtcctcgattatttaaagcatcgagatcagcttgttcgacgtagtataacatcacttcttcctcgaattgcccacttcctgcgtgacagatttgtgactaattacctgaagatttgcatggatcatatcttgtttgttctacgtacaccagacgagcgtgctagcggctttgttgcacttggagagatggctggggctctgggtgttgaacttgtgccttatttaccagcaattacttcacatttgcaagatgcgattgctcctcgcagaggaaggccatctcttgaggcaatttcttgtgtaggaagctttgcaaaagctatgggtcctgcaatggaacctcatattcgtagcggactgctagatgctatgttttttgctggtctttctgataaactggtagatgcacttgagtctataagcacaagcatcccgtctttactacccacaatacaggagcgtttattggattgtatatctcaagcactaccaaagtcatcaataaggccaggtgcttctgttggtcgagcaaacaggtcaaacagtttgcaacagtttgtggactctaatagtcctcttcttgtgcaacttgcactgtggactctagcaaacttcaactttaagggccatgaacttctggaattcgctagagagagtgtcatactttatttggaagatgaagatagcagtaccagaaaagctgcctcattgtgttgttgcaaattagttgcacactccctttctgcttcctcaacttcacagttcggttcaaataggacaaatcgtattggaggagctaagcgccgccggcttgtagaggagatagtggagaaacttcttatggctgcagttgctgatgctgatgttggtgttagaagttcggtcttcaaggcgttgtatcgaaatccagcttttgatgatttcttggcccaagctgacatcttgacttcaatttttgttgccttaaatgatgaggaatatgatgtcagagaattggcgatttctgttgctggccgattgtctgaaaagaatcctgcatatgtactgcctgcccttcgtcgctatcttatacagttgctcacatatcttgaccagagtatggatagcaagtgtagagaggaaagtgctagattattgggttgtttaattaggagctgtgcacggctcattcttccttacattgctccagttcacaaggcgcttgtgactagattgtgtgaaggaacgggaccaaatgctaataatgctcttgctgcgggagtgcttgccactgttggagaactggccaaagtgggtggctttgctatgaggcgatatcttcctgagctgatgcctgtagttgtggatgctcttttagatggaggtgctgttagtaaaagggaagtggctgtgtcaactctgggacaaattatccaaagcacaggctatgttatcgccccctataacgagtacccgccgttgcttggcttactcttgaagttgctgaatggtgaattggaatggtcaactagactagaagtgctaaaggttttagggattatgggtgcattggaccctcatgcacacaagcgaaatcagcataatctacctggtcaacatagagaggtcctacggccaacaatcgagactgcacagcatattgtttctatggaagagttaccgactgacttctggccatctttttcggcatctgaggactattactcaacagttctccctgagctattgcgtgctgttcgcatgtgcgaggatggtggtttaaaagagttcataacctggaagcttggaacattgatatctattgtccggcagcacatccggaaatatttacaagacatactttcccttatctctgagttgtggacttcctcattcagcttgcctgcaccaaatcggaccatacagggcccacagggttcaccggttcttcaccttgttgagcaattatgcttagctttaaatgatgagttcagaatttatttacttcacattctaccaagttgtatccaagtcttaggtgacgctgaacgttgcaatgattattactatgttcctggcatattacacacacttgaagtttttggtggaaatttggatgagcacatgcatttggttgctccagtgcttgttcgtttatttaaagtggagctggttgatatcagacggcgtgctattgttactttgactaatcttattcccaaggttcaggttggcactcatgtttcggctttagtgcatcatctgaagcttgtcttagatggcaacaatgatgatctgcggaaagatgctgcagaagcgctctgctgcctcgcacatgcccttggagaagactttactatcttcgtaccatcaatacgcaaaattcttgtgaagcaccatttacggtacagaaaatgggatgagattgaaaatcggttactgaggcgagagctactcatcactgaaaacttgtctgtacaaaagtacacacaatgtccacctgatgtcattagtgacccccttgatgattttgatggtacaccttctgagatagctgatgaaacacagcgacaagcaagaagtcatcaagtcaatgatgtccggttgcggagtgctggtgaggcttctcagaggagtactagggaagactgggctgaatggatgagacatttcagtattgcacttctcaaagagtcaccatctccagctttacgcacttgtgcaaggctagctcagcttcagccttctgttggccgcgagttgtttgctgcgggttttgcaagttgctgggcccaaatgagtgaatctgcccaggaacaacttgtgagaagtctcaagacagccttctcatctcaaaacattcctcctgaaattcttgctacactgctgaacttagcagagtttatggaacacgatgagaagccgcttcctattgatacaaggctgcttggtgcacttgctgagaagtgtcgagcatttgcaaaagccctccattataaagaaatggagtttgaagctgtgtgcaccaagaagatgggtgcaaatcctgttacggtggttgaatcccttattcatattaacaatcaactacaccagcatgaggcagctattggcatattgacttactcacagcagaatttggaagttcagttgaaagaatcatggtatgaaaaattgcaccgttgggatgaggcccttaaagcatacaccataaaatcatctcaagcacctggtcctttacaaaacttggatgctacattaggtcgaatgaggtgtctagcggctttggctcggtgggaagatttaagtgcattatgcagagagcaatggactggtgcagaaccatctgctcgattggaaatggctccaatggctgcaaatgctgcttggcatatgggtgagtgggaccatatggcagaatatgtttctcgcctggatgatggagatgaaaataagctccgtatgttgggtaacacaacggctagtggtgatggaagcagtaatggtgctttcttccgggcagttctttcagttcgttccaaaaagtatgatgaagctcggatatttgttgagcgagctcggcggtgtttagctacagaacttgcagcactggtacttgagagttatgagcgcgcttataataacatggtgcgtgttcaacaactttcaaaactggaagaggtgattgattactgcactcttcctgcggaaagccccatagctgacggacggagggaacttattcgcaatatgtggaatgaacgcattaaaggaacaaaacggaatgtggaggtctggcaagccctacttgcagtcagggagttggttcttcctcctaacgaagacagagacacctggataaaatttgctaaactttgctggaagaatggtcgtattagtcaggctagatctacattagtcaaacttttacagtttgatcctgaatcttctcctgaattgacactgtatcatgcacatccacaagtagccctggcttatctaaaataccagtatgcagttggtgatgagcttaaaagaagggatgcattttctagattgcaagagttgtctatgcagcttgctactgccatgggcaatttccctggaacatcagcaaaccatggtaccatgtcaaatgctggagttccactcattgctcgtgtttatttgacacttggtacctggaagaaggcgctatcacctgcattagatgatgattccattcaagaaattttgatttcttacaatcatgccacactaagtgcaaaggactgggggaaggcctggcacacatgggctttgttcaacacagaagtcatgtcacgctatactttccgaggtcgaccagatattgctggaaaatatgttgttgcagcagtaactgggtatttctattctattgcttgtcaatctactacgaaaggggttgatgatagcttacaggatatccttcgtctgttaactctttggttcaaccatggggctacctcagaagttcaaacagcgttgcagaaaggcttttcacttgtcaagattgagatgtggctggttgtgctgccccagataattgcaaggattcattcgaacaccagagtagttagagaactgatacaatctttgctagttcgaattggaaaggggcatccacaggctttgatgtatcctctcttggttgcctgcaaatcaataagtatattgagacaacgtgcagcgcaggaggtcgttgataagatccgccagcacagtggaggtcttgttgaccaggcacaacttgtatcaaaggaactgatacgggtagcaattttgtggcatgaaatgtggcatgaggctcttgaggaagctagcaggatgtactttggtgagcacaatattgaaggaatgcttgctgtacttgagccattgcatgcaatgcttgagaggggacctgagacaattaaagaaaatgccttcattcaggcttatggacatgaattactggaagctcatgaatgctgttcgaaatatcgggctacaggagaggatgctgagctaactaaggcctgggatttgtattaccatgttttcagaagaatcgacaaacagcttccaagtcttacaactctcgatttgcactctgtttcgcctgagctactcaaatgtcgaaagttggaacttgctgtgccaggaacttatgctgcagattcaccacttgtgacgattgagtattttgttccccaattgattgttataacatccaagcaaagaccaagaaaactgacaattcatggaagtgatggcaatgattatgcattcttgcttaaaggccatgaagatttgcgacaagatgaacgtgtaatgcagctttttggtctggtgaatactctcctagagaactcaaggaaaacatcagagaaggatttatcaatccaaagatatgctgttatacctttgtcgcctaacagtggtttaatcggatgggttccaaactgtgacacacttcatgctctgatccgtgaatacagagatgccaggaagattttcttgaatcaggagcacaaacttatgttggcttttgcacccgattatgatcacttacccctcattgcaaaggtggaagtgtttcagcatgctttgcaaaacaccgagggaaatgaccttgcaaaggttctgtggcttaagagtcgaacttcggaagtgtggcttgagcgccgcacaaactacgctagaagcctggctgttatgagcatggttgggtatttgcttggtttaggagatcgtcacccaagtaatcttatgttagatcgctatagtggaaaaatattacacattgactttggagattgctttgaggcttcaatgaatcgagaaaagttccctgaaaaagtaccattccgtttgactagaatgcttgtgaaagcaatggaagttagtggtattgagggtacattccgaacaacatgtgaaaatgtgatgcaagtccttcgcacaaacagagacagcgttatggccatgatggaggcatttgtacatgacccattaatcaattggcgtctgttcaatttcaatgaggttcctcaagtgtcaaactatggtaatgctcatgctcacacggttgtcagtagtgaagacgcagtggctaatcgagaactcatgcaacctcagcgaggagcacgtgagagggaactgctacaggccgtcaatcaacttggtgatgctaatgaagttctgaatgagcgtgctgtagctgtgatggcacggatgagtgacaagctaacagggcgtgacttctcttctgggtcagctttggctggagcaggtagctcgacccaacatggcagtgagcacttggcttcaggagatgcccgggatgcgcaacctgctctctcggtgaaggttcaggttcagaagctcatactccaagccacctcgcacgaaaatttgtgccaaaactatgtcgggtggtgtccgttctggtga

SEQ ID NO: 21513 - protein, 2423 aa, Sorghum bicolor
  misc_feature: Ceres ANNOT ID no. 8731689
  misc_feature: Up-regulated in shoot tissues in response to salicylic acid treatment
  misc_feature (1438)..(2361): SWISSPROT Homolog: EC 2.7.1.137 Phosphatidylinositol 3-kinase
  misc_feature (1394)..(1762): Pfam ID: FAT Pfam Description: FAT domain
  misc_feature (2033)..(2283): Pfam ID: PI3_PI4_kinase Pfam Description: Phosphatidylinositol 3- and 4-kinase
  misc_feature (1867)..(1966): Pfam ID: Rapamycin_bind Pfam Description: Rapamycin binding domain
  misc_feature (2391)..(2423): Pfam ID: FATC Pfam Description: FATC domain
MKPSPHFPEIGKKPKDLIAKDHAFNIAAYISSGADVIAAALRKHVEEEARDLSGEAFLRFMDQLYEQISSLLQSNDVTENLLALRAIDALIDMPFGEGASKVSKFASFLRNVFEVKRDPEILVPASAVLGHLAKAGGAMTADEVERQIKTALGWLTGDRVEYRRFAAVLILKEMAENGSTVFNVHVPEFVDAIWVALRDPKQAVREKAVEALRACLHVIEKRETRWRVQWYYRMCEAAQVGLGRNASVHSIHGSLLAVGELLRNTGEFMMSRYREVADIVLDYLKHRDQLVRRSITSLLPRIAHFLRDRFVTNYLKICMDHILFVLRTPDERASGFVALGEMAGALGVELVPYLPAITSHLQDAIAPRRGRPSLEAISCVGSFAKAMGPAMEPHIRSGLLDAMFFAGLSDKLVDALESISTSIPSLLPTIQERLLDCISQALPKSSIRPGASVGRANRSNSLQQFVDSNSPLLVQLALWTLANFNFKGHELLEFARESVILYLEDEDSSTRKAASLCCCKLVAHSLSASSTSQFGSNRTNRIGGAKRRRLVEEIVEKLLMAAVADADVGVRSSVFKALYRNPAFDDFLAQADILTSIFVALNDEEYDVRELAISVAGRLSEKNPAYVLPALRRYLIQLLTYLDQSMDSKCREESARLLGCLIRSCARLILPYIAPVHKALVTRLCEGTGPNANNALAAGVLATVGELAKVGGFAMRRYLPELMPVVVDALLDGGAVSKREVAVSTLGQIIQSTGYVIAPYNEYPPLLGLLLKLLNGELEWSTRLEVLKVLGIMGALDPHAHKRNQHNLPGQHREVLRPTIETAQHIVSMEELPTDFWPSFSASEDYYSTVLPELLRAVRMCEDGGLKEFITWKLGTLISIVRQHIRKYLQDILSLISELWTSSFSLPAPNRTIQGPQGSPVLHLVEQLCLALNDEFRIYLLHILPSCIQVLGDAERCNDYYYVPGILHTLEVFGGNLDEHMHLVAPVLVRLFKVELVDIRRRAIVTLTNLIPKVQVGTHVSALVHHLKLVLDGNNDDLRKDAAEALCCLAHALGEDFTIFVPSIRKILVKHHLRYRKWDEIENRLLRRELLITENLSVQKYTQCPPDVISDPLDDFDGTPSEIADETQRQARSHQVNDVRLRSAGEASQRSTREDWAEWMRHFSIALLKESPSPALRTCARLAQLQPSVGRELFAAGFASCWAQMSESAQEQLVRSLKTAFSSQNIPPEILATLLNLAEFMEHDEKPLPIDTRLLGALAEKCRAFAKALHYKEMEFEAVCTKKMGANPVTVVESLIHINNQLHQHEAAIGILTYSQQNLEVQLKESWYEKLHRWDEALKAYTIKSSQAPGPLQNLDATLGRMRCLAALARWEDLSALCREQWTGAEPSARLEMAPMAANAAWHMGEWDHMAEYVSRLDDGDENKLRMLGNTTASGDGSSNGAFFRAVLSVRSKKYDEARIFVERARRCLATELAALVLESYERAYNNMVRVQQLSKLEEVIDYCTLPAESPIADGRRELIRNMWNERIKGTKRNVEVWQALLAVRELVLPPNEDRDTWIKFAKLCWKNGRISQARSTLVKLLQFDPESSPELTLYHAHPQVALAYLKYQYAVGDELKRRDAFSRLQELSMQLATAMGNFPGTSANHGTMSNAGVPLIARVYLTLGTWKKALSPALDDDSIQEILISYNHATLSAKDWGKAWHTWALFNTEVMSRYTFRGRPDIAGKYVVAAVTGYFYSIACQSTTKGVDDSLQDILRLLTLWFNHGATSEVQTALQKGFSLVKIEMWLVVLPQIIARIHSNTRVVRELIQSLLVRIGKGHPQALMYPLLVACKSISILRQRAAQEVVDKIRQHSGGLVDQAQLVSKELIRVAILWHEMWHEALEEASRMYFGEHNIEGMLAVLEPLHAMLERGPETIKENAFIQAYGHELLEAHECCSKYRATGEDAELTKAWDLYYHVFRRIDKQLPSLTTLDLHSVSPELLKCRKLELAVPGTYAADSPLVTIEYFVPQLIVITSKQRPRKLTIHGSDGNDYAFLLKGHEDLRQDERVMQLFGLVNTLLENSRKTSEKDLSIQRYAVIPLSPNSGLIGWVPNCDTLHALIREYRDARKIFLNQEHKLMLAFAPDYDHLPLIAKVEVFQHALQNTEGNDLAKVLWLKSRTSEVWLERRTNYARSLAVMSMVGYLLGLGDRHPSNLMLDRYSGKILHIDFGDCFEASMNREKFPEKVPFRLTRMLVKAMEVSGIEGTFRTTCENVMQVLRTNRDSVMAMMEAFVHDPLINWRLFNFNEVPQVSNYGNAHAHTVVSSEDAVANRELMQPQRGARERELLQAVNQLGDANEVLNERAVAVMARMSDKLTGRDFSSGSALAGAGSSTQHGSEHLASGDARDAQPALSVKVQVQKLILQATSHENLCQNYVGWCPFW

SEQ ID NO: 21514 - DNA, 2280 bp, Sorghum bicolor
  misc_feature: Ceres ANNOT ID no. 8731992
  misc_feature: Up-regulated in shoot tissues in response to methyl jasmonate treatment
  misc_feature: Up-regulated in root tissues in response to methyl jasmonate treatment
  misc_feature: Encodes the peptide sequence at SEQ ID NO 21515
atgggtcgcttcacgatttcgccccttgcatacgcccttgtattggtcgccgcggcgtgccccgtgctggcctatgtccctcacggcgccgcggcaccgcggcggagcaccggcgccgcccgcgagcatcacgccaacgcccgaacttacatcgtcctggtcgagcctccgcctgcgagcacccaggaagaagacgaggccgcgcaccgccggtggcacgagtcgttcctccagagctccggcggcggtgtccgccgccgcggcgttcgccactcgtacaccagcgtgctctccggcttcgccgctaggctgaccgacgacgagctcgcggccgtgtccaggaagccagggttcgtgcgcgcgttcccggaacgcagggtgccgctcatgacgacgcgcacaccggggttcctcgggctcactcccgacggcggcgtctgggacgccaccggctacggcgagggcaccatcattgggtttctggacaccgggatcgacgagaagcacccttcgttccgcgacgacggcatgccgccgccgccgcccaggtggaagggcgcctgccagcctcctgttcggtgcaacaacaagctcatcggcgcggcgtcgttcgtcgtggacaacaccaccaccgacgacgtcggccacggcacgcacaccaccggcactgcggccggccggttcgtggaaggagtctcggccttcggccttggcggcggtggcaccgctgccgggacggcacccggcgcgcacctggccgtgtacaaggtctgcgacgcccaagggtgcttcgagtccgacttgctggccgggatggacgccgccgtgaaggacggcgtcgacgtcctctcggtgtccctcggcggcgtctccacgccgttggacaaggaccccatcgccatcggcgcgttcgcggcggtgtccaagggcgtcctcgtcgtgtgcgccggcggcaacagtggccctctgccctccacgctgtccaacgaagcgccgtggatactgaccgtggcggccgggtctgtggaccggagcttccgtgccagcgtgcggctcggcgacggcgagatgttccaaggcgagtcactgactcaggacaagcacttcagctccaaggtgtatccgctctactactcaaacggcatcaacttctgcgactacttcaacgtcaacatcaccggcatggtggtcctgtgcgacaccgagacaccggtgccaccgatgagctccatcgaggcggtccgcgaggctggcggcgccggcgtcgtgttcgtcaacgaaccagacttcggatacaccatcgtcttggagaaatactacaacctccccatgtcgcaggtgaccgcggtggacggcaccaagataatgggctacgccatgaagggtgcgtccacggccaaccatacggcaacgatcgtgttcaacagcacagtcgtcggcgtgaagccggcgccgatcgtggcagccttctcgtcgcgcggccccagcgttgccagcccaggcgtgctgaagcccgacgtcatggcgccggggctcaacgtcctcgcggcgtggccgtcggaggtgcccgtcgggggccccgagtcgaacagcttcaacgtcatctccggcacgtccatggcgacgccgcacatcaccggcatcgtggcgctcgtcaagaaggcgcacccggactggtcgcccgccgcgatcaagtccgccatcatgaccacgtccagcgccgtcgacaacgacggcaaccagatcatggacgaggagcaccggaaggcgagcttctacgccctcggcgccggccacgttgtcccgacgaaggccgtagaccccggcctggtgtacgacctcggcgtccgcgactacgccggctacatctgcaggctcctcggcgaggcggccctgaaaaccatagccggaaacaccagcttgacctgcactgaggtcgagcctatcaccggggcgcagctgaactacccggcgatactggtgccgctgcgagctgaggcgttcgccgtgaaccggacggtgacgaacgttgggccggcgaagtcgagctacaccgccaagatcgaagcgccgaaaggactgacggtcaaggtggagccggcggagctggagttcaccaaggaaaatgagaggaagacgttcacggtcacggtgagcgcagccgccggagccagcagcgagcagaagctcgccgaaggggccctgagctggttgtcccaagaccatcatcacgtcgtgaggagcccaatcgtggccgactccagccttaccctgagttga

SEQ ID NO: 21515 - protein, 759 aa, Sorghum bicolor
  misc_feature: Ceres ANNOT ID no. 8731992
  misc_feature: Up-regulated in shoot tissues in response to methyl jasmonate treatment
  misc_feature: Up-regulated in root tissues in response to methyl jasmonate treatment
  misc_feature (63)..(754): SWISSPROT Homolog: EC 3.4.21.25 Cucumisin
  misc_feature (141)..(596): Pfam ID: Peptidase_S8 Pfam Description: Subtilase family
  misc_feature (48)..(130): Pfam ID: Subtilisin_N Pfam Description: Subtilisin N-terminal Region
MGRFTISPLAYALVLVAAACPVLAYVPHGAAAPRRSTGAAREHHANARTYIVLVEPPPASTQEEDEAAHRRWHESFLQSSGGGVRRRGVRHSYTSVLSGFAARLTDDELAAVSRKPGFVRAFPERRVPLMTTRTPGFLGLTPDGGVWDATGYGEGTIIGFLDTGIDEKHPSFRDDGMPPPPPRWKGACQPPVRCNNKLIGAASFVVDNTTTDDVGHGTHTTGTAAGRFVEGVSAFGLGGGGTAAGTAPGAHLAVYKVCDAQGCFESDLLAGMDAAVKDGVDVLSVSLGGVSTPLDKDPIAIGAFAAVSKGVLVVCAGGNSGPLPSTLSNEAPWILTVAAGSVDRSFRASVRLGDGEMFQGESLTQDKHFSSKVYPLYYSNGINFCDYFNVNITGMVVLCDTETPVPPMSSIEAVREAGGAGVVFVNEPDFGYTIVLEKYYNLPMSQVTAVDGTKIMGYAMKGASTANHTATIVFNSTVVGVKPAPIVAAFSSRGPSVASPGVLKPDVMAPGLNVLAAWPSEVPVGGPESNSFNVISGTSMATPHITGIVALVKKAHPDWSPAAIKSAIMTTSSAVDNDGNQIMDEEHRKASFYALGAGHVVPTKAVDPGLVYDLGVRDYAGYICRLLGEAALKTIAGNTSLTCTEVEPITGAQLNYPAILVPLRAEAFAVNRTVTNVGPAKSSYTAKIEAPKGLTVKVEPAELEFTKENERKTFTVTVSAAAGASSEQKLAEGALSWLSQDHHHVVRSPIVADSSLTLS

SEQ ID NO: 21516 - DNA, 840 bp, Sorghum bicolor
  misc_feature: Ceres ANNOT ID no. 8731998
  misc_feature: Down-regulated in root tissues in response to salicylic acid treatment
  misc_feature: Encodes the peptide sequence at SEQ ID NO 21517
atggccgcctcggaggccaataataagcagcagccgcgacgccaccacttcatgctggtgcacgggatatgccacggcgcgtggtgctggtacaaggtggccacagcgctgcggcgtgccggccaccgcgccacggcgctcgacatggccggctgcggcgcgcacacggcgcgtctcgccgacgtgcacacgttcgaggagtactcacgcccgctgctcgacgcgatggccgcgttgcccgccggggagcaggtcgtgctcgtcgcgcacagccacggtgggtccagcgtcgcgctcgccgtcgagaggttcccggaaaaggtcgccgctgccgtgttcgtggccgcaatgatgccggccgtcggacgtcctatggctgccaccagtgacgagctaaaagcatttgttggaccggacttcttcctggactcaaaggagctcgaacaagagaatcccgaaatcaagggcaggccatttatctttgggcccaactgtatggccgaaaagctttaccaattgagcccaccggaggacttgactctgggtctgatgcttatcaagccggcgaacgcattcagcactggcaacccagacgacgaagcggtgacgagggacgagaagctgctcacggaggaagggtacgggtcggcgcggcgcgtgttcgtcgtggtggaggaagaccgcgccatcccggcggagttccagcgccgcatggtggcgcagagccccggcgtcgaggtgaggacggagatcaccggagctgaccacatggctatgctctcgcggccagtggagctggttcagctcctcgtcagcattgccgaccaatcggaagagtga

SEQ ID NO: 21517 - protein, 279 aa, Sorghum bicolor
  misc_feature: Ceres ANNOT ID no. 8731998
  misc_feature: Down-regulated in root tissues in response to salicylic acid treatment
  misc_feature (4)..(275): SWISSPROT Homolog: EC 3.1.1.78 Polyneuridine-aldehyde esterase
  misc_feature (42)..(272): Pfam ID: Abhydrolase_1 Pfam Description: alpha/beta hydrolase fold
MAASEANNKQQPRRHHFMLVHGICHGAWCWYKVATALRRAGHRATALDMAGCGAHTARLADVHTFEEYSRPLLDAMAALPAGEQVVLVAHSHGGSSVALAVERFPEKVAAAVFVAAMMPAVGRPMAATSDELKAFVGPDFFLDSKELEQENPEIKGRPFIFGPNCMAEKLYQLSPPEDLTLGLMLIKPANAFSTGNPDDEAVTRDEKLLTEEGYGSARRVFVVVEEDRAIPAEFQRRMVAQSPGVEVRTEITGADHMAMLSRPVELVQLLVSIADQSEE

SEQ ID NO: 21518 - DNA, 1575 bp, Sorghum bicolor
  misc_feature: Ceres ANNOT ID no. 8732236
  misc_feature: Up-regulated in shoot tissues in response to methyl jasmonate treatment
  misc_feature: Encodes the peptide sequence at SEQ ID NO 21519
atggaagctatccgccttgcctacgtgctcgtcttcctcctgcccttcttcctcctcctcctccgtctccgtaagcgcccagcaacaacgacggcccactccccgcaccccaacccggtcctgggcaacaccctcgccttcatccgcaaccgccgccgcttcttcgactggtacacggacctgctccgcgccgcgccgtcgggcgccgccgtcgaggcgtgggggccgtttggcgcgggccacgccgtcaccaccgcgagccccgccgacgtcgaccacctcctgcgcgccggcttcgacggctacgccaggggcgcgctcttccgcgacgccaccgccgacctcatcggcgacgggctcttcgccgccgacggccgcctctggagcctccagcggaagctcgcctcgcacgccttctcgtcccgctcgctccgccgcttcaccggcgacgtcctcgccgtgcacctgcgccgccgcttcctgccgctcctggacgccgccgccgccagggacggcggcgatgttgccgtcgacctgcaggacgcgctgcgccggttcggcttccgcaccatctgccacgtcgcgttcggcgtagagggcttggatggcaacgacgacgaggaccccgcgacgcaggaggcgctcttcgcggcgttcgacacggccgtcgagatctccttccggcgcgcgctcacgccggccacgttcgtgcggcggctcaccaagctcctggacgttggcaagtcgcgccggctccgggaggccgtccgtgtcatcgacgactacgccatgtccgtcgtcgaatccaaggcggcgcggcgccagaggaacaacctcgacgacgggagcgcggacctgctgtcgcggttcatggcggccacggacgacgacggcggcagcgagctcggcgccatgttcgccacgccagaggccaagctccggttcctgcgggacatggtcgtcaccttcgtactcgccgggaaggacaccacgtcgtcggcgctgacctggttcttctggctgctcgccgcgaacccgcggtgcgagcggcgcgcccacgaggaggccgcgtcatgctgcgacgacgacgacgacgacggcgacgtgaaggggatgcactacctgcacgccgccatcaccgaggcgatgcggctgtacccgccggtgccgttcaacggccgtgtcgcggtgcgcgacgacgtgctgccgggcggcgcggcggtgcgagcgggctggtacgccaactactcggcgtacgcgatggggcggatggagaagctgtggggcaaggactgcttggagttcgtgccggagcggtggctcggcgagcgcggcgagttcgtgccggtcgacgccgcgcggttcccggtgttccacgctggcccgcgggtgtgcctcgggaaggagatggcgtacgtgcagatgaagacggtcgccgcggccctactgcggaggtttagagtggacgtggtggcgccggtggctaacatggaggcgccgccagcgtacgagatgacggcgacgatgaagatgaaaggaggactgtgggtgcggctcaggaggcgcgaagactag

SEQ ID NO: 21519 - protein, 524 aa, Sorghum bicolor
  misc_feature: Ceres ANNOT ID no. 8732236
  misc_feature: Up-regulated in shoot tissues in response to methyl jasmonate treatment
  misc_feature (35)..(488): SWISSPROT Homolog: EC 1.14.14.1 Unspecific monooxygenase
  misc_feature (35)..(507): Pfam ID: p450 Pfam Description: Cytochrome P450
MEAIRLAYVLVFLLPFFLLLLRLRKRPATTTAHSPHPNPVLGNTLAFIRNRRRFFDWYTDLLRAAPSGAAVEAWGPFGAGHAVTTASPADVDHLLRAGFDGYARGALFRDATADLIGDGLFAADGRLWSLQRKLASHAFSSRSLRRFTGDVLAVHLRRRFLPLLDAAAARDGGDVAVDLQDALRRFGFRTICHVAFGVEGLDGNDDEDPATQEALFAAFDTAVEISFRRALTPATFVRRLTKLLDVGKSRRLREAVRVIDDYAMSVVESKAARRQRNNLDDGSADLLSRFMAATDDDGGSELGAMFATPEAKLRFLRDMVVTFVLAGKDTTSSALTWFFWLLAANPRCERRAHEEAASCCDDDDDDGDVKGMHYLHAAITEAMRLYPPVPFNGRVAVRDDVLPGGAAVRAGWYANYSAYAMGRMEKLWGKDCLEFVPERWLGERGEFVPVDAARFPVFHAGPRVCLGKEMAYVQMKTVAAALLRRFRVDVVAPVANMEAPPAYEMTATMKMKGGLWVRLRRRED

SEQ ID NO: 21520 - DNA, 1155 bp, Sorghum bicolor
  misc_feature: Ceres ANNOT ID no. 8732328
  misc_feature: Down-regulated in shoot tissues in response to salicylic acid treatment
  misc_feature: Encodes the peptide sequence at SEQ ID NO 21521
atggcctctcctcgccccacctccctctcctcccccgccgccctcatccacctccgcctccagcccctccccagcatcccgccgctccaccccactaccctccccttcccgcgctccctcccgctccacctcccctcgctccgcctcaacgggccccacctccctcctctccccggaagcggcatcaccggaaccggcggcgaggacggccttcctccctcgggcgggggaggcggagggggaggcggagatggcgagggcgagggcgagggcgatggcgagggcagcgacgacgcctcggtcaacaggagggaggccctgtttgttctggcgcagctcgggcggaagctcgagagcctgccggccgacctcgccgcggccgtggagggcggccgcatcccggccgagatcgtgcggcggttcgtggacctcgaggcctcgccggtgttcaggtggcttctgcagttcggtgggttcaaggagcgcctccttgccgacgacctcttcctcaccaaggtcgccatagagtgcggcgttggcatcttcaccaagactgctgcagagtatgagaaaaggagggagaactttgtcaaagagcttgactttgtgattgcagatgtggtcatggcaatagttgcagattttatgcttgtatggcttcctgctccaaccgtgtctttacagccaccactagcggtgaattctggagccattgctaagttcttctacaactgtccagataatgccttccaggttgctttgtctgggacatcatactcacttttgcagagagcaggagctattttgaggaatggtgcaaagctttttgctgtcggaactagtgcctctctggtcggcactggtgtgaccaatgcactgataaaagcaaggcaggctgccagcaaggattttgatggtgaagttgagaatcttccaattgtatcaactagtgttgcatatggtgtgtacatggcagtttccagtaacctcagataccaggttttggctggagtgattgaacagcggatgctcgagccactactgcaccaacacaaactagtattgagtgcagcaagttttgcagttcggacagggaatacgtttttgggttctctactgtggatcgactatgccaggtgggtaggcgtacaatag

SEQ ID NO: 21521 - protein, 384 aa, Sorghum bicolor
  misc_feature: Ceres ANNOT ID no. 8732328
  misc_feature: Down-regulated in shoot tissues in response to salicylic acid treatment
MASPRPTSLSSPAALIHLRLQPLPSIPPLHPTTLPFPRSLPLHLPSLRLNGPHLPPLPGSGITGTGGEDGLPPSGGGGGGGGGDGEGEGEGDGEGSDDASVNRREALFVLAQLGRKLESLPADLAAAVEGGRIPAEIVRRFVDLEASPVFRWLLQFGGFKERLLADDLFLTKVAIECGVGIFTKTAAEYEKRRENFVKELDFVIADVVMAIVADFMLVWLPAPTVSLQPPLAVNSGAIAKFFYNCPDNAFQVALSGTSYSLLQRAGAILRNGAKLFAVGTSASLVGTGVTNALIKARQAASKDFDGEVENLPIVSTSVAYGVYMAVSSNLRYQVLAGVIEQRMLEPLLHQHKLVLSAASFAVRTGNTFLGSLLWIDYARWVGVQ

SEQ ID NO: 21522 - DNA, 1788 bp, Sorghum bicolor
  misc_feature: Ceres ANNOT ID no. 8732437
  misc_feature: Down-regulated in shoot tissues in response to aminocyclopropane carboxylic treatment
  misc_feature: Encodes the peptide sequence at SEQ ID NO 21523
atgacgacggcggccggcatgccggggtcgtcgccggtgggctcggcggcggccgcggctggcggtcccgcggcgcccgaggtggcggcaagggacgcggtgatcgggtggttccgcggcgagttcgccgcggccaacgcgatgatcgacgcgctgtgcggccacctggcgcagatcggcggcggcggcgccgagtacgaccccgtcttcgccgcgctccaccgacgccgcgccaactggttccccgtcctccacatgcagaagttctaccccgtcaccgacgtcaccgccgagctgcgccgcgtcgcggacgcccgcgccgccgccgcagccgccgccgtcgcggggtcctgctgctactcggaggaggccacgtccacggtgatccaggagcccatggaagacctccccgctgaggctgaggctgaggctgagcctgagcccgaactggagccggagcacgagcaggatcctgtactacaggatccggcaccggcggccgaggaggctgacggcaccgtcatcgaccccgccgtggagtaccacgagcaggacgcggaggtggattcctccggggattcgtcggagcggaaggccccctccacggaagacgacaccgtagcagacggacatcatactgatcaaggatctcaaggggaacacagcctaccagagagctatcccatctgctctgaccacgaggagtgcattgcccgtcctgagaggatcaagatccagaaaggtttcgtggccaaggaatccgtgaaggggcacatggttaatgtcgtcaaaggcttgaagatatatgaagacgtctttacaacatcggagatcgtgaaagttgcagatttcatcaatgaaattcgtcaggctggcagaaatggagaactttcaggtgagactttcatattcttcaacaagcagatcaaaggaaacaagagggagatcatacagctcggtgtcccgttatttcaacctaccacagaggaagctaattgtcacacagaaccaatcccccttgtcctgcaggctgtcattgaccaccttgttctttggcgtttaataccagaaagcaggaagccaaacagtgtcatcatcaacttcttcgatgaggatgaacattcgcagccctacttcaagcctccccatctggacaaccccatttgcactcttctgctgtctgaaactacgatggcatttggcaggtcactcgtcactgacagcaacggcaactacaagggacctctcacactctcactaaagcaagggtccctattagtgatgcgtgggaacagtgccgacatggcgcgccatgtggtgtgtccgtcgtccaaccggcgcgtgagcatcacgttcgcaagggtgaggccatccacgccggtggacctgagcccactcccgtcccccaccaaggctatgacgccctggcagccgcagccggccactggctcccaggtggcggcgcccgcgtgcatgacgcagaagcccccggtcagcggtgccatcatcggttatgccccgacaccgcaggccgtgctggcgcccgcggcctggggcatggccatgcgcgcgcccgtcatgatggtggccgcagcgcctgcgaggcccatggtgatggcctcgtcgggcaccggcggcggcaacatcagcaagcggatgggccgcagcggcaccggcgtgttcctgccgtggacggtcgggccgaagcggtacaacaagcaccttccgccgcgcatccagaagcgccggttctcggcgatgatgtcgcccatcgaggcgcagggctga

SEQ ID NO: 21523 - protein, 595 aa, Sorghum bicolor
  misc_feature: Ceres ANNOT ID no. 8732437
  misc_feature: Down-regulated in shoot tissues in response to aminocyclopropane carboxylic treatment
  misc_feature (360)..(456): Pfam ID: 2OG-FeII_Oxy Pfam Description: 2OG-Fe(II) oxygenase superfamily
MTTAAGMPGSSPVGSAAAAAGGPAAPEVAARDAVIGWFRGEFAAANAMIDALCGHLAQIGGGGAEYDPVFAALHRRRANWFPVLHMQKFYPVTDVTAELRRVADARAAAAAAAVAGSCCYSEEATSTVIQEPMEDLPAEAEAEAEPEPELEPEHEQDPVLQDPAPAAEEADGTVIDPAVEYHEQDAEVDSSGDSSERKAPSTEDDTVADGHHTDQGSQGEHSLPESYPICSDHEECIARPERIKIQKGFVAKESVKGHMVNVVKGLKIYEDVFTTSEIVKVADFINEIRQAGRNGELSGETFIFFNKQIKGNKREIIQLGVPLFQPTTEEANCHTEPIPLVLQAVIDHLVLWRLIPESRKPNSVIINFFDEDEHSQPYFKPPHLDNPICTLLLSETTMAFGRSLVTDSNGNYKGPLTLSLKQGSLLVMRGNSADMARHVVCPSSNRRVSITFARVRPSTPVDLSPLPSPTKAMTPWQPQPATGSQVAAPACMTQKPPVSGAIIGYAPTPQAVLAPAAWGMAMRAPVMMVAAAPARPMVMASSGTGGGNISKRMGRSGTGVFLPWTVGPKRYNKHLPPRIQKRRFSAMMSPIEAQG

SEQ ID NO: 21524 - DNA, 2001 bp, Sorghum bicolor
  misc_feature: Ceres ANNOT ID no. 8732536
  misc_feature: Up-regulated in shoot tissues in response to methyl jasmonate treatment
  misc_feature: Up-regulated in root tissues in response to salicylic acid treatment
  misc_feature: Up-regulated in shoot tissues in response to salicylic acid treatment
  misc_feature: Encodes the peptide sequence at SEQ ID NO 21525
atggacgtccccgattccggcggtggcgcgccggatgccggcgagcccatctgggactggggcaatctcctcgacttcgtcgtccaggatgacgactccctggtcctcccgtgggacgacgccgccgccggtatagcagcagcagccgaccccaccgaggctgccacggcaccactgctccccgcctcgcccccgctaccgcagccggtggaggtagagccggagccggagccggagccggaaccggaaccggggccagtgcttccgccgccgcctcttcgggttcaggggatcgggcgccgcgtcaggaagcgggacccgcggctggtgtgcccgaactacctcgcggggagggtcccgtgcgcgtgccccgaggtggacgagatggtcgccgctgccgaggtggaggacgtggccacggagttcctggctggcgcgcggaagaagactaagactgcagctgctgctgctcgccgtagcaaggcggcagctgcaggcgctgcccccggagctgcaggaggaggagctgcccgcgcggcggcggcggagatgaagtgccaagtgcctggatgtgaggccgacatacgggagctgaaagggtaccaccgccggcaccgtgtgtgtctgcgctgcgcgcacgctgctgctgtcatgctcgatggcgtccagaagcgctactgccagcagtgcggcaagttccatatattactagattttgatgaagataaaaggagttgtagaagaaagttggagcggcataacaaaagaagacgaagaaaacctgattccaaaggaacattagataaagaaatagatgaacagttggatctgtcagcagatgttagtggcgatggtgaacttagagaagccctccagtcaactgcagtggcagttgtttcaaatagagttggcagtcgcggccgatctgcagtagctggcagcagtggtggctttggtttgccacaagcccacaacagagtattctctattttaagtataacagcaacaccttactattcaaaattactgttgaagcttaaaaaaagtggagaaaaggaaaagaacatggaaggcacaaccagtgagatgcttgagaccgttcttagcaacaaggtgttggaccgagaaacacctgtgggatctgaagacgtgcttagttcacctacctgtacacaacctagtttgcaaaatgaccaaagtaaaagtgtagtgacttttgcagcttctgttgaagcctgcattggtgcaaagcaggaaagtgtgaaacttgtcaattccccaatgcatgacaccaagagtgcctattcatcctcgtgtccaacagggcgcatctcattcaagttgtatgactggaatcctgcagaatttcctcgacgcctacgtcaccagatcttcgagtggttggctagcatgcctgttgaattggagggctacattcgtccgggttgtactattttaactgtatttattgcaatgccgcagcatatgtgggacaagttatcagatgatgcagcagatcttctcagaaacttggtaaattccccaaacagtcttctgttgggtaaaggggccttctttattcatgtcaataacatgttatttcaagtactaaaagatggagcaacactgatgagtaccagattagatgtacaagccccaaggattgattatgttcatccaacatggtttgaagcagggaaacctggcgatcttatcctttatggaagttctcttgaccaaccgaacttcaggtcacttctgtcttttgatggggactatttgaagcatgattgctaccgtttaacatcgcatgatacctttgaccgcgttgagaatggtgatcttattcctgattctcaacacgaaattttccgaattaacattactcaatcaagaccagatattcatggacctgcatttgtggaagtaagtattgttttcattggcaattttgaccaatttcatcatttaactatagtctggagcatcctattttattaa

SEQ ID NO: 21525 - protein, 666 aa, Sorghum bicolor
  misc_feature: Ceres ANNOT ID no. 8732536
  misc_feature: Up-regulated in shoot tissues in response to methyl jasmonate treatment
  misc_feature: Up-regulated in root tissues in response to salicylic acid treatment
  misc_feature: Up-regulated in shoot tissues in response to salicylic acid treatment
  misc_feature (185)..(263): Pfam ID: SBP Pfam Description: SBP domain
MDVPDSGGGAPDAGEPIWDWGNLLDFVVQDDDSLVLPWDDAAAGIAAAADPTEAATAPLLPASPPLPQPVEVEPEPEPEPEPEPGPVLPPPPLRVQGIGRRVRKRDPRLVCPNYLAGRVPCACPEVDEMVAAAEVEDVATEFLAGARKKTKTAAAAARRSKAAAAGAAPGAAGGGAARAAAAEMKCQVPGCEADIRELKGYHRRHRVCLRCAHAAAVMLDGVQKRYCQQCGKFHILLDFDEDKRSCRRKLERHNKRRRRKPDSKGTLDKEIDEQLDLSADVSGDGELREALQSTAVAVVSNRVGSRGRSAVAGSSGGFGLPQAHNRVFSILSITATPYYSKLLLKLKKSGEKEKNMEGTTSEMLETVLSNKVLDRETPVGSEDVLSSPTCTQPSLQNDQSKSVVTFAASVEACIGAKQESVKLVNSPMHDTKSAYSSSCPTGRISFKLYDWNPAEFPRRLRHQIFEWLASMPVELEGYIRPGCTILTVFIAMPQHMWDKLSDDAADLLRNLVNSPNSLLLGKGAFFIHVNNMLFQVLKDGATLMSTRLDVQAPRIDYVHPTWFEAGKPGDLILYGSSLDQPNFRSLLSFDGDYLKHDCYRLTSHDTFDRVENGDLIPDSQHEIFRINITQSRPDIHGPAFVEVSIVFIGNFDQFHHLTIVWSILFY

SEQ ID NO: 21526 - DNA, 1179 bp, Sorghum bicolor
  misc_feature: Ceres ANNOT ID no. 8732564
  misc_feature: Up-regulated in shoot tissues in response to salicylic acid treatment
  misc_feature: Up-regulated in root tissues in response to salicylic acid treatment
  misc_feature: Encodes the peptide sequence at SEQ ID NO 21527
atgaagttcttcagtggttatgaggacataaattttgatgatgaccttttgcctcttggttctaatgatcaaatatcttctggaattttgggtactgaaaaagattcttttgcacctgtgctggatgttcctggccgagataaagaagaatcctcagttgggacttctggatttatagaacagaaggacaccagcagtgttgcagatatgcttcctgatcttaatttgaatcattttgcttctacggcttcagctcactcaagccattctgttagtattgagtctcttgaggattctgttgctgatgccagaagcaataagaatgatctgttaccttctctagagttggttacaaaaatgatagaggatgttgagcttcttgaagaaaaggctaaagtagccaagcatgaagcatctgttgctgggacaggcattctgaccaaagttgaggagctcagagaaatgttaactcatgcaaaggaagcaaatgatatgcatgctggcgaggttttcggtgagaaagctattttaaccacagaggcacgtgagcttcaatcacgacttcagaggctttcagatgagaggaataaatatctggtgataattgaagagatacgccaaactcttgatgaaagattggctgctgcacaacaagaaattgcagcagctgagaaagaaaagattgaaaaggaggctgctgctcaggcactacttgatgaacaggaaaagacgatgaattctattgttgaagaatcaagaaagctgcagatagcagctgaggagaacctgaagttgaaggaattcttggttgagcgggggcaaattgttgatatgctgcaaggtgagatggccgtgatctgtgaggacgtttcgttgctcaagcgagtggtggatgagcgcctatcattgagcaagttgcagcgctcagctatgtcgagcctctcttcttcactgcattcttctcaacacaagagctggacttcctcggataggactactgaagcaatggagtctccagataagcgcacccttgttgaacctgcaagcccagtgtgcaaagatctggatggcgatgacgacgagtgcactgtggaagtgtcatatggcaacgacactggtaaaggtatcttgaagcgcgtgaattccaaggaggacggtgatggatgggagctttgctga

SEQ ID NO: 21527 - protein, 392 aa, Sorghum bicolor
  misc_feature: Ceres ANNOT ID no. 8732564
  misc_feature: Up-regulated in shoot tissues in response to salicylic acid treatment
  misc_feature: Up-regulated in root tissues in response to salicylic acid treatment
MKFFSGYEDINFDDDLLPLGSNDQISSGILGTEKDSFAPVLDVPGRDKEESSVGTSGFIEQKDTSSVADMLPDLNLNHFASTASAHSSHSVSIESLEDSVADARSNKNDLLPSLELVTKMIEDVELLEEKAKVAKHEASVAGTGILTKVEELREMLTHAKEANDMHAGEVFGEKAILTTEARELQSRLQRLSDERNKYLVIIEEIRQTLDERLAAAQQEIAAAEKEKIEKEAAAQALLDEQEKTMNSIVEESRKLQIAAEENLKLKEFLVERGQIVDMLQGEMAVICEDVSLLKRVVDERLSLSKLQRSAMSSLSSSLHSSQHKSWTSSDRTTEAMESPDKRTLVEPASPVCKDLDGDDDECTVEVSYGNDTGKGILKRVNSKEDGDGWELC

SEQ ID NO: 21528 - DNA, 1800 bp, Sorghum bicolor
  misc_feature: Ceres ANNOT ID no. 8732604
  misc_feature: Down-regulated in root tissues in response to methyl jasmonate treatment
  misc_feature: Encodes the peptide sequence at SEQ ID NO 21529
atggctgaggatgccagaggagagaagaaggatgccgacctgtcggcggcggtgaagatgccggcgaagcaacggggagggttcaggaccatgcccttcatccttgcgaatgacttctgcgaccggcttgcgtcggtggggttcacgacgaacctgatctcgtacctcaccctgcagctgcacctgccgctcgtccaggcctccaacatcatcaccaactacaacggcaccgccaacctcactccgctcatcggcggtctcatcgccgactcctttgccggccgcttctggaccatcacattcggctccatcatctaccagctcggcatggtctgcctcaccctctccgccgcgctcccgtcgctgcacccgccaccctgcgccaagcacgccgcagactgccagcgcgcgtcctcctaccagatttccgtgctctacctgtctctgctctgcacctcgattggcaccggcggcacgcgcccctgcaccatggcgttcggcgccgaccagctcgagctgaacgacgcgcacagcaggcacaagcccaagtggagcttctttaacctctacttcttcgccgtcgagctcgcgaagctcgcggcggtgaccgccgtggtgtacatccaggacaacgtcgggtggggttgggggatcggcgtgcctaccgtcgccatggtcgccgcggtgatcatcttcgtgtccgggtacaagctctacatcaggatgccgcccggcggcagccccctggtccgcttggcgcaggtcgctaccgcggcctacaagaagcggaacgccgtcgtgccggacccgagcctcctgtacgaggacaaggagctcgacgctggcatctccaccaccggccgccttcttcacaccgaccagctaaagttctttgacaaggcggctatagtgacggacggcgacgtgctaccgtcaggccagccgaacctatggcggctgtcgacggtgcaccgcgtcgaggagctcaagtcgatcatacgcatgctgccgatctgtgccgccggcatcatcctggtgacatcggcgtcgcacaatcacagcttcgccatccagcaggcccgtaccatggaccgggacatcacgccgcacttcaagatcccgccggcctccatgctcatcttcaccaacgtcggcatgctgctgaccctggccttctacgaccgcgtgctcgtccgcgtgctgcgccgcttcacgggccgccccaacggcatcacccacctccagcgcacgggcgtcgggctgacgatcgccatgctgtccaacgtggtggccgcggtcgtcgagcggaggcgcaagtccgtggccgccgcgagtgggctgctcgacgctcccaagggcgccaccctgccgatgagcgtcttctggctggtgccgcagtacgccatccacggcgtcgccaacgccttcatggacgtcggccgcatggagttcctgtacgaccaggcacccgagagcatgcggagcacggcgacggcgctctactggctgaccttctcgatagggagctacctcggcacgctgctggtgaccatcgtgcacgacaagacgcggcgaagcgggcagtggctcccggacaaccttaaccgagggaagctagacaactactactggcttgtcgtggctctggaggtggtcaacctcgtctacttctttatctgcgctaagtactacacctttaagccattggagatggttagcggagaggaggtcgagctccaccaccatggcaatggcaatggcaccgacgatgccaagaagcagggtgcaagcttcaagtag

SEQ ID NO: 21529 - protein, 599 aa, Sorghum bicolor
  misc_feature: Ceres ANNOT ID no. 8732604
  misc_feature: Down-regulated in root tissues in response to methyl jasmonate treatment
  misc_feature (96)..(505): Pfam ID: PTR2 Pfam Description: POT family
MAEDARGEKKDADLSAAVKMPAKQRGGFRTMPFILANDFCDRLASVGFTTNLISYLTLQLHLPLVQASNIITNYNGTANLTPLIGGLIADSFAGRFWTITFGSIIYQLGMVCLTLSAALPSLHPPPCAKHAADCQRASSYQISVLYLSLLCTSIGTGGTRPCTMAFGADQLELNDAHSRHKPKWSFFNLYFFAVELAKLAAVTAVVYIQDNVGWGWGIGVPTVAMVAAVIIFVSGYKLYIRMPPGGSPLVRLAQVATAAYKKRNAVVPDPSLLYEDKELDAGISTTGRLLHTDQLKFFDKAAIVTDGDVLPSGQPNLWRLSTVHRVEELKSIIRMLPICAAGIILVTSASHNHSFAIQQARTMDRDITPHFKIPPASMLIFTNVGMLLTLAFYDRVLVRVLRRFTGRPNGITHLQRTGVGLTIAMLSNVVAAVVERRRKSVAAASGLLDAPKGATLPMSVFWLVPQYAIHGVANAFMDVGRMEFLYDQAPESMRSTATALYWLTFSIGSYLGTLLVTIVHDKTRRSGQWLPDNLNRGKLDNYYWLVVALEVVNLVYFFICAKYYTFKPLEMVSGEEVELHHHGNGNGTDDAKKQGASFK

SEQ ID NO: 21530 - DNA, 3321 bp, Sorghum bicolor
  misc_feature: Ceres ANNOT ID no. 8732623
  misc_feature: Down-regulated in root tissues in response to salicylic acid treatment
  misc_feature: Encodes the peptide sequence at SEQ ID NO 21531
atggcggaggcggtggtcggctggctggtgtgcccgatcatcaagaccgtcgtcgaaaaggccgccgccgacaggatcaagtggatgggcgacggcgtccccaaggcgctcgagcgcctccggagcacgctggtccatctccagaccgtggcgagcgccgtccagctgcggggctccacggacaggtgccggaacctccgtgcgtggctgcagcagctcatggacgccgtgtacgaagcccaggacgtcctcgacgacttcgacgacccacaccctgaatcctccgtcgtcaggttcggcaagcggatcttgggcgccgacgagcgcgtcaacaggctcaaggtcgtcgtcgcgaagctggaggccatccacgatggctcttcgatgctgctgtcagccacggagaccatcgcggcggcgtcggtgtcgcgccaaccgagcggcagcaaccacacgggccccatgcgcccggacgaggacgccgtggtcgggcgccagaaggagctgcaagagatggtgtcctggctcgtcgacacgcccacgcccgacgccgacgccaagcccgtgtccgtccccatcgccgcgatccggggccatggcgggatggggaagaccacgctggcgcagctcctgttcaaggatcataaggtaatctccgccttcgagctcatgatctgggtccggcctgacgccaaggacaacgagtttgagctcgccaggcaaatcctgcagtccgccaatgtggatgtgcccgacagtatgaagaacttccacaggctacaaactgacctccaggaaaaagtctcgtcgcgcaagttcctgctgctgattgacgatgtctggaacagggaggacatggacatgaaggggattgactaccgtgagatgtgggctaaggtgctggcacccctcaggcacggggagccaaaggggagcaagattgtggtcaccacccggcaaaagatagtggtgacagcgcttaaagcacgcgagttctacttgggagacttgccagacaatgatatctggtctctgttcacaaggtatgcctttggtgacgacaacattgataagcagtctcctgagctgcaaggcattgggaggaaaatcgctgaaaagctcaggggctcaccattgttggcgaaggcagtcggacagatgctgggaggaagacgcagggaagaccattggaggaacgtgcttgagatggacggcttcgatgatgtttccaaaacattggagttgtgctaccagaatttaccagagcacctgcaaccatgctttgcaatctgtagcttgttcccaaagaactggaggttcaagcgcgataagctggtgaagatttggatggcccttgatttcatccagccaactagtgggaaggtccaattggaggatgttggaagcgagtactttgatcagcttgtggataggtcatttttccacaggcaaaaggtggggcgtcggaggtattattacatccatgacctgatgcatgatttggccgagaagatttctcgatttgattgcgagagagttgaagatgcaaagaaagagatccccaagacaattcggcacttatctgtttccagtgatagtgatacggtggcacagctcaagagccgatgtgacctgaagagattgcgcacactactgattctcaagaacccttcctcttcgttggatcaactgccaggagattttttcacagagctgaaaggccttcgagttcttagtctggaaggctgcaatatcattcgtctatcggagaggattggaaaccttaaatacctcagatacctggcactttgcaaatcaatcaccaaacttccacaagcactgacaaagctctatcgtcttcaaaccttcagtagtcctaaggggtctggccttgaggtcccagaacatattgtaaacctgacacgtctgcgacatttggacatggatacatcaaaaatcactggcattgggaaactggttcacctgcagggatcagttaagttccatgttaaaaatgaagaaggccatactttaggagacttggatggtatgagcagtctgcgtaaagagcttcatataaagaaccttgatgttgtaacaaagcaagaagaagcctgcaaggctggattaaaaaggaaggacaatgttaaggtattggaattagaatggaactcgacttgtaagagtgttccctctgttgaggctaaagttttggatggtcttgagccgcaccaatatgttaaaaggcttataattagaagatatcatggtaatagatcaccaaactggctgagcacaagcttgaaggtgagcaacttcaacttcaaataccttcatttgatcaattgtagaaaatgggaggtcctgcctcctctcgggcagcttccatgtctcaaggttttgcatttgaaagaaatgtgttcagtgaaaaaaattggccgtgaattttatggaaccaatccaattgcatttccatatttggaggaacttgaatttgatgatatgcctcagtgggttgggtggacccaagaagagaagagcactgatatgtttcctaaactccgcaagttgacgattttgaactgtcctcagttgattaaggtgcctcagctccctctattcgtgcggaaggtctcagtaaaaaatacaggatttgtttcacagctaaaactatcctcctcttcctcgccatcaaaagcgcgcaagtttgcattagacacatgttctgccactgtccttacaaatggcttaatgcacaagcaacaactggaatcaattgctattttgactctgaggaactgtcaagatgtaaagtttgaagagcttcatgtgttgacttccttaaagaggttgcaaatatctcattcaagcataaatgatgagcagctatgcacttgtttgaggggtttacaagcgcttacctggctggagatatctaattgcaacaacatcacatgccttccacagatggaaagttcagactgcttaacaaaacttcacgagctacacattcagcagtgctctgaattttcctctctacactctatgccaagttttgaggcactagaaagtgtattgatcgaaaattgctccaagatcaccgtgaaatctttccccaccaacttcaacagcaacaccactctgagaaaactgagcataatgaattgtgctgagttggagtcattgccaagtggcttcccatcttctctgcaagtgcttcatctaattgggtgcaaaccaaatttgatgaaccaactacaactcaaggatggaccagaatgggataaagtagctagtattcccataaaacaaatacgttga

SEQ ID NO: 21531 - protein, 1106 aa, Sorghum bicolor
  misc_feature: Ceres ANNOT ID no. 8732623
  misc_feature: Down-regulated in root tissues in response to salicylic acid treatment
  misc_feature (144)..(460): Pfam ID: NB-ARC Pfam Description: NB-ARC domain
MAEAVVGWLVCPIIKTVVEKAAADRIKWMGDGVPKALERLRSTLVHLQTVASAVQLRGSTDRCRNLRAWLQQLMDAVYEAQDVLDDFDDPHPESSVVRFGKRILGADERVNRLKVVVAKLEAIHDGSSMLLSATETIAAASVSRQPSGSNHTGPMRPDEDAVVGRQKELQEMVSWLVDTPTPDADAKPVSVPIAAIRGHGGMGKTTLAQLLFKDHKVISAFELMIWVRPDAKDNEFELARQILQSANVDVPDSMKNFHRLQTDLQEKVSSRKFLLLIDDVWNREDMDMKGIDYREMWAKVLAPLRHGEPKGSKIVVTTRQKIVVTALKAREFYLGDLPDNDIWSLFTRYAFGDDNIDKQSPELQGIGRKIAEKLRGSPLLAKAVGQMLGGRRREDHWRNVLEMDGFDDVSKTLELCYQNLPEHLQPCFAICSLFPKNWRFKRDKLVKIWMALDFIQPTSGKVQLEDVGSEYFDQLVDRSFFHRQKVGRRRYYYIHDLMHDLAEKISRFDCERVEDAKKEIPKTIRHLSVSSDSDTVAQLKSRCDLKRLRTLLILKNPSSSLDQLPGDFFTELKGLRVLSLEGCNIIRLSERIGNLKYLRYLALCKSITKLPQALTKLYRLQTFSSPKGSGLEVPEHIVNLTRLRHLDMDTSKITGIGKLVHLQGSVKFHVKNEEGHTLGDLDGMSSLRKELHIKNLDVVTKQEEACKAGLKRKDNVKVLELEWNSTCKSVPSVEAKVLDGLEPHQYVKRLIIRRYHGNRSPNWLSTSLKVSNFNFKYLHLINCRKWEVLPPLGQLPCLKVLHLKEMCSVKKIGREFYGTNPIAFPYLEELEFDDMPQWVGWTQEEKSTDMFPKLRKLTILNCPQLIKVPQLPLFVRKVSVKNTGFVSQLKLSSSSSPSKARKFALDTCSATVLTNGLMHKQQLESIAILTLRNCQDVKFEELHVLTSLKRLQISHSSINDEQLCTCLRGLQALTWLEISNCNNITCLPQMESSDCLTKLHELHIQQCSEFSSLHSMPSFEALESVLIENCSKITVKSFPTNFNSNTTLRKLSIMNCAELESLPSGFPSSLQVLHLIGCKPNLMNQLQLKDGPEWDKVASIPIKQIR

SEQ ID NO: 21532 - DNA, 2286 bp, Sorghum bicolor
  misc_feature: Ceres ANNOT ID no. 8732685
  misc_feature: Down-regulated in shoot tissues in response to methyl jasmonate treatment
  misc_feature: Down-regulated in shoot tissues in response to salicylic acid treatment
  misc_feature: Encodes the peptide sequence at SEQ ID NO 21533
atggggaagggggcgaggagcgggaggcgcagccgtgcgtcaggcggcggcgggggtggacgctggagcaagcgcccgcggcgggtcgcggaggaggaacaggaggaagaggaagtagagccggtggagggggaggaggaggcggaggcggaggcggaggcggaagcggtggagggggaggactattgcttcgtctgcaaggacggcggtgacctccgcgtctgcgacttcaggggctgtcacaaagcttaccatcctgcttgcgtggagaaagataccgacttcctcaattcagatgaagaattcatctgtgagtggcatacttgctttatttgcaaagggcgttcacgctattattgcttttgctgtccatggcacaccttttgtcaaggttgcgtgaaacaagctgaattcgtccccgtcttgaggaagacaaagggattttgcaccaactgtttaaggatggcaatcatgattgagaagaatgttgatgttgactctgatggggagagggtcgatttcagtgataggacgacttatgaatttttattcaaggagtattgggaggagatagttaaagacaaggagggcatgactctagataagcttgaaaaagcatatgcttctctgaaaaaaggcctaaactgcaaacaagatctagatttagaaaaggttcgtgatgaagagcgcagttcagatgatgattttgtgggcaatagtgatgatgacgacgacaacaaaccatcttccataaccaagttcaatggagcatcaaatacaatgaaattcttcctgagggaagataagtcaatgaagaatggctatgtgggctggggttcaaaagagctcattgagttcctttcctcaataggcaaagatacattgaactccctagatcaacatggtgctgctgaagttgtgagggcatacattcaacaaaatggtctctttgcaaaagataataagaaaaaacttgtcctatgtgatgacaagctcaagaatttgtttaggaggtcaaaagtgaggtacaacaggatatttagcttgttaggaaagcatattgctgtggatatgacatcagaggatgaaacttttgtgaactccgacaataacaatgaaacatttgtgagaaagaagactcgtattgggaactacagttccaatactccagaaataaacaagaaatgttttgctgctcttgttcgtcataacattgatttaatctacttgaagaaatctttggttgtggatctactaaaggagccagatacatttgacagcaaagttattggttgttttgtgaaagtaaagatcgatccctacgattatagtttctacatgcataaaacattgcgccagcataaaaagctgcaccagcttggactagtaacaggcacaaggaaatcctctgaagaatacaagataaacaacgtatcgacagatgttattttatgtatttccagcatacctgatgtcaaaatttcgagtttgtcagatgacgaattcgacgaggaagaatgtcaagatcttcggctgctggccaagaatgaatcctttaaaaggcctactgttggtgagcttgaggagaaagcaagaagtttacgcagggacataatgagtcactggatcagtaaagaactccagaggctagaaagattaattgacagagcaagtgagaaagtcacaagtgaactttgtgctgtgtactgttgtatccttaactggttgcattttacgaagtttgaataccttgataagaaacagctcttacgaaatccatctgaacaacaacgtctacttgaagaggtcccacgagttattccagagatggaagatagtcaagataccgaatttcaagttacaggacaagacaaacctattcaaaagagtattgtcgctttacaaggtaccaatgggacagggtctccttttttgaagagctgcacagaaaaaaaattcaaagttactacggcctacactgatggtggtactgctgtaatacacacttcaaatcagagcactaaagctgccattgcattttctcctgtgctaccaaagtatttacatcgccaagctgccaccgaagccaataatgctggtgatatttcacctattcaaaagctggatgctgaaggtgctaaactaccaaagccaacactgccggtgaggcacctggagcatttttggaaaagcagtgtgctaaaggtgctgatgttattaccattgaagacgatgatgacggcaacaacaatcatccttgttataaaggacaacaaacagcagtag

SEQ ID NO: 21533 - protein, 761 aa, Sorghum bicolor
  misc_feature: Ceres ANNOT ID no. 8732685
  misc_feature: Down-regulated in shoot tissues in response to methyl jasmonate treatment
  misc_feature: Down-regulated in shoot tissues in response to salicylic acid treatment
  misc_feature (61)..(140): SWISSPROT Homolog: EC 2.1.1.43 Histone-lysine N-methyltransferase
  misc_feature (403)..(517): Pfam ID: Plus-3 Pfam Description: Plus-3 domain
  misc_feature (62)..(115): Pfam ID: PHD Pfam Description: PHD-finger
  misc_feature (279)..(355): Pfam ID: SWIB Pfam Description: SWIB/MDM2 domain
MGKGARSGRRSRASGGGGGGRWSKRPRRVAEEEQEEEEVEPVEGEEEAEAEAEAEAVEGEDYCFVCKDGGDLRVCDFRGCHKAYHPACVEKDTDFLNSDEEFICEWHTCFICKGRSRYYCFCCPWHTFCQGCVKQAEFVPVLRKTKGFCTNCLRMAIMIEKNVDVDSDGERVDFSDRTTYEFLFKEYWEEIVKDKEGMTLDKLEKAYASLKKGLNCKQDLDLEKVRDEERSSDDDFVGNSDDDDDNKPSSITKFNGASNTMKFFLREDKSMKNGYVGWGSKELIEFLSSIGKDTLNSLDQHGAAEVVRAYIQQNGLFAKDNKKKLVLCDDKLKNLFRRSKVRYNRIFSLLGKHIAVDMTSEDETFVNSDNNNETFVRKKTRIGNYSSNTPEINKKCFAALVRHNIDLIYLKKSLVVDLLKEPDTFDSKVIGCFVKVKIDPYDYSFYMHKTLRQHKKLHQLGLVTGTRKSSEEYKINNVSTDVILCISSIPDVKISSLSDDEFDEEECQDLRLLAKNESFKRPTVGELEEKARSLRRDIMSHWISKELQRLERLIDRASEKVTSELCAVYCCILNWLHFTKFEYLDKKQLLRNPSEQQRLLEEVPRVIPEMEDSQDTEFQVTGQDKPIQKSIVALQGTNGTGSPFLKSCTEKKFKVTTAYTDGGTAVIHTSNQSTKAAIAFSPVLPKYLHRQAATEANNAGDISPIQKLDAEGAKLPKPTLPVRHLEHFWKSSVLKVLMLLPLKTMMTATTIILVIKDNKQQ

SEQ ID NO: 21534 - DNA, 1542 bp, Sorghum bicolor
  misc_feature: Ceres ANNOT ID no. 8732667
  misc_feature: Down-regulated in shoot tissues in response to salicylic acid treatment
  misc_feature: Encodes the peptide sequence at SEQ ID NO 21535
atggggctgaagcaggcggcggcggcgggagcgggggcggcggcggcagcagcgcagaccgtccaccttgtccgccccggctgtacgggacacggttgcgcgcccccatgcgggaggctgaggccaccgcggggaagggccagggccccggccgccgccagggtcccagagacggcggcagtgccggccgagatcgctagggacggggtgctgtgcctggaggaggtcgacggcaggcggtggagctacgtggtcgacgccgccggcgccgcggtcaaggccaagggaagggcgtccgtcggtggcgccttcaaggccgtcccgctccagtccccgctcccgcccgtcgaggaaataatgtcctttataaggtcatatgttgtgcccgaaggctttccagaaagtgtcacaccttcatatgttccatacatgacatggagagcaatgaagcatttctttggtggagcaatgggtgtgtttacaacaagaaccttgctcaactctgttggagtctcgcaaagcagggctgcatctggtgctgtggctatcaactggatactcaaggatggggctgggcgtgttggaaagatgctttttgcccgccaagggaagaaatttgattatgacctgaagcagcttcgcttttctggtgatctcttgatggagttaggagctgggatagaattagctactgcagctttcccacaacttttcctaccaatggcatgcatagcaaatgttgttaagaatgttgctgctgtgacttccacctctactcgaacaccaatctacaaggcatatgcaaaaggagaaaatatcggtgatgtcactgctaaaggagaaagtgttggaaacattgctgatctgttgggaactggaatgagcattctaatctctaaaagcaatccatcactggtaacttcttttgccgtcttgtcgtgcggatatcttctcagttcatattatgaggtgagatctgttgtactgaataccctgaatagggcaaggttcactgtggctgtggattctttcatcaggactgggtatgtaccctcactgaaggatggaaactcacaagagacaatatttaatccaccttggcgacatgagccagtcgcaataggatcaagatttggggaggcgtttcaagaacctgcttcgtttattgctataaaacctttgttcgaggatgagaggtatattgttacatataatccgacaaaggacaaggtatatgctttgctcaaggaccaagcaaagccagatgacattctcaaagctgctttccatgcacatgtgttactgcattttatcaatgcttcacatgctaacctgaatgcacggaagcgcatgaacgccaatcggtcataccagtataacccactgaacatggactttgtaccacacatcgaagagtcatgcaagatcgttatgtcatcttatggagtcttcaagaagaaagcaagagaacagggatggataatgtctgaatcacttcttaacccgggaagagcaagattgtgtggagtagtaccacaatga

SEQ ID NO: 21535 - protein, 513 aa, Sorghum bicolor
  misc_feature: Ceres ANNOT ID no. 8732667
  misc_feature: Down-regulated in shoot tissues in response to salicylic acid treatment
MGLKQAAAAGAGAAAAAAQTVHLVRPGCTGHGCAPPCGRLRPPRGRARAPAAARVPETAAVPAEIARDGVLCLEEVDGRRWSYVVDAAGAAVKAKGRASVGGAFKAVPLQSPLPPVEEIMSFIRSYVVPEGFPESVTPSYVPYMTWRAMKHFFGGAMGVFTTRTLLNSVGVSQSRAASGAVAINWILKDGAGRVGKMLFARQGKKFDYDLKQLRFSGDLLMELGAGIELATAAFPQLFLPMACIANVVKNVAAVTSTSTRTPIYKAYAKGENIGDVTAKGESVGNIADLLGTGMSILISKSNPSLVTSFAVLSCGYLLSSYYEVRSVVLNTLNRARFTVAVDSFIRTGYVPSLKDGNSQETIFNPPWRHEPVAIGSRFGEAFQEPASFIAIKPLFEDERYIVTYNPTKDKVYALLKDQAKPDDILKAAFHAHVLLHFINASHANLNARKRMNANRSYQYNPLNMDFVPHIEESCKIVMSSYGVFKKKAREQGWIMSESLLNPGRARLCGVVPQ

SEQ ID NO: 21536 - DNA, 516 bp, Sorghum bicolor
  misc_feature: Ceres ANNOT ID no. 8732686
  misc_feature: Up-regulated in root tissues in response to salicylic acid treatment
  misc_feature: Encodes the peptide sequence at SEQ ID NO 21537
atggccacggccaccacgtgccgcctcgtcctcctcctgcctctcctctcgctcctcctcctccacaccgtgtcggcgttcgactccggcaaccagccccagccgagcgcgtacgagatgctggaggggttcgggttcccgaggggcatcctgccggagggcgtgacggggtacacgtaccggccgtcggacggcgcgttcgaggtgttcatgggcggggactgcgagttcgaggtggacggcggctaccgcctcacgtaccggcgcaggatctccggcaacgtggagggcggcagcatccggaacctcggcggcgtctcggtgcgcatgttcctcttcaactggggcatcgaccgcgtcgtcatggaggacgcggaccgccgcctcatgttctacgtcggacccatctcgcaggcgttccccgccgacaacttcgtgcagtccccgcagtgccgccgccacggtggagggaacggcggcgtggatgccgccgccgtgggcatggcggcgatgtag

SEQ ID NO: 21537 - protein, 171 aa, Sorghum bicolor
  misc_feature: Ceres ANNOT ID no. 8732686
  misc_feature: Up-regulated in root tissues in response to salicylic acid treatment
MATATTCRLVLLLPLLSLLLLHTVSAFDSGNQPQPSAYEMLEGFGFPRGILPEGVTGYTYRPSDGAFEVFMGGDCEFEVDGGYRLTYRRRISGNVEGGSIRNLGGVSVRMFLFNWGIDRVVMEDADRRLMFYVGPISQAFPADNFVQSPQCRRHGGGNGGVDAAAVGMAAM

SEQ ID NO: 21538 - DNA, 1671 bp, Sorghum bicolor
  misc_feature: Ceres ANNOT ID no. 8732800
  misc_feature: Up-regulated in shoot tissues in response to methyl jasmonate treatment
  misc_feature: Encodes the peptide sequence at SEQ ID NO 21539
atgccttccggctcggacgactactccgaccccctgctggcggcgcgcgccgacggcagcatggccggcggcgacgcggcggcgctggactaccgcggccgccccgccgaccgcggcgccaccggcggctggaggtcagcgctcttcatcatagcggtggagatcgcggagcggttcaccttctacggcgtgtcgtcgaacctgatcaactacctgacgggcccgctcggtgagggcaccgcggcggcggcggcggccatcaacgcgtggaacggggtggcgcagctgctgccgctgctgggcggggccctcgccgacaagtggctcggccgctaccgcaccatcgtcatcgcctcgctcctctacgtcctcggtctaggcatgctggcgttctcgaccatgctctcctcgggcagcggccaccagtgcaccaccgccaggggccagacccagacctgtgcgccgtccactctgaaggcgaccttcttctacgtctccctctacatcgtggcggtggcgcagggcgggcacaagccgtgcgtgcaggcgttcggcgccgaccagttcgaccagagcgaccccaaggagaccgtctccaggagctccttcttcaactggtggtacttcggcatgtgcgccggcactgccgtcacgctcgtgctcctcagctacgtgcaggacaacatcgggtgggggctcggcttcggcatcccgtgcgccgtcatggcggccgcgctcgccgtcttccttctcggcacacggacgtaccggtactacgtcactgccggggagcgcggcctgttcgctcgtgccgccgaggctttcgctgagtggcggagcaggcgaaagacccttgctggtgtggatgaggaggagcaggctgcagtgagcaacagcgcaggcctcgtcaaggaggccaaggccatcatccgtctgttcccgatatgggcgacgtgcctgctctacgcggtggcgttctcgcagtcgtcgacgttcttcacgaaacaggcggcgacgctagaccggcgcatcgggcggcacggcttgcaggtgccaccggccgcgctgcagagcttcatcagcatcaccatcgtcgtcttcatccccatctacgaccgcgtcctcgtgccggtgtcgcgccggtactccgggaagccatcgggcatcaccatgctgcagcgcatcggcacggggatgctcctctcgctcctgtccatggtgatcgcggcgctcgtcgagaagcaccggctcggcgtcgcgcgggacgcgggcctcgtggacaagccgaaggtcccgctgccgatgagcctgtggtggatggtgccgcagtacgtgctgttcggagccgccgacgtgttcaccatggtcggactgcaggaattcttctacgatcaggtgcccgacaagctgcgcagcctcgggctggcgctgtacctcagcatcttcggcgtcggcagcttcatcagcagcgcgctcgtgtcggtcatcgacagggtgacgacggctaggggcgggagctggttcaacaacaacctgaaccgcggccacgtcgactacttctactggctgctcgccgcgcttagcgccgtcgagctcctcgcctatgtcttcttcgcggtgacatacaagtacaagaacaaaagagccgtacatgcaactgttgagagttag

SEQ ID NO: 21539 - protein, 556 aa, Sorghum bicolor
  misc_feature: Ceres ANNOT ID no. 8732800
  misc_feature: Up-regulated in shoot tissues in response to methyl jasmonate treatment
  misc_feature (112)..(482): Pfam ID: PTR2 Pfam Description: POT family
MPSGSDDYSDPLLAARADGSMAGGDAAALDYRGRPADRGATGGWRSALFIIAVEIAERFTFYGVSSNLINYLTGPLGEGTAAAAAAINAWNGVAQLLPLLGGALADKWLGRYRTIVIASLLYVLGLGMLAFSTMLSSGSGHQCTTARGQTQTCAPSTLKATFFYVSLYIVAVAQGGHKPCVQAFGADQFDQSDPKETVSRSSFFNWWYFGMCAGTAVTLVLLSYVQDNIGWGLGFGIPCAVMAAALAVFLLGTRTYRYYVTAGERGLFARAAEAFAEWRSRRKTLAGVDEEEQAAVSNSAGLVKEAKAIIRLFPIWATCLLYAVAFSQSSTFFTKQAATLDRRIGRHGLQVPPAALQSFISITIVVFIPIYDRVLVPVSRRYSGKPSGITMLQRIGTGMLLSLLSMVIAALVEKHRLGVARDAGLVDKPKVPLPMSLWWMVPQYVLFGAADVFTMVGLQEFFYDQVPDKLRSLGLALYLSIFGVGSFISSALVSVIDRVTTARGGSWFNNNLNRGHVDYFYWLLAALSAVELLAYVFFAVTYKYKNKRAVHATVES

SEQ ID NO: 21540 - DNA, 489 bp, Sorghum bicolor
  misc_feature: Ceres ANNOT ID no. 8732908
  misc_feature: Down-regulated in shoot tissues in response to methyl jasmonate treatment
  misc_feature: Down-regulated in root tissues in response to methyl jasmonate treatment
  misc_feature: Down-regulated in shoot tissues in response to aminocyclopropane carboxylic treatment
  misc_feature: Encodes the peptide sequence at SEQ ID NO 21541
atgtcaactgccttcaccgtcccacgactgtccgtccccaaatccggggcaagctaccaccagaccgccgccgctccggcggcggccaagaagaccgtctccttggtcagctacacgaggcagcaggcgccgcacgcgtcagggatactactacggctgtccagctccagcaggttcgtggcggcgtccgcagcggccgtgcacaaggtgaggctggtggggccggacgggacggagcaggagttcgaggcccccgaggacacgtacatcctcgaggcggccgagaacgccggggtggagctgcccttctcctgccgcgccgggtcctgctccacctgcgccgggaagatgtcgagcggagaggtcgaccagtccgaggggtcgttcctcgacgagggccagatggccgacgggtacctcctcacctgcatctcctaccccaaggcggactgcgtcatccatacccacaaggaggaggagctgtactag

SEQ ID NO: 21541 - protein, 162 aa, Sorghum bicolor
  misc_feature: Ceres ANNOT ID no. 8732908
  misc_feature: Down-regulated in shoot tissues in response to methyl jasmonate treatment
  misc_feature: Down-regulated in root tissues in response to methyl jasmonate treatment
  misc_feature: Down-regulated in shoot tissues in response to aminocyclopropane carboxylic treatment
  misc_feature (73)..(160): SWISSPROT Homolog: EC 1.14.13.7 Phenol 2-monooxygenase
  misc_feature (73)..(149): Pfam ID: Fer2 Pfam Description: 2Fe-2S iron-sulfur cluster binding domain
MSTAFTVPRLSVPKSGASYHQTAAAPAAAKKTVSLVSYTRQQAPHASGILLRLSSSSRFVAASAAAVHKVRLVGPDGTEQEFEAPEDTYILEAAENAGVELPFSCRAGSCSTCAGKMSSGEVDQSEGSFLDEGQMADGYLLTCISYPKADCVIHTHKEEELY

SEQ ID NO: 21542 - DNA, 489 bp, Sorghum bicolor; identical to SEQ ID NO: 21540
  misc_feature: Ceres ANNOT ID no. 8732911
  misc_feature: Down-regulated in shoot tissues in response to methyl jasmonate treatment
  misc_feature: Down-regulated in root tissues in response to methyl jasmonate treatment
  misc_feature: Down-regulated in shoot tissues in response to aminocyclopropane carboxylic treatment
  misc_feature: Encodes the peptide sequence at SEQ ID NO 21543

SEQ ID NO: 21543 - protein, 162 aa, Sorghum bicolor; identical to SEQ ID NO: 21541
  misc_feature: Ceres ANNOT ID no. 8732911
  misc_feature: Down-regulated in shoot tissues in response to methyl jasmonate treatment
  misc_feature: Down-regulated in root tissues in response to methyl jasmonate treatment
  misc_feature: Down-regulated in shoot tissues in response to aminocyclopropane carboxylic treatment
  misc_feature (73)..(160): SWISSPROT Homolog: EC 1.14.13.7 Phenol 2-monooxygenase
  misc_feature (73)..(149): Pfam ID: Fer2 Pfam Description: 2Fe-2S iron-sulfur cluster binding domain

SEQ ID NO: 21544 - DNA, 1878 bp, Sorghum bicolor
  misc_feature: Ceres ANNOT ID no. 8732935
  misc_feature: Up-regulated in shoot tissues in response to methyl jasmonate treatment
  misc_feature: Encodes the peptide sequence at SEQ ID NO 21545
atggtcgcatatgcatatgcaaccacgttgtacgtggcagctcaagcagcccgcctgccgagctccttgcagccgcaggcggtggccgccgtcttcttcacgtcggccgcgtgcaccgtcgccctagccgtcctcctggccttgctgcggctccgcccgccgtggtggtgcgcgtgcgcggtgtgcgaggcgtacgtgacggcgtcgtgggcagccgagttcgacaacctctgcgactggtacgctcacctgctgcgccgcgcgcccgggcggaccgtgcacgtgcacgtgctcggaaacgtgctcaccgccaacccgcccaccatcgaccacatgctgcgcggccgcttcgacaactaccccaagggcgcccccttctcggccatcctcgccgacttcctcggccgcgggatattcaacgtcgacggcgactcctggctcttccagcgcaagctcgccgccgccgagctcgcgtccccagcgctgcgctgcttcgcggccggcgtcgtggcctccgagctccggtgccgactcattcctctgctctactctgcagccggcgacggagacagcagcggcgacaggctgctggacctccaggacgtgttccgccgcttcgccttcgactgcatatgcaggatctcgttcggcctcgatcccggctgcctggagctctcgctgcccatgtcggcgttcgccgacgcgttcgacacggcgtcgatgctctccgcacgacgcgcgacggcgcccatgcacgtgctctggaagctgaagcggctactcaacgtcggggaggagcgggagctccgcgacgccatccgcctcgtcgacacgctcgccgctgaggtcatccggcagcgccggaagctcggcaccgccgcctcgggcgacgacctcctgtcgcgcttcatgggctccatcaacgacgacaagtacctccgggacatcgtcgtgagcttcatgctggccggccgcgacaccgtcgcctcggctctcaccgccttcttcttgctgctctccgaccaccccgacgtggccaccgcgatccgggacgaagtctcgcgcgtcgccggagacgacgacagagacggccacgccgccgccagctcggagaagctcaaggacatgcactacgtgcacgcggcgctgcacgagtgcatgcggctgttcccgccggtgcagttcgactccaagttcgcggccggcgacgacatgctccctgacggcacgttcgtcgccaggggcacccgggtgacctaccacgcctacgccatgggccgcatggagtccgtgtggggccccgactgcgccgagttccggccggaccgctggctccacgacggccggttcgtgccggagagcccctaccggtacccagtgttccagggcggcgtgcgcgtctgcatcggcagggagctcgccatcatggagatgaagtccgtcatcgtctccgtcgtgcagagcttcgacatagaggcggtcggccggagctcccaccggccaaagttcgcgccaggccttaccgccacattcgccgggggcgtgcctgtcagagtgcggcggcgagcgagagctcgtgcggaggaagggattagtcgtctaatccgatgcccgacggacggcactagttctggcacatgcataaaaagggggcggcgtaaagtcgcctctgcatgtcagcatgtgtgctattctttccaactttcaaagcagaattgtcgaaaagaaaattttgcagattcaaagttgcagaatgcatgcacatctagatgttgtagcttcctagggaacttgaattattgcaaggtggtcgggcagcgaattagaaaaatgcatgcagttgatatattctttattccagctcagctcgttggatag

SEQ ID NO: 21545 - protein, 625 aa, Sorghum bicolor
  misc_feature: Ceres ANNOT ID no. 8732935
  misc_feature: Up-regulated in shoot tissues in response to methyl jasmonate treatment
  misc_feature (197)..(494): SWISSPROT Homolog: EC 1.14.13.98 Cholesterol 24-hydroxylase
  misc_feature (49)..(517): Pfam ID: p450 Pfam Description: Cytochrome P450
MVAYAYATTLYVAAQAARLPSSLQPQAVAAVFFTSAACTVALAVLLALLRLRPPWWCACAVCEAYVTASWAAEFDNLCDWYAHLLRRAPGRTVHVHVLGNVLTANPPTIDHMLRGRFDNYPKGAPFSAILADFLGRGIFNVDGDSWLFQRKLAAAELASPALRCFAAGVVASELRCRLIPLLYSAAGDGDSSGDRLLDLQDVFRRFAFDCICRISFGLDPGCLELSLPMSAFADAFDTASMLSARRATAPMHVLWKLKRLLNVGEERELRDAIRLVDTLAAEVIRQRRKLGTAASGDDLLSRFMGSINDDKYLRDIVVSFMLAGRDTVASALTAFFLLLSDHPDVATAIRDEVSRVAGDDDRDGHAAASSEKLKDMHYVHAALHECMRLFPPVQFDSKFAAGDDMLPDGTFVARGTRVTYHAYAMGRMESVWGPDCAEFRPDRWLHDGRFVPESPYRYPVFQGGVRVCIGRELAIMEMKSVIVSVVQSFDIEAVGRSSHRPKFAPGLTATFAGGVPVRVRRRARARAEEGISRLIRCPTDGTSSGTCIKRGRRKVASACQHVCYSFQLSKQNCRKENFADSKLQNACTSRCCSFLGNLNYCKVVGQRIRKMHAVDIFFIPAQLVG

SEQ ID NO: 21546 - DNA, 1713 bp, Sorghum bicolor
  misc_feature: Ceres ANNOT ID no. 8733018
  misc_feature: Up-regulated in root tissues in response to salicylic acid treatment
  misc_feature: Encodes the peptide sequence at SEQ ID NO 21547
atgtcttcggcggcgggcggtggtggatacggggccggcggcggcgccgagcaccagcacctgttgctggggcaggcggcggggcagctctaccacgtgccgcagcacagccgccgcgagaagctgcggttcccgcccgacccggccgactcgcccccgcccactgcctggccggcgcccccacccttctactcctacgcgtcctcgtcgacgtcgtcctactcgccgcatagcccaacgccgctggcgcacgcgcagctcgtggcgcacgcgctacctgcaggcgccggggcccagatcccgagccagaacttcgcgctctcgctctcctcggcgtcctcgaaccctccgcccgcgccgcggaggcagctcgccgcgggggtagccacggggccgtacggcccgttcacgggctacgcggccgtcctcggccggtccaggttcctcggccccgcgcagaagctgctcgaggagatctgcgacgtgggcggacggcccccgcacctggaccggcgctccgacgagggcatgctcgacatggacgccatggacgtggttggggacgtggaccatgacatggacggcggtgaccgcgctaccgctgaggcggtcgctgtctccggcgccgagcagcagtggaggaagaccaggctcatctccctcatggaggacgtttgcaggcgatacaagcagtactaccagcagctgcaatctgtgatctcctcgtttgagactgttgcggggctgagcaacgccgccccctttgcttccatggctcttcggacaatgtcgaagcatttcaagtgtctcaaggaaatgataatgagccaattaaggaacacaagcaaggttgtcgccaatgatggtattggcaaagacgatatggctaactttgcgcttatgggtggtggagcaggcctcctgaggggaaacaatgtgaacgcattcggccagcctcacaacatttggaggcctcaaagagggcttcctgagcgtgcagtgtctgtgcttcgctcgtggctgttcgagcacttcttacatccgtatccaactgatagtgacaagcagatgctggctaaacagacaggcttaacaaggaaccaggtgtcaaattggtttatcaatgcaagggtgcggctctggaagcccatggtggaagaaatccacaacctggagatgcggcaggtgcagaagaacacatcggtggacaagaatcaacttggcatgcagcagattcagcactcgacggacagcagtgggaagctttctgacccttcaaactctcagcgtgggcaaagcagcggcatgacaagaaacctcagctctccggcatcacgccatatccaagacgagctctcccagatgccccacgacatgccaggccaggtgagctttgcttacaatgggctccccacacaccacggtcttgcgctgtcacacccccagcaagctgaagcagtcagcgccggcattggccttggcggcgtggctgccggcggtggcggcgtttccctcacactcggccttcaccagaacaacaggacttacattgccgagccacttccggccgcgctcccgctcaacctcccgcaccgttttgggctggaggacgtgagcgacgcctacgtgatggggtcattcggcggcggccaggaccgtcatttcaccaagggaataggtggccaccatttgctccatgactttgttggttga

SEQ ID NO: 21547 - protein, 570 aa, Sorghum bicolor
  misc_feature: Ceres ANNOT ID no. 8733018
  misc_feature: Up-regulated in root tissues in response to salicylic acid treatment
  misc_feature (141)..(276): Pfam ID: POX Pfam Description: Associated with HOX
MSSAAGGGGYGAGGGAEHQHLLLGQAAGQLYHVPQHSRREKLRFPPDPADSPPPTAWPAPPPFYSYASSSTSSYSPHSPTPLAHAQLVAHALPAGAGAQIPSQNFALSLSSASSNPPPAPRRQLAAGVATGPYGPFTGYAAVLGRSRFLGPAQKLLEEICDVGGRPPHLDRRSDEGMLDMDAMDVVGDVDHDMDGGDRATAEAVAVSGAEQQWRKTRLISLMEDVCRRYKQYYQQLQSVISSFETVAGLSNAAPFASMALRTMSKHFKCLKEMIMSQLRNTSKVVANDGIGKDDMANFALMGGGAGLLRGNNVNAFGQPHNIWRPQRGLPERAVSVLRSWLFEHFLHPYPTDSDKQMLAKQTGLTRNQVSNWFINARVRLWKPMVEEIHNLEMRQVQKNTSVDKNQLGMQQIQHSTDSSGKLSDPSNSQRGQSSGMTRNLSSPASRHIQDELSQMPHDMPGQVSFAYNGLPTHHGLALSHPQQAEAVSAGIGLGGVAAGGGGVSLTLGLHQNNRTYIAEPLPAALPLNLPHRFGLEDVSDAYVMGSFGGGQDRHFTKGIGGHHLLHDFVG

SEQ ID NO: 21548 - DNA, 1188 bp, Sorghum bicolor
  misc_feature: Ceres ANNOT ID no. 8733044
  misc_feature: Up-regulated in shoot tissues in response to methyl jasmonate treatment
  misc_feature: Encodes the peptide sequence at SEQ ID NO 21549
atgagctggatccgatcggctctgaagagggccctcatcgctccgaagccgtggggctcccgccagtttgctgccacagcagtcgccggcgagacgcaggctgagagggtggcggcggagatggtccgctacgcccttggcggcgccgtgcaccggagctcgccagaggaggcgatgcggatactggagcaaggcgcctcgaacctgcagggcggaggcgagggcagcgccgaggctgtgggcctgctcatgctcgctatgtccacgctgctctaccggagtggaagacgtcaagatgcaatggaaaagctcaaagcaacccaacaagttgccccttctgcagctttcagagttgcagcgtgggaagcactaatgggattacacatggaggcagggcaggagatgtcctacttgatttccccagatgatttagttgatctgtcaatcaaagatgatagcagatggtctgatcaggaccatcttaaatttcgggttaatgctatcagaggacttgttgcacttctgaatggagaaacagaatcagaaaatgctgccatttcatatggtgaatatttgcattgtgttggggattttcaaatggcagcacaagtgtatgagaaaattcatgaggcattttgcatggatgacgtgtctggaaaccttttagcagctggaaacatggtttctgaggaggcttctcttggggccacttgctcatatggccagcttttatctcactctgggaagtttgatgaggcagaggattatctcacaagagctctacagaaggctgaagaacaatttggtgcaaaccacccaaaggttggtattatattgacctgtatagctagaatgtacaaaatgaaggcaaaatcggaaagttctacttcaattatggtccaggagggattatacaggaaggccctagaagtattgaaagctcctgctattaattctgagggtaccagcaagcaggtcgattggagagatatcatctcccttgccagaggtgagtacgcagagctgttattaattcagtctaacaggaaggcggaaggtgaacggatgaagcagtgggcagaagatgcttggaggaaccgtaggctaacgctagcacaagctctagagttttcagaaccttcaaagccgactctcgttgttgacacccggatcggcagggtcgtgtag

SEQ ID NO: 21549 - protein, 395 aa, Sorghum bicolor
  misc_feature: Ceres ANNOT ID no. 8733044
  misc_feature: Up-regulated in shoot tissues in response to methyl jasmonate treatment
MSWIRSALKRALIAPKPWGSRQFAATAVAGETQAERVAAEMVRYALGGAVHRSSPEEAMRILEQGASNLQGGGEGSAEAVGLLMLAMSTLLYRSGRRQDAMEKLKATQQVAPSAAFRVAAWEALMGLHMEAGQEMSYLISPDDLVDLSIKDDSRWSDQDHLKFRVNAIRGLVALLNGETESENAAISYGEYLHCVGDFQMAAQVYEKIHEAFCMDDVSGNLLAAGNMVSEEASLGATCSYGQLLSHSGKFDEAEDYLTRALQKAEEQFGANHPKVGIILTCIARMYKMKAKSESSTSIMVQEGLYRKALEVLKAPAINSEGTSKQVDWRDIISLARGEYAELLLIQSNRKAEGERMKQWAEDAWRNRRLTLAQALEFSEPSKPTLVVDTRIGRVV

SEQ ID NO: 21550 - DNA, 1608 bp, Sorghum bicolor
  misc_feature: Ceres ANNOT ID no. 8733053
  misc_feature: Up-regulated in shoot tissues in response to methyl jasmonate treatment
  misc_feature: Up-regulated in root tissues in response to methyl jasmonate treatment
  misc_feature: Encodes the peptide sequence at SEQ ID NO 21551
atggtcatggagctcgtgctcgctacacctgacctcccaaccccgctgctgctctccgccttgacggtagcagtgtccgtggccgtctgctatgtcctcttctggaagcagcagcaggcggcggcgaggcgagcgccgctgccgccggggccgaggggctggcccgtgctgggcaacctgccgcagctgggcgggaagacgcaccagacgctgcacgagctgaccaaggtgtacggcccgctgctgcggctgcggttcggcagctccgacgtggtggtggccggttcggcggccgtggcggagcagttcctccgcgtccacgacgccaacttcagctgtcgcccgccaaactccggcggcgagctcatggcgtacaactaccaggacgtcgtgttcgccccctacgggccccggtggcgcgccatgcgcaaggtgtgcgccgtgaacctcttctccgcgcgcgctctcgacgacatctgcgacgtccgggagcgtgaggccgcgctcatggtgaggtcgctcgcggagcaggcggcccgcgaccgcaacacgccggtggcgctcggcaaggccgtgaacgtctgtacgacgaacgcgctgtcgcgggcggccgtcgggcggcgggtgttcgctgccgccggcgccggcgacgagggcgcgagggagttcaaggagatcgtgctcgaggtgatggaggtgggcggggtgctcaacgtcggcgacttcgtgccggcgctccggtggctcgacccgcagggcgtggtgggcaggatgaagaagctgcaccgccggttcgacgacatgatgaacgggatcattgcagatagcaggaaggccagggctacgccggcagacggagaggaaagcaaggatttgctgggcttgctgctgtccatggtggaggacgagggaagcgacgacgaagtcaggatcaccgaaaccgatgtcaaggcacttattttgaacctgttcatagcaggaaccgacacaacatcgaccatagcagagtggtcgctagccgagctgatccgccacccggacatcctcaagcaggcacaagaggagctagacacagtcgttggccgtggaaggttggtcaccgagtcagacctccgacacctcaccttcttcaatgcagtcattaaggagacgtttcgcctgcacccatcaacgcccctctcccttcctcgcatggctgcagaggagtgtgagattgctggctacagcatccccaagggctgcgagctgctagtcaatgtgtggggcattgcacgtgacccggccttgtggcctgacccactagagttccgccctgctaggttcctaccaggtggatcacattcggatgtggatgtcaaaggaggcaactttgggcttataccattcggcgcgggtcggaggatatgtgccggccttagctgggggctgcggatggtcacactaactagcgccactctggtgcatgcatttgattgggagttgccggtaggacagacaccagataagctaaacatggaggaggccttcaccttgttgctacagcgtgctgtgccgttaatggctcatccaatacccaggctgctaccatcagcatatgagattgcataa

SEQ ID NO: 21551 - protein, 535 aa, Sorghum bicolor
  misc_feature: Ceres ANNOT ID no. 8733053
  misc_feature: Up-regulated in shoot tissues in response to methyl jasmonate treatment
  misc_feature: Up-regulated in root tissues in response to methyl jasmonate treatment
  misc_feature (54)..(532): SWISSPROT Homolog: EC 1.14.13.21 Flavonoid 3'-monooxygenase
  misc_feature (48)..(520): Pfam ID: p450 Pfam Description: Cytochrome P450
MVMELVLATPDLPTPLLLSALTVAVSVAVCYVLFWKQQQAAARRAPLPPGPRGWPVLGNLPQLGGKTHQTLHELTKVYGPLLRLRFGSSDVVVAGSAAVAEQFLRVHDANFSCRPPNSGGELMAYNYQDVVFAPYGPRWRAMRKVCAVNLFSARALDDICDVREREAALMVRSLAEQAARDRNTPVALGKAVNVCTTNALSRAAVGRRVFAAAGAGDEGAREFKEIVLEVMEVGGVLNVGDFVPALRWLDPQGVVGRMKKLHRRFDDMMNGIIADSRKARATPADGEESKDLLGLLLSMVEDEGSDDEVRITETDVKALILNLFIAGTDTTSTIAEWSLAELIRHPDILKQAQEELDTVVGRGRLVTESDLRHLTFFNAVIKETFRLHPSTPLSLPRMAAEECEIAGYSIPKGCELLVNVWGIARDPALWPDPLEFRPARFLPGGSHSDVDVKGGNFGLIPFGAGRRICAGLSWGLRMVTLTSATLVHAFDWELPVGQTPDKLNMEEAFTLLLQRAVPLMAHPIPRLLPSAYEIA

SEQ ID NO: 21552 - DNA, 4413 bp, Sorghum bicolor
  misc_feature: Ceres ANNOT ID no. 8733115
  misc_feature: Down-regulated in shoot tissues in response to methyl jasmonate treatment
  misc_feature: Down-regulated in root tissues in response to methyl jasmonate treatment
  misc_feature: Down-regulated in shoot tissues in response to salicylic acid treatment
  misc_feature: Encodes the peptide sequence at SEQ ID NO 21553
atggatcgctgccggaagcggcccgactcagaccccgagggctgcagcgagcccgagccccccgccgataagcgcccgtgcacggcggaaccctcgacttccgccgcggccgccgccgctcctccgcccggcgcgcgccaggctgagcagggcggctcggatatggacacctcgtcgtccggccaccccggcgatgctgatgtcgacgcggatgacggggacgacgagggcgccgggcaggacgcggtggtggcggctctcatggagctctgcgaggcgctgtcgttctgcgcggaggacgccggcgggtacttccccacggaggcagccgcgcgggcgctggtgcggcgggccggcggcgatggcacgggggctaccccggacgtgattctgctgtccgtgcgcgccatcacgtacctctgcgacgccatgccgcgcgccggggacgccgtcgtccgccacggcctcctccccgtgctctgctcccggctgctagccatcgagtacctcgatgtagctgagcagtgcttgcaagcttttgagaagatatcacggaggcagcctacccagtgcttgcaggcgggcatgatcaacgctgtgctggcatacattgacttcttcgctgcaagcatccagagggttgcagtgtcagctgtcgcaaatgcctgcaaaaaggtcccgacagattgctcccactttgttctggattcggtcccagctctatgtaatcttctgcaatctgaggacaaaatgggtgttatagagaaggtcctacctttgatacacactggtggactcacggcccttagcccatcgacatgcagtaacctgattgggcttcttgctaagctagcctgtacttcacttgtggcagtgaagtctctatttgagctgggtgttagtagcacaataaaggggattttgatcacttcagacatctcccatggcatgccatacttgcctctggaaaaacaaaataatcaggtcaatgaagctctgaaactagcaaaccagttgattccttcagcagcaagggacgttgaagacacccagatcatactagcaaaagaaaaaataattacagatgaaccaaggttcttgtctcaattctctagggatattcttcctgtcttgatcaaggcggtgaactctggtgccaattcatacatttgctatggctgtgcttcaatcgttaacaatatttgttacttcagtgaaccagaaatacttcaagagttgctcaaggaaacgaacataccgggcttcttggctggtttattgtctagaaaggatcatcatgtgctgacctcatcactaaagataattgagattctcatgcaaaagcttcctgatgcataccttggcttctttatcaaggaaggtgttgtcaatgcagttgaggcgcttcttaatcaagaggattgctcaaaatccactcatctgcctgatgacatgcaacaaccagagactcaacctgtcataagaaataagactacatgtttctgctatgcatttgatgcccgtagatctgaagctgctgaaaaaaggacttgtaggattgggaaggacagtctttttacttttgccaggcatgtgaaaacaacctactttactaaggatgtagtgagttctgagatggggttaactgagattttgcagaagctcaaaacttgctgtgcagttttgaatgagaccacagacaagtcatcagaccaatgcaatcttcatcagagtgaagaatacttatctaccattttaaatgaggtgatgatggagcttcatgggggagaaacaatgacaacctttgaattccttgagagtggattggtcaaatctttatcaaattatctctcaaatggcaagtacctccaggtggagaacaatatgaattgcagttctgaccattttttggctgtcgtgaaaagatttcagtcatttgctcggatgtctttctcaagaatgggccaaggttggggtgacatgcttttgacacttttagtaagcaagctgcagaatgctcttacttctgttgacaactttccacttataatgagccacaacttcaagccaaggagcagtatttctgatatccctacgaggcactcaacaattactccatgtatccgagtaagattcaagaaagacgaagatgaaactaacttgtcaagctatgatagtgctgtgaatgtggaaatatcgtcatcgttgcataccatcgaagaatttttgtggcccaaagttagtatagatgtcaatagtcagaaggctgaatcaccacctagtggtactgctttggaaagcaaatatgctgatgatgactctcaggaacgagattccacacctagtcagaaggctgattcaccatcagagggcctggcttgtgaaaatcagaatccgcctgtagaaacaagtccaaagcaaggaacttcatcttctggtcaagcagaaagaaacacaacaatcttgagtgattgcaccatacaacagaaattggtatttagcttaaatggtaaagagcttgaccggtctgttactctgtatcagtcaatactgcaggatcagatcaacgtagggtctgacataattctggacatgcagttttggcgcagtgttcatgacataactttcagagctgctaacccagaagcaaatataacagctgttaacccagaagcaaatgattctcctagacattcctctactgcaatgtcatcaataaatgagaacataactgggtttacatggcagatgctccctttctttcctagtatgttgcttggtaaacttccttgcaaactcgacagatcaggtccttcgtatgacatattgtttatgttacacattttagagggattaaacaggtattcttttcacctcgtgtctgatgagagaaaccgttcttttgcccatggaaggataactaacctcaatgatctgaaagctgaagttttctcgattcctcagcaagagtttgtcagtgccaaattgacagataaattggagcaacaaatgcatgatccattagtttcaaaatctttctgcctgcctttatggtgcaccgaactgatgtctgcctgccctttcttattttcatttgaggcgagatggaagtatttccagctgacagcatttggttctttgaaaaatcatcatggccatatgatagatgcaagtgttaacagtgtcgcagaaagggcgtctaaccactcacggaaaaagttcaaagttgatcgcgatgatatactggtttcagctgcaaaaatgatgaaatcgcatgctaagagcaatgctctactcgaagtagaatataaagaggaagtgggcactggtttaggtcctacaatggaattctatacattgataagtcatgaatttcagaagtctggtctaggcatgtggagaggggagcttccttgtgaatctgttaccgataatggtcatgtttctgaattcgtggttgcccctaatggacttttccctagaccttggtctgcttctgcagattctgcttcctttcaagaagtgagcaagagattccacttgcttggtctggttgttgcaaaagcaattaaagacaacagaattcttgacattccattttctaaagcattctacaagcttatccttgggcagtcattggattctgaactggccacatcccttgtggagtttcaagctcttgcttgtcggagaaaatatgcagagtcaaatttgacaagggactgccagattatatcagatttgacttatcgaggttgtagaattgaggatcttgctattgagtttgctctcccagggtatccagaatatgtgctctcactgggaagttgctctgacagtttgaatgctgagaatttggaagaatatgttcgtcatgttgttgacgcaacggttaaaagtggaattgcaagacagatggaggcttttaagtcaggatttaatgagttaggataccgtacatggaaccatgagaacacttccatggtatttccactaaaaaaactccaggttttctcagaggatgagctagagagattactctgtggtgaacaagatacatgggattttgcgaaacttgtggatcatatcaaatttgatcatggttacacttccagcagccctcctgtcatcaatttgttggaaatcatacaagagtttggatcccttgagcgcagagctttcttgcaatttataacgggttcacctcggcttccaccaggcgggttggctgcactaaatccgaagttcacagttgtccgaaagcataacagcaatgacgctgacgatgacctgcctagcgtgatgacttgtgcgaactatcttaagttacctccgtattcttcaaaggagaagatgagggagaaactcctctatgcaattacagagggccaggggtccttccacctatcttaa

SEQ ID NO: 21553 - protein, 1470 aa, Sorghum bicolor
  misc_feature: Ceres ANNOT ID no. 8733115
  misc_feature: Down-regulated in shoot tissues in response to methyl jasmonate treatment
  misc_feature: Down-regulated in root tissues in response to methyl jasmonate treatment
  misc_feature: Down-regulated in shoot tissues in response to salicylic acid treatment
  misc_feature (1119)..(1470): Pfam ID: HECT Pfam Description: HECT-domain (ubiquitin-transferase)
MDRCRKRPDSDPEGCSEPEPPADKRPCTAEPSTSAAAAAAPPPGARQAEQGGSDMDTSSSGHPGDADVDADDGDDEGAGQDAVVAALMELCEALSFCAEDAGGYFPTEAAARALVRRAGGDGTGATPDVILLSVRAITYLCDAMPRAGDAVVRHGLLPVLCSRLLAIEYLDVAEQCLQAFEKISRRQPTQCLQAGMINAVLAYIDFFAASIQRVAVSAVANACKKVPTDCSHFVLDSVPALCNLLQSEDKMGVIEKVLPLIHTGGLTALSPSTCSNLIGLLAKLACTSLVAVKSLFELGVSSTIKGILITSDISHGMPYLPLEKQNNQVNEALKLANQLIPSAARDVEDTQIILAKEKIITDEPRFLSQFSRDILPVLIKAVNSGANSYICYGCASIVNNICYFSEPEILQELLKETNIPGFLAGLLSRKDHHVLTSSLKIIEILMQKLPDAYLGFFIKEGVVNAVEALLNQEDCSKSTHLPDDMQQPETQPVIRNKTTCFCYAFDARRSEAAEKRTCRIGKDSLFTFARHVKTTYFTKDVVSSEMGLTEILQKLKTCCAVLNETTDKSSDQCNLHQSEEYLSTILNEVMMELHGGETMTTFEFLESGLVKSLSNYLSNGKYLQVENNMNCSSDHFLAVVKRFQSFARMSFSRMGQGWGDMLLTLLVSKLQNALTSVDNFPLIMSHNFKPRSSISDIPTRHSTITPCIRVRFKKDEDETNLSSYDSAVNVEISSSLHTIEEFLWPKVSIDVNSQKAESPPSGTALESKYADDDSQERDSTPSQKADSPSEGLACENQNPPVETSPKQGTSSSGQAERNTTILSDCTIQQKLVFSLNGKELDRSVTLYQSILQDQINVGSDIILDMQFWRSVHDITFRAANPEANITAVNPEANDSPRHSSTAMSSINENITGFTWQMLPFFPSMLLGKLPCKLDRSGPSYDILFMLHILEGLNRYSFHLVSDERNRSFAHGRITNLNDLKAEVFSIPQQEFVSAKLTDKLEQQMHDPLVSKSFCLPLWCTELMSACPFLFSFEARWKYFQLTAFGSLKNHHGHMIDASVNSVAERASNHSRKKFKVDRDDILVSAAKMMKSHAKSNALLEVEYKEEVGTGLGPTMEFYTLISHEFQKSGLGMWRGELPCESVTDNGHVSEFVVAPNGLFPRPWSASADSASFQEVSKRFHLLGLVVAKAIKDNRILDIPFSKAFYKLILGQSLDSELATSLVEFQALACRRKYAESNLTRDCQIISDLTYRGCRIEDLAIEFALPGYPEYVLSLGSCSDSLNAENLEEYVRHVVDATVKSGIARQMEAFKSGFNELGYRTWNHENTSMVFPLKKLQVFSEDELERLLCGEQDTWDFAKLVDHIKFDHGYTSSSPPVINLLEIIQEFGSLERRAFLQFITGSPRLPPGGLAALNPKFTVVRKHNSNDADDDLPSVMTCANYLKLPPYSSKEKMREKLLYAITEGQGSFHLS

SEQ ID NO: 21554 - DNA, 1164 bp, Sorghum bicolor
  misc_feature: Ceres ANNOT ID no. 8733141
  misc_feature: Up-regulated in shoot tissues in response to methyl jasmonate treatment
  misc_feature: Up-regulated in root tissues in response to methyl jasmonate treatment
  misc_feature: Up-regulated in shoot tissues in response to salicylic acid treatment
  misc_feature: Encodes the peptide sequence at SEQ ID NO 21555
atggagccatggaggctagtcagcgtttcatctgaggacgtatccaggctaaccacgacatctattcctgacggacaggactcggtcatgccaaaaacggccacgcaagctaggccaccaagatttgcatgtattcatgcacgatgggaaggtgtgatatcacgttttctggcaaggaaaccttcccacacaaaggaaagacagaccaggcaaccactctatgattgcttcctccccgttccgtcctcccggctaaaagtctccgcctccagagagatgtcggcggcgacggaggtggcgccagtacagcagcggagccatgcggcggcggtgtggcgggcggtggcggggtggctcggcctgctcttccagatcctgctccggatcatccgcagcacgccctcctcctgggcgcagctgctctccttcgtgggcctgcgccacccgctcctcccagtcgcctcgtcgcctgaggtggccttcgtgcagctcccatccgaggcccctgctgacgtgtcgcctccgccgctccggcggctcacggtggtgcttgacttggatgagactttagtttgcgcgtatgagtcttcgagccttcctgctactgtgcgcacacaggctgttgaagcaggattgcattgctttgacatggagtgtgtatcgtctgaaaaggatcctgatggaaggcagaggataaatcatgtaactgtctttgagcgtcctggcttacatgaatttttgcagcgaactagcgaatttgctgatcttgttctctttacagctggtttggaaggctatgccaaacctctagttgacaggatagatgctcacaacagattcactcaccgtctgtatcggccttcaactgttactacagaatacagagagcacgtaaaagatctttcttgtttgtccaaagatttccagagaattgtccttgttgataacaacccatacagtttcttactgcaaccattgaatggaataccatgtattacattttcagctggacaacctgttgacgatcagcttatgggaacgatatttccgctcctcgagcacctcgctctgcaaaaagatgttaggcctgcattgtatgaaacgtttcacatgccagagtggttccaaagacaaggaatcccacaaactgaacaggcagtttag

SEQ ID NO: 21555 - protein, 387 aa, Sorghum bicolor
  misc_feature: Ceres ANNOT ID no. 8733141
  misc_feature: Up-regulated in shoot tissues in response to methyl jasmonate treatment
  misc_feature: Up-regulated in root tissues in response to methyl jasmonate treatment
  misc_feature: Up-regulated in shoot tissues in response to salicylic acid treatment
  misc_feature (232)..(365): SWISSPROT Homolog: EC 3.1.3.16 Phosphoprotein phosphatase
  misc_feature (171)..(367): Pfam ID: NIF Pfam Description: NLI interacting factor-like phosphatase
MEPWRLVSVSSEDVSRLTTTSIPDGQDSVMPKTATQARPPRFACIHARWEGVISRFLARKPSHTKERQTRQPLYDCFLPVPSSRLKVSASREMSAATEVAPVQQRSHAAAVWRAVAGWLGLLFQILLRIIRSTPSSWAQLLSFVGLRHPLLPVASSPEVAFVQLPSEAPADVSPPPLRRLTVVLDLDETLVCAYESSSLPATVRTQAVEAGLHCFDMECVSSEKDPDGRQRINHVTVFERPGLHEFLQRTSEFADLVLFTAGLEGYAKPLVDRIDAHNRFTHRLYRPSTVTTEYREHVKDLSCLSKDFQRIVLVDNNPYSFLLQPLNGIPCITFSAGQPVDDQLMGTIFPLLEHLALQKDVRPALYETFHMPEWFQRQGIPQTEQAV

SEQ ID NO: 21556 - DNA, 2325 bp, Sorghum bicolor
  misc_feature: Ceres ANNOT ID no. 8733468
  misc_feature: Up-regulated in root tissues in response to salicylic acid treatment
  misc_feature: Up-regulated in shoot tissues in response to salicylic acid treatment
  misc_feature: Encodes the peptide sequence at SEQ ID NO 21557
atgaccgtagtccacttgtcagtggctggcacgggacgcgtggcctccacagtcgtcaggtgtggacagccgcgatgcttcaccactgccgttcgtgtcttcgccaccccatcccgcaccgcgtgcgtacaccgtggttcctatggatcactgacgcaccggcccctccgataccatcgccaatacgacgtcgagcatttcccatggaccgcgtccacgcgagtgatctccacccacatgcacccggtggggacctgccgccccaataaaagcaccgtacccgtcgtctgcgagccacgacccctcgacactgcgagcgaacgcggacaaatatatcctcgctcgtcagtcgcagctactccgccgccgccgcaactccgcacggccaccaccttcttccgggctccagcgatgtcggcggcgatcagaggagccgagttccccggcttccggggcgcggcggcgcagctccccaggtcgcggatgctcgggaggccgatccgggtggcgccacccgccgcggcccagccaggcggcggcggcgcgtccgcgggcagcatacgcgccgtctccgcgcctgcgaagaaggatgcttctgaagttaagcgaagcaaggttgagataataaaggaaaagagcaattttctcaggtaccctttgaacgaggagttggtctcagaggccccaaatatcaacgagagtgctgttcagctgatcaagtttcatgggagctaccagcaaactgatcgggatgtccgtgggcagaagaattactcatttatgctccggacaaagaatccttgtggaaaagttccaaaccaactttatttggctatggatacactagctgatgagtttggaatcggaacactccgcctgacgaccaggcagacattccaattgcacggagttcttaagaagaacttgaagactgttctcagcactgtcataaagaatatgggctcaacattgggcgcttgtggtgatctcaacaggaatgtacttgcacctgcagcaccttatgtcaaaaaggatatcctttttgctcaacaaacagcagagaacattgccacacttcttacaccacagtctggggcttattatgacctgtgggtggatggagaaaagataatgtcagctgaagagcctcctgaggtgacaaaagcccgcaatgacaactcacatggaacaaacttccctgactctcctgagccaatttatggcacccaatatctgccgaggaagttcaaggtcgcagttaccgcggctggtgataactctgttgatattctgaccaatgacataggtgtcgttgttgtttcagatgatgcaggagaacctattggttttaacatctatgttggtggtggcatgggaagaacacaccgagtggaaactacattccctcggctggctgatccgttgggttatgttccgaaagaagatatattatatgctataaaggccatcgtcgtcacacagagggaaaatggaagaagggatgatcgcaagtatagtaggatgaagtatttgattgaccgttggggaatcgacaagtttcgggctgaagttgaaaaatattacgggaagaagttcgaaagtttccgaccattgccagagtggcagtttaacagctaccttggctggcaagaacagggtgatgggaaattattctatggagtgcatgttgataacggtcgtgttggtgggcaagcaaagaaaactctacgagagataatcgagaagtataatttggatgttagtattaccccaaaccaaaatcttattttatgtgggattgatcaggcatggagagaacccattactacagctcttgcccaagctggcctgctggaaccacaggatgttgaccccctgaatttaacttccatggcatgccccgccttgccactatgccctttggcacaaacagaagctgaacgggggatcttacccattcttaaacggattaggacagttttcaacaaggttggtatcaaggattcagagtctgtggttgtgaggataactggctgccctaatggatgtgctagaccatatatggcagagcttggttttgttggtgatggcccaaaaagttaccagatctggctgggtggaacaccaaaccagagtacgctagcagaatcatttatggataaagtgaagcttgatgacattgagaaggttttagaacctctgttttcctattggaatagcacgcgccaggaaggtgaatcttttggaagcttcacaaaccgaacgggattcgacaaattgaaagatgtggtgaacaagtgggcagagtcaccatcagccgcatga

SEQ ID NO: 21557 - protein, 774 aa, Sorghum bicolor
  misc_feature: Ceres ANNOT ID no. 8733468
  misc_feature: Up-regulated in root tissues in response to salicylic acid treatment
  misc_feature: Up-regulated in shoot tissues in response to salicylic acid treatment
  misc_feature (198)..(762): SWISSPROT Homolog: EC 1.8.7.1 Sulfite reductase (ferredoxin)
  misc_feature (351)..(532): Pfam ID: NIR_SIR Pfam Description: Nitrite and sulphite reductase 4Fe-4S domain
  misc_feature (251)..(319): Pfam ID: NIR_SIR_ferr Pfam Description: Nitrite/Sulfite reductase ferredoxin-like half domain
  misc_feature (547)..(615): Pfam ID: NIR_SIR_ferr Pfam Description: Nitrite/Sulfite reductase ferredoxin-like half domain
MTVVHLSVAGTGRVASTVVRCGQPRCFTTAVRVFATPSRTACVHRGSYGSLTHRPLRYHRQYDVEHFPWTASTRVISTHMHPVGTCRPNKSTVPVVCEPRPLDTASERGQIYPRSSVAATPPPPQLRTATTFFRAPAMSAAIRGAEFPGFRGAAAQLPRSRMLGRPIRVAPPAAAQPGGGGASAGSIRAVSAPAKKDASEVKRSKVEIIKEKSNFLRYPLNEELVSEAPNINESAVQLIKFHGSYQQTDRDVRGQKNYSFMLRTKNPCGKVPNQLYLAMDTLADEFGIGTLRLTTRQTFQLHGVLKKNLKTVLSTVIKNMGSTLGACGDLNRNVLAPAAPYVKKDILFAQQTAENIATLLTPQSGAYYDLWVDGEKIMSAEEPPEVTKARNDNSHGTNFPDSPEPIYGTQYLPRKFKVAVTAAGDNSVDILTNDIGVVVVSDDAGEPIGFNIYVGGGMGRTHRVETTFPRLADPLGYVPKEDILYAIKAIVVTQRENGRRDDRKYSRMKYLIDRWGIDKFRAEVEKYYGKKFESFRPLPEWQFNSYLGWQEQGDGKLFYGVHVDNGRVGGQAKKTLREIIEKYNLDVSITPNQNLILCGIDQAWREPITTALAQAGLLEPQDVDPLNLTSMACPALPLCPLAQTEAERGILPILKRIRTVFNKVGIKDSESVVVRITGCPNGCARPYMAELGFVGDGPKSYQIWLGGTPNQSTLAESFMDKVKLDDIEKVLEPLFSYWNSTRQEGESFGSFTNRTGFDKLKDVVNKWAESPSAA

SEQ ID NO: 21558 - DNA, 1074 bp, Sorghum bicolor
  misc_feature: Ceres ANNOT ID no. 8733560
  misc_feature: Up-regulated in shoot tissues in response to salicylic acid treatment
  misc_feature: Up-regulated in root tissues in response to salicylic acid treatment
  misc_feature: Encodes the peptide sequence at SEQ ID NO 21559
atggggggcggcggcggcggaggagcctctgggccggagctgtcgacggacaacatgaaggggatagtcctcgcgctgctctccagcggcttcatcggcgccagcttcatcatcaagaagaagggtctccgccgggccgccgccgcgaccggcgtccgtgcaggtgtcggcgggtactcctacctcatggagcccctgtggtgggttggcatgatcactatgattgtaggtgagattgccaatttcgtggcatatgccttcgcccccgcggtgctggttactccccttggagcgctcagcataattgttagtgcagtgctggctcatttcattctgaatgagaggttgcatgccctcggggtgcttggctgtgtgatgtgcattgcagggtctgtggtcatcgttattcacgctccacaggagcaggagattacttcagttagggaaatatggaacatggcgatacaacctgctttcttgctatatgttgcgtcagttattgtcattgtttttgtcctggtgttctatttctcccctctctatgggcagtccaatgtgttgatctacactgccatttgctctttgatgggctctctttcggttatgagtgttaaggctcttggtacatcattaaagctcactttcgagggaacaaaccaattaatatatccagagacttggttctttatgcttgttgtggctacttgtgtgctcactcagatgaactatctgaacaaggcacttgacacgttcaatacggcaattgtatctccaatatactatgtgatgttcacaactcttacaatacttgccagcgtcataatgttcaaggattggtctggtcaaagcccgggaagcatcatttctgaaatttgtggtttggttgtggtgttgtccggtaccattttgttgcatgtaacgaaggattatgaaaggatcccgcaatcaagaagtgtttatgcaccattatctccctccttgacaactagattaaatggagaattgttgaagcatgtcgaggatgagaggacttcggacgaagaaaaggcattgagaagacaagagatgtactag

SEQ ID NO: 21559 - protein, 357 aa, Sorghum bicolor
  misc_feature: Ceres ANNOT ID no. 8733560
  misc_feature: Up-regulated in shoot tissues in response to salicylic acid treatment
  misc_feature: Up-regulated in root tissues in response to salicylic acid treatment
MGGGGGGGASGPELSTDNMKGIVLALLSSGFIGASFIIKKKGLRRAAAATGVRAGVGGYSYLMEPLWWVGMITMIVGEIANFVAYAFAPAVLVTPLGALSIIVSAVLAHFILNERLHALGVLGCVMCIAGSVVIVIHAPQEQEITSVREIWNMAIQPAFLLYVASVIVIVFVLVFYFSPLYGQSNVLIYTAICSLMGSLSVMSVKALGTSLKLTFEGTNQLIYPETWFFMLVVATCVLTQMNYLNKALDTFNTAIVSPIYYVMFTTLTILASVIMFKDWSGQSPGSIISEICGLVVVLSGTILLHVTKDYERIPQSRSVYAPLSPSLTTRLNGELLKHVEDERTSDEEKALRRQEMY

SEQ ID NO: 21560 - DNA, 981 bp, Sorghum bicolor
  misc_feature: Ceres ANNOT ID no. 8733564
  misc_feature: Down-regulated in root tissues in response to methyl jasmonate treatment
  misc_feature: Encodes the peptide sequence at SEQ ID NO 21561
atgggctcgtcgtcggagccgctgtcgaggggcctgtacgcgctggtcgagccctacgactccgggttcctcaaggtctccgatgtccacaccatctactacgagcagtccggcaacccccagggccatccggtggtgtttctccacggaggtcccggagccggcacgtcgcccggcaacaggaggttctttgacccggagttctacagaatcgtgctgtttgaccagaggggtgcaggcagaagcactccccatgcctgtttagagcagaacactacttgggacttggtagctgacattgagaagctcagggagcatcttgacatcccggaatggcaggtgtttggtggttcatggggaagcaccttggcacttgcctacagccaggagcaccctgataaggtcactggccttgttctgagaggaattttcatgcttaggaaaaaggagcttgattggttctacgagggtggtgcagcagccattttcccagatgcatgggaaccatttagagattttattcccgaggatgaaaggaattgtttcatagatgcgtataacaaaaggttaacttcatctgatcctattgttcaggttgaagctgctaagcgctggacgatgtgggagatgatgactgcccatcttatccaaaacaatgataacattaaaagaggagaagatgacaagttttcactggcatttgcaaggattgaaaatcactattttgtgaataagggttttttaccctccgactcattcctattggacaatgttgacaagatccgacatattaaagcttttattgtacagggccgttatgatgtttgttgccctatgatgtcggcttgggatcttcataaggcttggcctgaagctgaattcaaggtggtaccggatgcagggcactcggccaatgaagtaggcatcgctgccgaactgaggtcagccaccgaaaagctgagggacttgttgagcaaatga

SEQ ID NO: 21561 - protein, 326 aa, Sorghum bicolor
  misc_feature: Ceres ANNOT ID no. 8733564
  misc_feature: Down-regulated in root tissues in response to methyl jasmonate treatment
  misc_feature (10)..(324): SWISSPROT Homolog: EC 3.4.11.5 Prolyl aminopeptidase
  misc_feature (69)..(315): Pfam ID: Abhydrolase_1 Pfam Description: alpha/beta hydrolase fold
MGSSSEPLSRGLYALVEPYDSGFLKVSDVHTIYYEQSGNPQGHPVVFLHGGPGAGTSPGNRRFFDPEFYRIVLFDQRGAGRSTPHACLEQNTTWDLVADIEKLREHLDIPEWQVFGGSWGSTLALAYSQEHPDKVTGLVLRGIFMLRKKELDWFYEGGAAAIFPDAWEPFRDFIPEDERNCFIDAYNKRLTSSDPIVQVEAAKRWTMWEMMTAHLIQNNDNIKRGEDDKFSLAFARIENHYFVNKGFLPSDSFLLDNVDKIRHIKAFIVQGRYDVCCPMMSAWDLHKAWPEAEFKVVPDAGHSANEVGIAAELRSATEKLRDLLSK

SEQ ID NO: 21562 - DNA, 2874 bp, Sorghum bicolor
  misc_feature: Ceres ANNOT ID no. 8733713
  misc_feature: Down-regulated in shoot tissues in response to salicylic acid treatment
  misc_feature: Encodes the peptide sequence at SEQ ID NO 21563
atgcgaggaggaggaggaggagggccgggcgtcggcacgccggggcgcccgcgatgggggtccggcgccacgacgccgcggtcgctgagcacgggctcctcgccgcgcggctccgaccggagctccgacgacggggaggagctggtcgaggtcacgctggacctcctcgaggacgacaacattgtgctgcggagcgtcgagccggcagcggcgggctccgccgcggtggcggctccgccgcgccgccacccggacccgaccccgtcgtcgtccggggcgccgtcgcggtcgcgctcgcccgcgatgcgccggacctcctcgcaccgcctgctgcagttctcgcaggagctcaaggctaccgccaaccgcgccaagcagttctcgcaggacctcaccaagcgcttcacgcgcacacagagccgcgccaacctcgcggacccgccgccggccacaggcaccgccgcggcgccgtcctcgggcatcgacgccgcgctcgaggcccgcgcacagcgccgccgccgcgcgcagctcgaccgcaccaagtccggcgcgcagcgcgcgatccgcggactccgattcatcagcggcggcaacaaggctagcaacgcctggatcgaggtccaggctaacttcgaccgcctcgcgcgcgacggctacctctcccgcgccgactttcccaaatgcatagggatgacggagtcgcaggagttcgcgatggagctcttcgacacgctgagccgccgccggcagatgcaggtggataagatcaacaaggatgagctgcgcgagatctggcagcagatcaccgacaacagcttcgactcgcgcctccagatcttcttcgacatggtggataagaacgcagatggccatatcacggaggccgaggtgaaagagatcattatgctgagtgcttctgctaataaattgtcgaggcttaaggagcaagctgaggagtatgcagccttgatcatggaggaacttgatcctgaagggcttggctacattgagctttggcaattggagacactgctactgcaaaaggatacctatgtgaactacagccaggccttgagttacacaagccaggcactaagccagaaccttgctggtctgaggaaaagaagtccaatccgaaaaattagcagcacggtgaactactatctggaggacaactggaaacgtctctgggtgcttgcagtgtggattggaataatggctgggttgttcatttggaagttcattcagtaccgtaaccgttatgtctttgatgtgatgggctactgtgtcacaactgcgaaaggtgctgcagagactctcaaactgaacatggcgcttattctcttgcctgtatgccgcaacactatcacctggctgcggaatactaaagctgcacgagcattgccgttcgatgacaacataaacttccataagactattgcagcagcaattgtggttggtgttgttcttcatgcagggaaccaccttgtatgtgattttccacggctcattggttcatcagagatgaagtatgctccgctgcgcaaatactttggggaaaataaaccaacatatctagctctggtaaaaggagtggagggcataacaggggtaatcatggttgtgtgcatgcttatcgcttttactctagcaacaaggtggttccgccgtagcctggtgaagcttccaaggccatttgacaaactaactggcttcaatgcattctggtactcccatcatctgttcatcattgtgtacatagcacttgttattcatggagagtgtctataccttatccatgactggtacaaaaagacgacatggatgtaccttgctgttcctgttggtctgtatgtaggggaaaggactctgaggtttttcagatcaggcagttattctgttcggttattgaaggtggctatatatcctggtaatgttttgacattgcagatgtctaaacctcctgcattccgttacaagagcggacagtatatgtttgttcaatgccctgcagtttcaccttttgaatggcatcctttctcaattacttcagcacctggggatgactatttaagcattcatgttcgacaacttggtgactggacacgggagctcaagcgggtattctcagcagcttgtgagccaccggtgggtgggaaaagtggccttcttcgagcagacgagacaactaagaaagcgttaccaaaacttttgattgatggaccatatggttctcctgcacaagactacagcaagtatgatgttctactacttgtcggattaggaattggtgccacaccttttattagcatactgaaagacctgctcaataacatcatcaaaatggaagaagaggaagaagcttcaagtgatctttacccaccaattggtcgcagcaaggcacatgttgatcttgacacccttatgaggattacctcaaaaccaaagagggtactgaagacaacaaatgcttacttttattgggtgacacgtgaacaagggtcttttgattggtttaaaggggtcatgaatgaaattgctgaactagatcagaggaatatcattgagatgcacaactatctcacaagtgtttacgaggaaggggatgcccggtcagcactcattacaatgctacaagctctcaaccatgccaagaatggtgttgatatagtttctggaactaaagtgcggacacattttgcaagaccaaattttaagaaggtcctatctaagatagctaccaaacatccatatgctaagataggagtgttctattgtggggctccagttctggcacaggaactaagcaaactctgttatgaattcaatggcaagtctacaacaaaattcgaattccacaaggaacatttctga

SEQ ID NO: 21563 - protein, 957 aa, Sorghum bicolor
  misc_feature: Ceres ANNOT ID no. 8733713
  misc_feature: Down-regulated in shoot tissues in response to salicylic acid treatment
  misc_feature (391)..(710): SWISSPROT Homolog: EC 1.6.3.1 NAD(P)H oxidase
  misc_feature (753)..(940): Pfam ID: NAD_binding_6 Pfam Description: Ferric reductase NAD binding domain
  misc_feature (176)..(275): Pfam ID: NADPH_Ox Pfam Description: Respiratory burst NADPH oxidase
  misc_feature (631)..(747): Pfam ID: FAD_binding_8 Pfam Description: FAD-binding domain
  misc_feature (434)..(590): Pfam ID: Ferric_reduct Pfam Description: Ferric reductase like transmembrane component
  misc_feature (276)..(304): Pfam ID: efhand Pfam Description: EF hand
MRGGGGGGPGVGTPGRPRWGSGATTPRSLSTGSSPRGSDRSSDDGEELVEVTLDLLEDDNIVLRSVEPAAAGSAAVAAPPRRHPDPTPSSSGAPSRSRSPAMRRTSSHRLLQFSQELKATANRAKQFSQDLTKRFTRTQSRANLADPPPATGTAAAPSSGIDAALEARAQRRRRAQLDRTKSGAQRAIRGLRFISGGNKASNAWIEVQANFDRLARDGYLSRADFPKCIGMTESQEFAMELFDTLSRRRQMQVDKINKDELREIWQQITDNSFDSRLQIFFDMVDKNADGHITEAEVKEIIMLSASANKLSRLKEQAEEYAALIMEELDPEGLGYIELWQLETLLLQKDTYVNYSQALSYTSQALSQNLAGLRKRSPIRKISSTVNYYLEDNWKRLWVLAVWIGIMAGLFIWKFIQYRNRYVFDVMGYCVTTAKGAAETLKLNMALILLPVCRNTITWLRNTKAARALPFDDNINFHKTIAAAIVVGVVLHAGNHLVCDFPRLIGSSEMKYAPLRKYFGENKPTYLALVKGVEGITGVIMVVCMLIAFTLATRWFRRSLVKLPRPFDKLTGFNAFWYSHHLFIIVYIALVIHGECLYLIHDWYKKTTWMYLAVPVGLYVGERTLRFFRSGSYSVRLLKVAIYPGNVLTLQMSKPPAFRYKSGQYMFVQCPAVSPFEWHPFSITSAPGDDYLSIHVRQLGDWTRELKRVFSAACEPPVGGKSGLLRADETTKKALPKLLIDGPYGSPAQDYSKYDVLLLVGLGIGATPFISILKDLLNNIIKMEEEEEASSDLYPPIGRSKAHVDLDTLMRITSKPKRVLKTTNAYFYWVTREQGSFDWFKGVMNEIAELDQRNIIEMHNYLTSVYEEGDARSALITMLQALNHAKNGVDIVSGTKVRTHFARPNFKKVLSKIATKHPYAKIGVFYCGAPVLAQELSKLCYEFNGKSTTKFEFHKEHF

SEQ ID NO: 21564 - DNA, 2295 bp, Sorghum bicolor
  misc_feature: Ceres ANNOT ID no. 8733777
  misc_feature: Down-regulated in shoot tissues in response to salicylic acid treatment
  misc_feature: Encodes the peptide sequence at SEQ ID NO 21565
atggccgccaagcacgtcgtgctgttcccgttccccggtcagggccacctctccgcgttcatgtccctcgccgacctcctacacggcattctccccgacgccgccatcacgctcgtctccaccccgcgcaacgttgccgcgctccggactaccgcacggtccaactcgtcgttcctcgtcttccacgcgctgcccttcaccccggcggaccacggcttgccaccggactgcgagtcctccgacgccgtacagcccggcgccatcgcgggcctcctcgtggcgttcgagtcgctcgaggccgcgttcgacgactacctctccgccgccgtcgccggtggccacgacgtctgcgtcgtttccgacccgttcacggcgtggacggtgaccgcggcccggcgccgcggctgcgcgcacgccttcttcgcctcctgcggcgcgtacggcagcgccgtcgtgcactcgctctggagccacctgcccgtccgccctgatccggccacgggccgcgtccacctgcccgagtaccccgaggtcgtgatccaccgctcgcagctctccaagatcgcgtccgccccgcccgccgtcgccatccgcgccgccggattctacggccggcagatccctctgggctacgagacgggtgccgtgctcgtcaacaccgtggaggagttcgagcccaccggtctcgacatgctgcggcgcaccctcaagatcccggtctggcccatcggccctctcgtgcgcgccaccaaccttccagtctcgccggaggccgatgccgccgtcgtgagcttcctggactgccacccgccgtcgtcggtgctgtacatctcattcggctctcagaactcaatactagcagagcacatggcggagctggcactggcgttagagtcaaccggccggccgttcgtctgggttgtcaggccgccggacggacacaacatcaagggcgagttccgggccgaccagtggctgccggacgggttcgaggagagggcgcgcacgaccaacagaggactgctggcacgagggtgggcaccgcaggtgaggatcctggcgcacgcgtcgacgggcgcgttcctgagccactgcgggtggaactcggtgctggagagcgtgacgcacggcgtgccgatcatcggctggccgctcgccggcgagcagttctacaatgccaagatgcttacagaggaatggggcgtgtgcgtggaagtggcgagggggaacatggaggacactgtggtgaacagtgctgcggtcgccgacgttgtggagacggtgatgggtcagacggcgaaggccgcggagatgcggcggcgggtgagggagatcaagaaggcggtggaggggtcctggaacgagggaggcgggtcgtcgaggaaggcgatggaggatttcttgcgggcgatgaatctccgatctttttttttgttcgctgctccaattccccgttccctgctcgtctctattgttcgtcttgaggtcaagcctggatccactgttaagtgtgagcctggacatggctttatcctgcacctttcgcaggctgctctcggggaatcaaagaaaagtgacaatgccttgatgtacgtcaaagtcgacgatcagaagcttgccattggaaccctctctattgacaagtttccgcaagtacaattcgatttggttttcgataaagagtttgagctgtcgcacacatcaaaaactaccaatgaggaggagctggacgttcctgtaatcaaggaaaatggcaaagctgatgggaaggagcagaaaagtcaagagaaggcagttgccgcagcttcaaaatcaagtcttgtttctaagaaaagcaaggatgatgatgattctgatgaggatgagactgatgattctgattctgatgataccgatgattctgatgagggtgagggattatctcctgaagaaggcgatgacgatgattcaagtgatgaggatgatacaagtgacgatgaggaggaagaaactccaactcctaagaagaagccagaggcaggcaagaagagacctgctgaaaattccctgactcctctttctgataagaaagctaaggttgccacaccgtcagcccagaagacaggtggcaagaagggcgccgtccatgtggcaactccacacccagcaaaaggcaagacccctgcaaacaatgataaatcaaaggagaagtctccaaaatctggtggctcggtcccttgcaaatcttgcaccaagactttcaacagtgagatggcacttcaggctcactcgaaggcgaagcatggtgccaagtga

SEQ ID NO: 21565 - protein, 764 aa, Sorghum bicolor
  misc_feature: Ceres ANNOT ID no. 8733777
  misc_feature: Down-regulated in shoot tissues in response to salicylic acid treatment
  misc_feature (5)..(460): SWISSPROT Homolog: EC 2.4.1.238 Anthocyanin 3'-O-beta-glucosyltransferase
  misc_feature (4)..(503): Pfam ID: UDPGT Pfam Description: UDP-glucoronosyl and UDP-glucosyl transferase
MAAKHVVLFPFPGQGHLSAFMSLADLLHGILPDAAITLVSTPRNVAALRTTARSNSSFLVFHALPFTPADHGLPPDCESSDAVQPGAIAGLLVAFESLEAAFDDYLSAAVAGGHDVCVVSDPFTAWTVTAARRRGCAHAFFASCGAYGSAVVHSLWSHLPVRPDPATGRVHLPEYPEVVIHRSQLSKIASAPPAVAIRAAGFYGRQIPLGYETGAVLVNTVEEFEPTGLDMLRRTLKIPVWPIGPLVRATNLPVSPEADAAVVSFLDCHPPSSVLYISFGSQNSILAEHMAELALALESTGRPFVWVVRPPDGHNIKGEFRADQWLPDGFEERARTTNRGLLARGWAPQVRILAHASTGAFLSHCGWNSVLESVTHGVPIIGWPLAGEQFYNAKMLTEEWGVCVEVARGNMEDTVVNSAAVADVVETVMGQTAKAAEMRRRVREIKKAVEGSWNEGGGSSRKAMEDFLRAMNLRSFFLFAAPIPRSLLVSIVRLEVKPGSTVKCEPGHGFILHLSQAALGESKKSDNALMYVKVDDQKLAIGTLSIDKFPQVQFDLVFDKEFELSHTSKTTNEEELDVPVIKENGKADGKEQKSQEKAVAAASKSSLVSKKSKDDDDSDEDETDDSDSDDTDDSDEGEGLSPEEGDDDDSSDEDDTSDDEEEETPTPKKKPEAGKKRPAENSLTPLSDKKAKVATPSAQKTGGKKGAVHVATPHPAKGKTPANNDKSKEKSPKSGGSVPCKSCTKTFNSEMALQAHSKAKHGAK

SEQ ID NO: 21566 - DNA, 768 bp, Sorghum bicolor
  misc_feature: Ceres ANNOT ID no. 8733805
  misc_feature: Up-regulated in shoot tissues in response to methyl jasmonate treatment
  misc_feature: Down-regulated in root tissues in response to methyl jasmonate treatment
  misc_feature: Encodes the peptide sequence at SEQ ID NO 21567
atggccgctcctctccacgcgcgcctcctcccgctccccttgcccccgaaccctagccccggcctccccccgagcggcgcgcggcgggtgctccggcacccgcgccgctgcctcgcgacgccgccgtcgcggaacgggagctcctcctcgccggagaccgagtggtgcccggtgccgccggagcagcgccccgtgaacgagtacgaggcgctcgcggcgtccctgcccttctcctgggcggcgggggacctccgcgtctactgctcccgcctcgcgctcacgggcgccgccgtcgcgctcttcgtcgggctccccgtcgccgccttcgggggacgcggcggggccggcggcgacgctctgcacctcgcgctcggcgccacggggtccgggatcctcgccgtcacgctcgccgtcgtgcggatgtacctcgggtgggcctacgttggcaaccgcctgctcagcgccacagtggagtatgaggagacgggatggtatgatgggcagatatgggttaaaactccagaagttttagctcgcgatcgacttctaggctcattttctgtcaagcctgtgctaaacagagtgaagttcaccttggtgggtctggcaggctccctgatcctttgcattcttctttacgtgaacaccgaaaacccaaaggaaccatatgttaataccggtggaagggctatccctggagtgtacagtgacactgccgcaaggtcatttgagcctgatgcattctgtggagagcctgatctttcgtag

SEQ ID NO: 21567 - protein, 255 aa, Sorghum bicolor
  misc_feature: Ceres ANNOT ID no. 8733805
  misc_feature: Up-regulated in shoot tissues in response to methyl jasmonate treatment
  misc_feature: Down-regulated in root tissues in response to methyl jasmonate treatment
MAAPLHARLLPLPLPPNPSPGLPPSGARRVLRHPRRCLATPPSRNGSSSSPETEWCPVPPEQRPVNEYEALAASLPFSWAAGDLRVYCSRLALTGAAVALFVGLPVAAFGGRGGAGGDALHLALGATGSGILAVTLAVVRMYLGWAYVGNRLLSATVEYEETGWYDGQIWVKTPEVLARDRLLGSFSVKPVLNRVKFTLVGLAGSLILCILLYVNTENPKEPYVNTGGRAIPGVYSDTAARSFEPDAFCGEPDLS

SEQ ID NO: 21568 - DNA, 2736 bp, Sorghum bicolor
  misc_feature: Ceres ANNOT ID no. 8733798
  misc_feature: Up-regulated in shoot tissues in response to methyl jasmonate treatment
  misc_feature: Encodes the peptide sequence at SEQ ID NO 21569
atggcgctctaccgtcgtgtcctgatcctccgtcgcctctcccacctccacccctcgcccgcccccgccatctgctcctcaccgccaccacccacccttgcggggctcttcacccctatggggcgccgccacatggccttctcgtccgccgaggaggccgccgccgagcgccgccgccgcaagcgccgcctccgcatagagcctccaatgaacgccctccgccgcggcccgcctcccccgcgggaccccaacgcgccccgcctcccagacaccacctccgcgctcaccggcccgcgtctcagcctccacaaccgcgtccagtccctcatccgctcgggtgatctagacggcgcctcagtcgccgcccgcgccgccgtctcctcgcgcgtccggcccaccgtcttcacctgcaacgccgtggccgcggccatggtccgcgccgcccgccacgatgacgccgtcgcgctcttcgatttcttcttccgccgctccaacatcgtccccaacatcgtctcctacaacaccctcatccacgcacactgcgaggccgaccgcgtcgacaccgcggtgcaggtctaccacgacatgctcgcgtctgcgcccttttccccctctgcagtcacctttcgccacctcaccaagggtctcgtcgctgttggtcgcatccatgacgccctcgacctcctccgcgagatgctcgaccgcggcgctggcgcggactccctcgtctacaacaacctcatcgctggctacatcgacctcgacgactggggcagggccttcgagctctttaacgagctcgcagagaggtgccttgtctacgacggtgttgtccacaccaccttcatggagggctactggaggcagggcaaggacaaggaggccatggacaactaccagtcccttcttgatcggggcttcaagatgacgccggccacctgcaacgtcctgctcgagacactcttcaagcacggcaagcacaaggaggccaacgacctatgggagaccatgattgacaaccacaccccgccaagcttcattggcatcaacgctgagtcctacaatgtcatggttaaccagtgcttcagggagggcaagttcaaggaggcgattgaggtcttccaccgccagcccaggaagaatgtccaaatggacgtcggctgcttcaacaacatcattggcaaactctgtgaaaatggcatgctaggtgaggcagaaaagctctttgaggagatggagaagaagtcagtccttccagatgtgcacacctacacttaccttgttgactcatgcttcaaggaaggtcgtgtggaagatacaatgggatatttctacaaaatggcagatgggaagcagcatgggccaaagttcaatattggtttcttcaaccgcatgtttgaagggcttacagaagctggccggattgatgatgccttgaaggtgtacgggaggatgcctgacaaggagatcaaaccaaacatgaccacttttgaaatccttgtcaaagccttatgcaaagaagaaggggacttggatcaagcaaggggcctagtgatggacatggcgagaggtagtattgtgcctcctccagagttccgtgagtctgttgttaactttttcaagaaggctggtcgacaggaagaaattgagaaagcttttgaagaaaaacctatgctaacaactcagcctaggacagagtatctgtcgaggactgaatatcactctcgcaatgcagttggtgctgctcaagtaaaacaacctggctttagctcagctccagcagcggaacctgaatttgtttactctcagccacaacagtcaacacttagtaacactccaaatcagcagcctgagtttggctcatctcgttcatggaattcaggttttggtgctcctcaagcgcagcctggatatggtgcacctcagcctgtacaggctgtagctggttcatctcagcgaccccggacacagtttggtgcttctcagggtgaaccaggatatagcaacataggaaatcagcatggtcagtttggttctccccagagagaaccaaaatatagcaaccatccaccacaagttgggtatggtgcccaattgcctcagtcaggatatcgctttgagctccaacaagaacaggttggaattggaaatcgagtagcacaatctgcatatgtggcttcaagccaaccctcatatgacacccgctggagctcaagtggttatggatcaacccaagggcaactgggatatggtggtcctcaagcgcagtcacatgaatctcagttaccacatcaccagggaaattttggtatgccacatatccaaaataacaatggcttctatagacacaaccatggatacatgccatctaatggtctgcagggatttgatgctccccatggtgattctggaactgctatgtctaaagactatcaagagactaccacttctgaagaccggcttgtgaaattacaaaaggttgcttctctgtttgacatcattgataatatcaatgatcctatgaaaggtttctgtttcggaacatccactttatatggaacagataggccagtgcctatcatcagacctgggaacgacatcattgtatgtagtttacctatcattacgatgtgctatctggttacgatacttttcggtttttgctgtacattttgtcaaaaacgtggagaaatagcattgaagagaaaggttttctttaacaaaaatctagcgtaa

SEQ ID NO: 21569 - protein, 911 aa, Sorghum bicolor
  misc_feature: Ceres ANNOT ID no. 8733798
  misc_feature: Up-regulated in shoot tissues in response to methyl jasmonate treatment
  misc_feature (387)..(421): Pfam ID: PPR Pfam Description: PPR repeat
  misc_feature (352)..(386): Pfam ID: PPR Pfam Description: PPR repeat
  misc_feature (460)..(494): Pfam ID: PPR Pfam Description: PPR repeat
  misc_feature (171)..(205): Pfam ID: PPR Pfam Description: PPR repeat
MALYRRVLILRRLSHLHPSPAPAICSSPPPPTLAGLFTPMGRRHMAFSSAEEAAAERRRRKRRLRIEPPMNALRRGPPPPRDPNAPRLPDTTSALTGPRLSLHNRVQSLIRSGDLDGASVAARAAVSSRVRPTVFTCNAVAAAMVRAARHDDAVALFDFFFRRSNIVPNIVSYNTLIHAHCEADRVDTAVQVYHDMLASAPFSPSAVTFRHLTKGLVAVGRIHDALDLLREMLDRGAGADSLVYNNLIAGYIDLDDWGRAFELFNELAERCLVYDGVVHTTFMEGYWRQGKDKEAMDNYQSLLDRGFKMTPATCNVLLETLFKHGKHKEANDLWETMIDNHTPPSFIGINAESYNVMVNQCFREGKFKEAIEVFHRQPRKNVQMDVGCFNNIIGKLCENGMLGEAEKLFEEMEKKSVLPDVHTYTYLVDSCFKEGRVEDTMGYFYKMADGKQHGPKFNIGFFNRMFEGLTEAGRIDDALKVYGRMPDKEIKPNMTTFEILVKALCKEEGDLDQARGLVMDMARGSIVPPPEFRESVVNFFKKAGRQEEIEKAFEEKPMLTTQPRTEYLSRTEYHSRNAVGAAQVKQPGFSSAPAAEPEFVYSQPQQSTLSNTPNQQPEFGSSRSWNSGFGAPQAQPGYGAPQPVQAVAGSSQRPRTQFGASQGEPGYSNIGNQHGQFGSPQREPKYSNHPPQVGYGAQLPQSGYRFELQQEQVGIGNRVAQSAYVASSQPSYDTRWSSSGYGSTQGQLGYGGPQAQSHESQLPHHQGNFGMPHIQNNNGFYRHNHGYMPSNGLQGFDAPHGDSGTAMSKDYQETTTSEDRLVKLQKVASLFDIIDNINDPMKGFCFGTSTLYGTDRPVPIIRPGNDIIVCSLPIITMCYLVTILFGFCCTFCQKRGEIALKRKVFFNKNLA

SEQ ID NO: 21570 - DNA, 2361 bp, Sorghum bicolor
  misc_feature: Ceres ANNOT ID no. 8733831
  misc_feature: Up-regulated in root tissues in response to methyl jasmonate treatment
  misc_feature: Up-regulated in shoot tissues in response to methyl jasmonate treatment
  misc_feature: Encodes the peptide sequence at SEQ ID NO 21571
atgcggatgcctccatgtagccgcaaccgcaaccgcaggcccggggcaccaggtaagcgcgccaccgccgctttccgcccaattcaccgccgccgactcagctttcccatttctaggaaaggttggtgcgggcggcgcgggttgcgcgcttcctgcagtgacgaccgcctcagcgccctcaccgacgacctactgctcctcatcttgcgccgcctcgacacccgcacggcgctagccaccgcaaccctctcgaagcgctggagttgcctgccccgctgtctcgatgccctcgatttcagggtcactgacatactcccggcgcgctactaccagtggatcagtatccacggtaaagccgctaattatgcttatggtttgggcgtcgatctcaaggtgctccgcgacaacattaagcggtatgagcgccgtgctatgcgtgctatgacctcatccatcaacaacttcctcgacgcagatgatgatcaggacagaggcagtctaggcctctggagtgtccgaacactgcggcttgatttctttcctggtcattgttcaagtggcatcaaccgattgatagctaaggctgctgattcgtggggggtcgaagatctggaggttttagttaagaatacattccagcaacattttgcccacagttttcctcaccatggtctctgcaacaatccacacaactcccgactaagaagtttgaagctggcagcctgctacattccaccattgaagggcttccatgcgctcaccagcctggtcttgcaagatttaccagagtccactccaaccgcagcctatgaagctattttcaccttgtgcccgcagctacaagcactgcacctcaagtcctgcacactgaaccaaggtgttgtggccgtacacgcccccaaatcacagatcaagcaacttatcatggagcattgctggtttgggctgattaagctgtacactctgccactgctcgagagcatggctgttctgcaaagtaatgtgagttatgagcttagctccttcccatacctcacacacttgaatatcgcctttcaccgtggtgtcacaaaaacccgctgtgttcgtgttggaaattattatgacctcaatcagtatcttggaggaaccccgggaataagtgaccttatagtacgcttcactggatatgacagatggttcaaaccttggagccccacattgttgttccctaaactcaggaggcttctgattgctgatgtgccttcatcctgggatgtctcttggccccgcctccttattgaggcggcaccatgcctcgagtgccttcacatccatattaccccttgggaggaggagcctcatgatgacatttcgtgggaaccctctgagttctgccataatcagctaaaggagttggtgataattggttttcagggagcggagagacagatttactttgttaactttgttattaaagtatcaacgtcattgcagcttgtttccttgtacaaaaatggacatgttcaggacagggggcgctggaactgggacattgtgacacagcaataccaatgggttaaagaggagaaggttaaaatactgaaccagattgctgatagcgctccttgcgctgctacacccgttcagcgatctgggagaggctctgtggagaggctcaacagctctgtggagaggctctctaagctaaaggcggacaggtttactgagatcaagaaaaaggctttggctattatatcattctggaatactttgttggtgccttatgagaaaaagcaggaacttctaagcctgatgtactatgtggaagtggaatcagataaggagataactgaagtcagtgctttgtcggtagagtttctcaatagagttgtgcaagagtatgatgaactttgtgaacaaatgaatggattggttttgaagaagaaatataagcttttgcagattctaaagactacccatctcccatccaactttgtcaataaagatatcactgaccctatagcagcacttttgtatatgaagacagaaatctctaaggcacaaaatctggcttctcaacgtgctgccattgtggccaaaatggaattcattcagcatgcggatagagagactgactggtataaagaatcaaagaagtccggtgtcatcattcaagatgaaagaagtataaaagtaaaaattctgcaaaaagggcttccgaaaatattgaggagtcttaaggctgaacttggcaagcgggcagaaccatttatatatgatgagccgattattatcggtcactatttattcttggtcagtaaccattttggtccaatctttgcgaccgcaagaagcggcaaacttgaagatcatatctag

SEQ ID NO: 21571 - protein, 786 aa, Sorghum bicolor
  misc_feature: Ceres ANNOT ID no. 8733831
  misc_feature: Up-regulated in root tissues in response to methyl jasmonate treatment
  misc_feature: Up-regulated in shoot tissues in response to methyl jasmonate treatment
MRMPPCSRNRNRRPGAPGKRATAAFRPIHRRRLSFPISRKGWCGRRGLRASCSDDRLSALTDDLLLLILRRLDTRTALATATLSKRWSCLPRCLDALDFRVTDILPARYYQWISIHGKAANYAYGLGVDLKVLRDNIKRYERRAMRAMTSSINNFLDADDDQDRGSLGLWSVRTLRLDFFPGHCSSGINRLIAKAADSWGVEDLEVLVKNTFQQHFAHSFPHHGLCNNPHNSRLRSLKLAACYIPPLKGFHALTSLVLQDLPESTPTAAYEAIFTLCPQLQALHLKSCTLNQGVVAVHAPKSQIKQLIMEHCWFGLIKLYTLPLLESMAVLQSNVSYELSSFPYLTHLNIAFHRGVTKTRCVRVGNYYDLNQYLGGTPGISDLIVRFTGYDRWFKPWSPTLLFPKLRRLLIADVPSSWDVSWPRLLIEAAPCLECLHIHITPWEEEPHDDISWEPSEFCHNQLKELVIIGFQGAERQIYFVNFVIKVSTSLQLVSLYKNGHVQDRGRWNWDIVTQQYQWVKEEKVKILNQIADSAPCAATPVQRSGRGSVERLNSSVERLSKLKADRFTEIKKKALAIISFWNTLLVPYEKKQELLSLMYYVEVESDKEITEVSALSVEFLNRVVQEYDELCEQMNGLVLKKKYKLLQILKTTHLPSNFVNKDITDPIAALLYMKTEISKAQNLASQRAAIVAKMEFIQHADRETDWYKESKKSGVIIQDERSIKVKILQKGLPKILRSLKAELGKRAEPFIYDEPIIIGHYLFLVSNHFGPIFATARSGKLEDHI

SEQ ID NO: 21572 - DNA, 1581 bp, Sorghum bicolor
  misc_feature: Ceres ANNOT ID no. 8733885
  misc_feature: Up-regulated in shoot tissues in response to methyl jasmonate treatment
  misc_feature: Encodes the peptide sequence at SEQ ID NO 21573
atggcggcgacgacccacgccgcctccatgtcgttcctcctctcccacccgcagtcgcgctccgccacgccaagccgccacctccagctccgcccggcagcccgccgcgtccgctgctgcgccaccgacgccaccgccgccgcccccgcagccaccaccaagcaccggcgcgcggcggatgagaacatccgcgaggaggcggcgcggcacccggccccgaagcagggcctctccgcgtggtacgagcccttcccgccggccccgaacggcgaccccaacgagcgctactccctggacgagatcgtctaccgctccagctcggggggcctcctcgacgtgcgccacgacatggaggcgctggcccgcttctccggcgcctactggcgggacctcttcgactcccgcgtcggccgcaccacctggccctacggctccggcgtctggtccaagaaggagttcgtgctccccgagatcgacccggaccacatcgtctccctcttcgagggcaactccaacctcttctgggccgagcgcctcggccgcgaccatctcggcgggatgaacgacctctgggtcaagcactgcggcatctcccacacgggctccttcaaggacctcggcatgaccgtgcttgtcagccaggtcaaccgcctccgccgcgccccgctgtcgcgccccatcgccggcgtcggctgcgcgtccacgggggacacctccgccgcgctctccgcctactgcgccgccgcggggatcccggccattgtcttcctccctgccaatcgcatctcgctggagcagctcatccagcccatcgccaacggcgccaccgtgctttccctcgacaccgacttcgatggctgcatgcggctcatcagggaggtgactgccgagctgcctatctaccttgccaattcgcttaattccctccggctggaggggcagaagacagcggccattgagatactgcagcagttcgattgggaggtgcccgattgggtgattgtgccgggaggcaatctggggaacatatatgcgttctacaagggatttgagatgtgccgtgttcttgggcttgttgatcgtgtgccgcggcttgtctgtgcacaggcagccaacgcaaacccgctctatggctattacaagtcaggctggaccgagttccaacctcaggtggccagaccaacatttgcatcagcgattcagatcggtgacccggtgtctgtcgaccgagctgtggtcgcgctcaaggcaacgaatggcattgtcgaggaggccacagaggaagagctcatgaacgcaatgtcactcgctgaccgcactgggatgtttgcttgcccacatactggggttgcgctcgccgccctgttcaagctcagggaccagcgcatcatcgggccaaatgatcgcacggtggtcgtcagcacagctcacggcctgaagttctcgcagtcaaagatcgactaccatgatagtaagatcgaggacatggcttgcaagtactccaacccgcctgtgagcgtgaaggctgactttggcgccgtcatggatgtgctgaagaagaggctcaagggtaagctctga

SEQ ID NO: 21573 - protein, 526 aa, Sorghum bicolor
  misc_feature: Ceres ANNOT ID no. 8733885
  misc_feature: Up-regulated in shoot tissues in response to methyl jasmonate treatment
  misc_feature (60)..(522): SWISSPROT Homolog: EC 4.2.3.1 Threonine synthase
  misc_feature (164)..(476): Pfam ID: PALP Pfam Description: Pyridoxal-phosphate dependent enzyme
MAATTHAASMSFLLSHPQSRSATPSRHLQLRPAARRVRCCATDATAAAPAATTKHRRAADENIREEAARHPAPKQGLSAWYEPFPPAPNGDPNERYSLDEIVYRSSSGGLLDVRHDMEALARFSGAYWRDLFDSRVGRTTWPYGSGVWSKKEFVLPEIDPDHIVSLFEGNSNLFWAERLGRDHLGGMNDLWVKHCGISHTGSFKDLGMTVLVSQVNRLRRAPLSRPIAGVGCASTGDTSAALSAYCAAAGIPAIVFLPANRISLEQLIQPIANGATVLSLDTDFDGCMRLIREVTAELPIYLANSLNSLRLEGQKTAAIEILQQFDWEVPDWVIVPGGNLGNIYAFYKGFEMCRVLGLVDRVPRLVCAQAANANPLYGYYKSGWTEFQPQVARPTFASAIQIGDPVSVDRAVVALKATNGIVEEATEEELMNAMSLADRTGMFACPHTGVALAALFKLRDQRIIGPNDRTVVVSTAHGLKFSQSKIDYHDSKIEDMACKYSNPPVSVKADFGAVMDVLKKRLKGKL

SEQ ID NO: 21574 - DNA, 2355 bp, Sorghum bicolor
  misc_feature: Ceres ANNOT ID no. 8733927
  misc_feature: Down-regulated in root tissues in response to salicylic acid treatment
  misc_feature: Encodes the peptide sequence at SEQ ID NO 21575
atgatgatcgggaataagagaagggctgtagcatctggtgctgcacatttcctgccggaggagatgatgacagaggtgttcctacggctgcctgtcaaatccattcttcgctttcgggccgtctgccggtcctggaatgcagtgctttcatccgatgaattctgctgcctccacatggccagggctgaagcagagccagcgcctcctagtctgttcttcacttcaccaacagctggttttgacgccactgcggtgtacttgagctcatcatcaggccccgatgacggcctgctgttcactcttgatgatgtatgtggcggtgacttcatccacatgacacctgcaccgtgccgtggcctcaccctcctacacgatccttttgcaccagcttactatgtcttcaacgcatccacaagggcagttacccggttgcccccgtgccacaatgcgcactatgtgaccgctgggcttgggtttgatgcccggacgaagaagtacaaggtggtgaggttattccgaggggatcctgatgagacctttgcatgggtccggtcgccgccgtttgaagcatcaggtgtgcacttggtggagcttgcaggccacctgtgcatggtccgggaccttcgtcatgttggcgtgctagagatttggaagctgaatgactgtagctctggtggttggtcattggaacatcgcattgatctgttgcagcatgttggcagagatgttgtaattgagcctgagattgttagagttattggttctgttggcagttgtgtgtccacaaagaggatagtcattgctacatccaaacgcaaggtgattgtctatgatcccgtgtctcagactgtagaaactgtcactgcaatcagagagacccattcatcttaccaagctgaaaatcttgctcttactagtgtctccctgtttcaagagagcctggttccagtgcatcagacaaatgaagagagggccctgtcagctcccctggctaaagcgactagggagatcttgctccgactcccaggtgattgtaccatgcgattcaaacttgtctgcaagcagtggcttagcttgattgagagtaacagctttgtgcactcttatcactcgcataacaacatggacaagaggcccaagatcatgcttgtgggcaagggcatcacttgggatcgcatcactagaggatcaggcttcagttttactccctgctcaaagttgctccaacgtgctcgtagacatgatatatggcttgacacgaaggtggtttgctccaagccttgccatggcctgaacctgctaagcactgagctgaaggactatctctacaacccctgtacaggtttctgtcgtatgtatcacactcgaggggaggcatccgtccacgtaccctggaatattcgtagctatgttggcagcaagaatgttggcctggggttcaatctgtcgacgcaggatcacgtgattgttgaaatgttttaccacatgaaggacttcaaatcccgtcgatatttcttgacatgcatagtgtccgagtgtacaaggggctctgtcagtgacggcttcccgccacctctgcctgtgagtgacatgccgccggtgtatcttgcaggagtgctctactggatgactgatccaaggttgggcgaaagtgatgcgagggctgttgtgtcgtttgacataacaagaagtgaatttagtgtcatcccctgtccgcaatgtattgctaagtggaactgcggaattgcttccagtgcttttctggttgagcttgaggggacattatgtgctgttcttgcagaccctgatgcagaagagctaagtatttggaagcgagagaatggtcagtggcatagcgcatacacggtgtatttggaaggttggccaggctattcccttggggcaaatgttgtggtgccatgggctatcgatcccaaggacgggaagatcttgctaaacacggggaggaaattgggattctatgatccagcaaggcgttttattgagaacctgtatgatcttgaagaggtgctgcgtgtcaggagtacagagcaatcctctcatattggagtccctgaaaatctttgcattgccaaatgcaaacatgatgttgagaggttctgttcacagaaatcactttttgtgcagcacaaggtttcagatgatccttcgcctgctttatctggaaatagttctgcatgctccagcggagagcaatgtttggatagaagaaattcattacatactgaaataatacccttggtccctatattatacggggagagtctgacaagttttccccgaaagcgcaaatcaaacgttttattagatattttagcatcacaatttccataa

SEQ ID NO: 21575 - protein, 784 aa, Sorghum bicolor
  misc_feature: Ceres ANNOT ID no. 8733927
  misc_feature: Down-regulated in root tissues in response to salicylic acid treatment
  misc_feature (13)..(60): Pfam ID: F-box Pfam Description: F-box domain
MMIGNKRRAVASGAAHFLPEEMMTEVFLRLPVKSILRFRAVCRSWNAVLSSDEFCCLHMARAEAEPAPPSLFFTSPTAGFDATAVYLSSSSGPDDGLLFTLDDVCGGDFIHMTPAPCRGLTLLHDPFAPAYYVFNASTRAVTRLPPCHNAHYVTAGLGFDARTKKYKVVRLFRGDPDETFAWVRSPPFEASGVHLVELAGHLCMVRDLRHVGVLEIWKLNDCSSGGWSLEHRIDLLQHVGRDVVIEPEIVRVIGSVGSCVSTKRIVIATSKRKVIVYDPVSQTVETVTAIRETHSSYQAENLALTSVSLFQESLVPVHQTNEERALSAPLAKATREILLRLPGDCTMRFKLVCKQWLSLIESNSFVHSYHSHNNMDKRPKIMLVGKGITWDRITRGSGFSFTPCSKLLQRARRHDIWLDTKVVCSKPCHGLNLLSTELKDYLYNPCTGFCRMYHTRGEASVHVPWNIRSYVGSKNVGLGFNLSTQDHVIVEMFYHMKDFKSRRYFLTCIVSECTRGSVSDGFPPPLPVSDMPPVYLAGVLYWMTDPRLGESDARAVVSFDITRSEFSVIPCPQCIAKWNCGIASSAFLVELEGTLCAVLADPDAEELSIWKRENGQWHSAYTVYLEGWPGYSLGANVVVPWAIDPKDGKILLNTGRKLGFYDPARRFIENLYDLEEVLRVRSTEQSSHIGVPENLCIAKCKHDVERFCSQKSLFVQHKVSDDPSPALSGNSSACSSGEQCLDRRNSLHTEIIPLVPILYGESLTSFPRKRKSNVLLDILASQFP

SEQ ID NO: 21576 - DNA, 1005 bp, Sorghum bicolor
  misc_feature: Ceres ANNOT ID no. 8733924
  misc_feature: Down-regulated in shoot tissues in response to salicylic acid treatment
  misc_feature: Encodes the peptide sequence at SEQ ID NO 21577
atggccggtgcgcaggagtccctgtccctggtgggcacgatgcgcgcccacaacggcgaggtgacggcaatcgccaccccgatcgacaactcgccgttcatcgtctccgcctcccgcgacaagtccgtgctgctgtgggacctggaaaacccggtccactccaccccggaatccggcgtcaccgccgactacggcgtccccaaacgccgcctcaccggccactcccacttcgtccaggacgtcgtcctcagctccgacggcatgttcgccctctctggctcctgggacggcgagctccgcctctgggacctctccaccggcgccaccacccgccgcttcgtcggccacggtaaggacatcctctccgtcgccttctccgtcgacaaccgccagatcatctccgcgtcccgcgacaagaccatcaagctctggaacaccctcggtgagtgcaagtacaccatcggcggcgacctcggtggtggcgagggccacaacgggtgggtctcctgcgtcaggttctcccccaacaccttccagcccaccatcgtttccggatcctgggatcgcaccgtcaaggtctggaaccttaccaactgcaagctgcgctgcactctcgacggccacggcggctatgttaacgccgtcgccgtgagccccgacgggtcgctgtgcgcatctggcgggaaggacggtgttactctgctgtgggatttggctgaggggaaaaggctgtactcgctggacgcgggctctatcatccactccctctgcttctcgcccaaccgctactggctctgcgctgcgacacaggactctgtcaagatctgggaccttgagtcgaagcacgtcgtgcaggacctcaagcccgacatccagatctccaagaaccagatcctgtactgctcaagcttgagctggagcgcagatggaagcaccctctacactggctacaccgatgggtctatcagggtttggaagatctctgcttatggctacgcaggctag

SEQ ID NO: 21577 - protein, 334 aa, Sorghum bicolor
  misc_feature: Ceres ANNOT ID no. 8733924
  misc_feature: Down-regulated in shoot tissues in response to salicylic acid treatment
  misc_feature (71)..(280): SWISSPROT Homolog: EC 2.7.11.7 [Myosin heavy-chain] kinase
  misc_feature (155)..(195): Pfam ID: WD40 Pfam Description: WD domain, G-beta repeat
  misc_feature (107)..(145): Pfam ID: WD40 Pfam Description: WD domain, G-beta repeat
  misc_feature (199)..(237): Pfam ID: WD40 Pfam Description: WD domain, G-beta repeat
  misc_feature (65)..(103): Pfam ID: WD40 Pfam Description: WD domain, G-beta repeat
  misc_feature (8)..(47): Pfam ID: WD40 Pfam Description: WD domain, G-beta repeat
  misc_feature (288)..(326): Pfam ID: WD40 Pfam Description: WD domain, G-beta repeat
MAGAQESLSLVGTMRAHNGEVTAIATPIDNSPFIVSASRDKSVLLWDLENPVHSTPESGVTADYGVPKRRLTGHSHFVQDVVLSSDGMFALSGSWDGELRLWDLSTGATTRRFVGHGKDILSVAFSVDNRQIISASRDKTIKLWNTLGECKYTIGGDLGGGEGHNGWVSCVRFSPNTFQPTIVSGSWDRTVKVWNLTNCKLRCTLDGHGGYVNAVAVSPDGSLCASGGKDGVTLLWDLAEGKRLYSLDAGSIIHSLCFSPNRYWLCAATQDSVKIWDLESKHVVQDLKPDIQISKNQILYCSSLSWSADGSTLYTGYTDGSIRVWKISAYGYAG

SEQ ID NO: 21578 - DNA, 1662 bp, Sorghum bicolor
  misc_feature: Ceres ANNOT ID no. 8733938
  misc_feature: Down-regulated in shoot tissues in response to methyl jasmonate treatment
  misc_feature: Down-regulated in root tissues in response to methyl jasmonate treatment
  misc_feature: Encodes the peptide sequence at SEQ ID NO 21579
atggcgtctcgccgggtcgcctcctcgctcctccgctccgtctcccgcctccgggacgcatcgcccgcggggccgcgcccgcgtgccccgcctcaccgcccgtccccggccgggtacctcttcaaccgcgccgccgcctacgcctcctccgccgcggcccaggcggcgcccgccgcgtcggcgccggccaccgggaagaccgggggcggcaagatcaccgacgagttcaccggcgccggggccatcggccaggtgtgccaggtgatcggcgccgtcgtcgacgtgcgcttcgatgagggcctcccgcccatcctcacggcgctcgaggtgctcgacaacaacatccgcctcgtgcttgaggtggcgcagcaccttggcgagaacatggtgcgcaccatcgctatggacggcacggaggggctcgtccgcggccagcgcgtcctcaacaccggctcccccatcaccgtgcctgttggcagggctacccttggacgcatcataaatgttatcggtgagccgattgatgagaggggtgacataacgacaaaccacttcctccctattcatcgtgaagcccctgctttcgttgagcaggccactgagcagcaaattcttgtaactggaatcaaggtcgtggatcttcttgcaccctaccaaaggggtggaaagattggtctctttggtggtgcaggagtgggtaaaactgtgctcattatggagcttatcaacaatgttgctaaggcccatggtggtttctctgtgtttgctggtgttggagaacgtacccgcgaaggtaatgacctgtacagggaaatgattgaaagtggtgtcattaagctaggtgacaagcagagtgaaagcaaatgcgctcttgtctacgggcagatgaacgagccccctggtgctcgtgctcgtgttgggttgactggtttgactgttgctgaacatttccgtgatgctgaaggacaagatgtgcttctttttattgacaacattttccgtttcactcaggcaaactctgaggtgtctgctcttcttggacgtatcccatctgctgtgggataccagccaacccttgccactgatcttggaggactgcaagagcgtattacgacaacaaagaagggttctattacgtctgtccaggctatctatgtgcctgctgatgacttgacggatcctgctcccgctactacctttgcccatcttgatgctacaactgtgctgtcacgacagatctctgagcttggtatttatcctgctgttgatccactggattccacatcaagaatgctttctccccacgtgctgggtgaggatcactacaacactgctcgtggtgttcagaaggttcttcagaactacaaaaatcttcaggatattattgctatcttgggtatggacgagctcagtgaagatgacaagttgacagtcgctcgtgcaagaaagattcagcgtttcctgagccagcctttccatgtcgctgaagttttcacgggtgctccagggaagtatgtggagctgaaggaaagcgttaagagtttccagggtgttttggatgggaagtatgatgacctccccgagcagtcattctacatggttggaggcattgaggaagtcattgctaaggctgagaaaattgccaaggagtctgcttcataa

SEQ ID NO: 21579 - protein, 553 aa, Sorghum bicolor
  misc_feature: Ceres ANNOT ID no. 8733938
  misc_feature: Down-regulated in shoot tissues in response to methyl jasmonate treatment
  misc_feature: Down-regulated in root tissues in response to methyl jasmonate treatment
  misc_feature (39)..(553): SWISSPROT Homolog: EC 3.6.3.14 H(+)-transporting two-sector ATPase
  misc_feature (207)..(429): Pfam ID: ATP-synt_ab Pfam Description: ATP synthase alpha/beta family, nucleotide-binding domain
  misc_feature (442)..(549): Pfam ID: ATP-synt_ab_C Pfam Description: ATP synthase alpha/beta chain, C terminal domain
  misc_feature (85)..(151): Pfam ID: ATP-synt_ab_N Pfam Description: ATP synthase alpha/beta family, beta-barrel domain
MASRRVASSLLRSVSRLRDASPAGPRPRAPPHRPSPAGYLFNRAAAYASSAAAQAAPAASAPATGKTGGGKITDEFTGAGAIGQVCQVIGAVVDVRFDEGLPPILTALEVLDNNIRLVLEVAQHLGENMVRTIAMDGTEGLVRGQRVLNTGSPITVPVGRATLGRIINVIGEPIDERGDITTNHFLPIHREAPAFVEQATEQQILVTGIKVVDLLAPYQRGGKIGLFGGAGVGKTVLIMELINNVAKAHGGFSVFAGVGERTREGNDLYREMIESGVIKLGDKQSESKCALVYGQMNEPPGARARVGLTGLTVAEHFRDAEGQDVLLFIDNIFRFTQANSEVSALLGRIPSAVGYQPTLATDLGGLQERITTTKKGSITSVQAIYVPADDLTDPAPATTFAHLDATTVLSRQISELGIYPAVDPLDSTSRMLSPHVLGEDHYNTARGVQKVLQNYKNLQDIIAILGMDELSEDDKLTVARARKIQRFLSQPFHVAEVFTGAPGKYVELKESVKSFQGVLDGKYDDLPEQSFYMVGGIEEVIAKAEKIAKESAS

SEQ ID NO: 21580 - DNA, 1242 bp, Sorghum bicolor
  misc_feature: Ceres ANNOT ID no. 8733961
  misc_feature: Up-regulated in root tissues in response to salicylic acid treatment
  misc_feature: Up-regulated in shoot tissues in response to salicylic acid treatment
  misc_feature: Encodes the peptide sequence at SEQ ID NO 21581
atggtggtggaagtgggcaccgccgtggggacacgaaccacctccacttggcctgcaggtccagccgcccggcgcagttcacggggccaggtcgtctccttcgccttcgccttcgccctcgcccccgagtcgtcccgccgggtccgggtccgggtccggtgccgcgcgatgcagcaggaggagcggcggccgccgaccgtccgcgcggtcaccatccccttcgccgacctcagggagacggacaaggacctcggcggcaagatcgaggaaggcctgggtccccatgggctcggcatcatcaccattgccgatatacctgagtttccagagctaagaaaaaggctgctgcggttggcaccaaggattgcaaaccttcctgaagaggtgaagaaacagcttgaagatccagatagcagatataactttgggtggagtcatgggaaggagaaactcgagtctgggaaacttgacacatttaaaggttccttttatgcgaaccctgttttggatgtccctactactgatgatgtgcttgtaagtaggtatccatcatattgccgaccaaatatatggccaaatgagaatcttcctgaacttgagatagcatttaaagctcttgggaagctgatgatggaagttggtttgatgttggctcatcattgtgatcgctacgtaatggggcaaggagtgggatcatatgatggtgacagtcttgagcagacgattgcccgttcaaggtgtcacaagggtcgtctgttgtactatttcccacgacagtttagcaagcagatagacgttgagtctgtttcatcatggtgtggatggcacactgatcatggatctctaacaggtctcacatgtggcttgtttacgaagaattctgtggaggtaccatgtccagatagtgcagctggactatacattcggactcgtgataaccaagttgttaaggttgtgtttgatgaggatcagctggcttaccaaattggggaaactactgaaatactgtcaagagggtatctgtgtgcaacgccacactgtgtgcaggcacccaacagtgaaaatgcttcaaatgttgaccgctctacttttgccttgttcatgcaaccagattggaatgagaagcttaagtttccgagcgaaatcccctatcaccaagagttgattccaccaaacggaacgctgactttcggggaatactctgaaaggctagtaaacaagtattaccagacaacaacgtag

SEQ ID NO: 21581 - protein, 413 aa, Sorghum bicolor
  misc_feature: Ceres ANNOT ID no. 8733961
  misc_feature: Up-regulated in root tissues in response to salicylic acid treatment
  misc_feature: Up-regulated in shoot tissues in response to salicylic acid treatment
MVVEVGTAVGTRTTSTWPAGPAARRSSRGQVVSFAFAFALAPESSRRVRVRVRCRAMQQEERRPPTVRAVTIPFADLRETDKDLGGKIEEGLGPHGLGIITIADIPEFPELRKRLLRLAPRIANLPEEVKKQLEDPDSRYNFGWSHGKEKLESGKLDTFKGSFYANPVLDVPTTDDVLVSRYPSYCRPNIWPNENLPELEIAFKALGKLMMEVGLMLAHHCDRYVMGQGVGSYDGDSLEQTIARSRCHKGRLLYYFPRQFSKQIDVESVSSWCGWHTDHGSLTGLTCGLFTKNSVEVPCPDSAAGLYIRTRDNQVVKVVFDEDQLAYQIGETTEILSRGYLCATPHCVQAPNSENASNVDRSTFALFMQPDWNEKLKFPSEIPYHQELIPPNGTLTFGEYSERLVNKYYQTTT

SEQ ID NO: 21582 - DNA, 2706 bp, Sorghum bicolor
  misc_feature: Ceres ANNOT ID no. 8733983
  misc_feature: Up-regulated in shoot tissues in response to salicylic acid treatment
  misc_feature: Up-regulated in root tissues in response to salicylic acid treatment
  misc_feature: Encodes the peptide sequence at SEQ ID NO 21583
atggcgccaccgcgcgcaaaccctagccaccacccgctcctcgtcctccccctcctgctcctgctcctactcctgatccccgccgccgcggcggatgcctccctgtcctccttctcctactcccgccactgccccaacctcccgtccgcgctcgacctgcccggcggccaagtttccgcgctcgggcccgacgcccctgtccccgtccccgaggtctccaccgggtacttcgtcggcggagaccgcatcttcggctccgacacctaccagccgcgctccttctcgctgttcccctcctccgtcgcccgcaccaccaacgcgtcgctcctccacgtctccgccactctcaccgtctccggcgggcgccgcccgttccgcgaccgcggcggccggaacctcttcgagtacgacggccgcgcgcgccacttccgcccgcacctcccgcgcttcacggggcggcgcggctccatcaccttcggcctggagggctactactccaccgcgtccggggacctctgcatggtcggcaccgggtctgggcgctccgtcgacggcacgcccgtgcacttcctccccgtcgtgctccgcctcggtttccccatccccgccaacgtgacgcggcccttcgtcaccggtcgcctcgagaacgtcgacaccatcaaccccatcgagcccatctcactcgtcgcctacgcccaggagggctacgtgtacggggagagcgcctcctgcccgccgccgcctgcggggaggcttgacgcgctgcaggtgttcgagaataggaatttctcgtgcgcccacctcagttccatgctcaaatcgccgttcaggttggactacccgaatggcagcgagtcgatcgcatcttcactggggattcaccaaagctacatgtatgtcaaccggatgcactgcaacgatgatggagctgtccgcgcttatgtggcgttcactaaccagacagaggtatcaaggtactacttcatgctgggggagaaggctgtcgtggtggatgggttctgggatcagaagagcagccggctttgcctcaaagggtgtcacgtggtgaaggggccatcccgtgtagatttggcagtgggtgagtgtggaattgggatgagcttctggttcccggcagtgtggtctttacagcaacggagcttttctgctggtctggtctggaatgcaagtctagaaagtggtgaggccattgctgcaggttctagtgcaatcactcccaactataggggcaatctttctggtttgaagtataattacactaaggtggatgaggctatgaagcactatgagaaatctggatggaacaagaacaggaaagggaagttcccagatagcaattcataccgggacttggtgttccgtttcttcgtgcagaaaggaggcggctctggatatgcctcacccgtcacaattggatcaatgttgtttgatggtaactctttggttgatcaagatccccattttcagcatgtcacagccgagatgaagcaaagactgcttaatgtcagctatgatatctactatgttggcaattggtctctagaatcattccaccgtcgacatatctctgctgagggtgtttatgatactaagacaggttccctttgcatgatcgcttgtcgagaacttaatgtctcatcagattgtgaaattctggtgactgctcagttttcttctttggatgcaaaggttgcacagcatgtgaaggggacaatcaaaagcttgaggaagaagactgaccctcttttctttaaaacactggacattgcttcatatgggatgtatgtagagcaagtggacgaatcaatatggagaatggacttagaaagcaccatggccttgatctctatgacactagcatgcatcttcattgctgtgcagctatttcatgtcaaaaaggtccctgaagcactccctgccatgtctatcaccatgcttgttgttctggctcttggctacatgatccctcttgtgctgaactttgacgctctcttcaagaacagcaacaaacagactgttccactttcaggtggtggatggcttgaggtgaatgaagttatggtgcgaatcattaccatgataacctttctgctgcagttgcgtcttcttcagctggcttggtctgcacgatctgtggatgtcagcaaagctgagtcatggtctgctgagaagaaagtgctctggatatgcttgccactgtacataattgggggagttattacttgggttgttcacatgagatcgaaccacagccgaagaatgctaaggcaggttgtccacttgaagccaatcgagcatgcattctgggaggaccttgtgtcttattgtggattgatactcgatgggttcttgctccctcaagtgatcctaaatgtgttctcagattccaaagttagagccctttccccagggttctatattggaagcaccttaatccgtgcgctgcctcatgtgtatgatgtgttcaggcgacagcattttgtgcccagcttgagaccatcttacatgtatgcgagccctcatgatgatctcttcagccttgcttgggacatcgtcataccttgcggagcactactactgtcggtgcttctcttctttcagcagtggcgtggaggagctttcttcctttgttcgaagaacaggaagacaagagagtatgaaatggtttccacagtcagttcttaa

SEQ ID NO: 21583 - protein, 901 aa, Sorghum bicolor
  misc_feature: Ceres ANNOT ID no. 8733983
  misc_feature: Up-regulated in shoot tissues in response to salicylic acid treatment
  misc_feature: Up-regulated in root tissues in response to salicylic acid treatment
MAPPRANPSHHPLLVLPLLLLLLLLIPAAAADASLSSFSYSRHCPNLPSALDLPGGQVSALGPDAPVPVPEVSTGYFVGGDRIFGSDTYQPRSFSLFPSSVARTTNASLLHVSATLTVSGGRRPFRDRGGRNLFEYDGRARHFRPHLPRFTGRRGSITFGLEGYYSTASGDLCMVGTGSGRSVDGTPVHFLPVVLRLGFPIPANVTRPFVTGRLENVDTINPIEPISLVAYAQEGYVYGESASCPPPPAGRLDALQVFENRNFSCAHLSSMLKSPFRLDYPNGSESIASSLGIHQSYMYVNRMHCNDDGAVRAYVAFTNQTEVSRYYFMLGEKAVVVDGFWDQKSSRLCLKGCHVVKGPSRVDLAVGECGIGMSFWFPAVWSLQQRSFSAGLVWNASLESGEAIAAGSSAITPNYRGNLSGLKYNYTKVDEAMKHYEKSGWNKNRKGKFPDSNSYRDLVFRFFVQKGGGSGYASPVTIGSMLFDGNSLVDQDPHFQHVTAEMKQRLLNVSYDIYYVGNWSLESFHRRHISAEGVYDTKTGSLCMIACRELNVSSDCEILVTAQFSSLDAKVAQHVKGTIKSLRKKTDPLFFKTLDIASYGMYVEQVDESIWRMDLESTMALISMTLACIFIAVQLFHVKKVPEALPAMSITMLVVLALGYMIPLVLNFDALFKNSNKQTVPLSGGGWLEVNEVMVRIITMITFLLQLRLLQLAWSARSVDVSKAESWSAEKKVLWICLPLYIIGGVITWVVHMRSNHSRRMLRQVVHLKPIEHAFWEDLVSYCGLILDGFLLPQVILNVFSDSKVRALSPGFYIGSTLIRALPHVYDVFRRQHFVPSLRPSYMYASPHDDLFSLAWDIVIPCGALLLSVLLFFQQWRGGAFFLCSKNRKTREYEMVSTVSS

SEQ ID NO: 21584 - DNA, 1572 bp, Sorghum bicolor
  misc_feature: Ceres ANNOT ID no. 8733980
  misc_feature: Up-regulated in shoot tissues in response to salicylic acid treatment
  misc_feature: Encodes the peptide sequence at SEQ ID NO 21585
atggagccctcgccagcggcgggagagctgggcgcgatgcttcgggcggccgctgacttcgcgtcctacccagggttgcatagtgatgatactgtgaggcagttcctggaacgatgtcctctgcctaagctcttaggtgcattgcagagtgaagcagatgtacctgggatggttgaaactgtcacagagtgtttagacaaaatattttcctcaagatatggagcgtcacttctgccaagctacggtgcatttattcaagctggattgctcacagactcgaagcaaatcagaaaattagcctgcaaagctgtactccatcttcttgacaaggctgaagatggtgctgctgtggagacagttgtgcagcacaatctgtttcctcttatgatcaattgcttgattgagggagatgaagagatttcagcaatcattttggacactgtaaagcgtttagcacaaattcctaaaggagccgaagtcatattcccaccagatggtcaaggatctgtccaacttggtaaagtggcggctcagtcatcctcattgccacggattcgtattctatctttaatagccaagctcttcactgtttcaagttatactgcttctgccattcgtgatacaaaccttctgagcatatttgaagaggaaataaaagatacaagagatatgcttaaaaccctcagtgcgctggaggtcttatatgagcttgttgaacaccctcacagcaacattttcttgctgaagaccaacttgcttcaactcatagttgatatcatcaatgattcatcagctgattctgttatacggtcaagggcagcattaattagtgggaggcttctttcttcagctgatgctttcacagcaattgataaatcctgcgttaccaatctgcttgtagccatagacaaaattttgaagatggaagaaagccagaatactgatgaaattgagagtgcattggagaccttgggtctaattggtacaacaagtcaaggagcacatttcttgctgacatcatcaaatgttgccagacatgttgtcaagtcatcctttgaccgacaaggcagaggtagacagctggctgctttacatgcctttgggagcatatgtggtatggatagacaagaagaccagatgaaacttgatgacgaagccgaaggaaacttgaagcgcttggtctatacaactgcagcaaacagtccaaaattaaccccttcagctgctcttctgtcaattctgcaacaagacccggacattaggatagctggttacagagtaatatcaggactggtcatccgggaatggtgcttaagggaggtttgcttaaattcagagataatcagatttgttacagacccaacaatggagacaacaaaacttggcatggaagcccggtataactgctgtgtggcaattaacaaggccctatcatcatcccatcttctgcatgaagcaagtctttctggactcattgggaagttgaatgatgccgtgaaacggggcccttacctttctgaaaggaagcgtgtggaggcacggccggttgttgatactgcagagaggttttaa

SEQ ID NO: 21585 - protein, 523 aa, Sorghum bicolor
  misc_feature: Ceres ANNOT ID no. 8733980
  misc_feature: Up-regulated in shoot tissues in response to salicylic acid treatment
MEPSPAAGELGAMLRAAADFASYPGLHSDDTVRQFLERCPLPKLLGALQSEADVPGMVETVTECLDKIFSSRYGASLLPSYGAFIQAGLLTDSKQIRKLACKAVLHLLDKAEDGAAVETVVQHNLFPLMINCLIEGDEEISAIILDTVKRLAQIPKGAEVIFPPDGQGSVQLGKVAAQSSSLPRIRILSLIAKLFTVSSYTASAIRDTNLLSIFEEEIKDTRDMLKTLSALEVLYELVEHPHSNIFLLKTNLLQLIVDIINDSSADSVIRSRAALISGRLLSSADAFTAIDKSCVTNLLVAIDKILKMEESQNTDEIESALETLGLIGTTSQGAHFLLTSSNVARHVVKSSFDRQGRGRQLAALHAFGSICGMDRQEDQMKLDDEAEGNLKRLVYTTAANSPKLTPSAALLSILQQDPDIRIAGYRVISGLVIREWCLREVCLNSEIIRFVTDPTMETTKLGMEARYNCCVAINKALSSSHLLHEASLSGLIGKLNDAVKRGPYLSERKRVEARPVVDTAERF

SEQ ID NO: 21586 - DNA, 1305 bp, Sorghum bicolor
  misc_feature: Ceres ANNOT ID no. 8734006
  misc_feature: Down-regulated in shoot tissues in response to salicylic acid treatment
  misc_feature: Encodes the peptide sequence at SEQ ID NO 21587
atgacaggattgaagaatcctattctatcagagccgagcgcgctgtcgaagttcttctcgatgttcttcacgctctcgctgatcttgttgacggctccggcaatgtcctgcaggccgccgagcgacaccttcccggaccaccacgccatcccagtccccggactccgatcaccacaggcgccagactacgtgaggcggggaaggggaccgagccgacgcgaccgcggagcaagggaagctcttcagctcagcgagctcccgccgcgctgtggcgagtggcgaggcgggaggggagatgtagctgctgcgggacagccggagggaggagtgcgtagggtagggttgggttgggtcagggagcacaacggacggagaggagggagagagtgcgttcggccgttggcgcgtgggggcgccgcgtcggcgtcggtgatcgcccgcgcgcccgcctacccccgctctcggctcggtgcagtgagcagtggatctcggcctgaacgaggaagacgaacggggaggtgcgggtgcggctcgtcccgtcgctccaggccagctgcgtcatcaccagggcacgctgcctaccagggccaaccaaccggggcgccgtacagtacagggcagcgtgggccgtgtggaccttgtcgacgagtcgctcatgggctgttccggcgtgcaatccaacagaggccacgtggcacactccctatgggtctctcgggcatcttcgcgccatgcgaggcggccacaacctcccaaacaaatcccaaaatcctcagcacgatacgattccaccgaattaagtttgtgcacgtagtacgcactgggacaccagtgagcaacacaacagccagtgcgcgcgccatggcctccctcgccgccgccgtctccgtgcagcccgtggccgtgaagggcctctccggcagctccatctccggcaggaagctcgccgtcgccagcaggccgtcgtcgtcggcccgcgccgcctgccgctccacccgcagggccgccgtcgtggccaagtacggcgacaagagcgtctacttcgacctcgaggacatcggcaacaccaccgggcagtgggacctctacggctccgacgctccctcgccctacaacccgctccagagcaagttcttcgagacgttcgcggctccgttcaccaagagaggcctgctgctgaagttcctgctgctgggcgggggctccctgctggcctacgtcagcgcgtcggcgtcgccggacctcctgccgatcaagaagggaccgcagcagccgccgcagccgggcccgcgcggcaagatctaa

SEQ ID NO: 21587 - protein, 434 aa, Sorghum bicolor
  misc_feature: Ceres ANNOT ID no. 8734006
  misc_feature: Down-regulated in shoot tissues in response to salicylic acid treatment
  misc_feature (293)..(434): Pfam ID: PSI_PsaH Pfam Description: Photosystem I reaction centre subunit VI
MTGLKNPILSEPSALSKFFSMFFTLSLILLTAPAMSCRPPSDTFPDHHAIPVPGLRSPQAPDYVRRGRGPSRRDRGAREALQLSELPPRCGEWRGGRGDVAAAGQPEGGVRRVGLGWVREHNGRRGGRECVRPLARGGAASASVIARAPAYPRSRLGAVSSGSRPERGRRTGRCGCGSSRRSRPAASSPGHAAYQGQPTGAPYSTGQRGPCGPCRRVAHGLFRRAIQQRPRGTLPMGLSGIFAPCEAATTSQTNPKILSTIRFHRIKFVHVVRTGTPVSNTTASARAMASLAAAVSVQPVAVKGLSGSSISGRKLAVASRPSSSARAACRSTRRAAVVAKYGDKSVYFDLEDIGNTTGQWDLYGSDAPSPYNPLQSKFFETFAAPFTKRGLLLKFLLLGGGSLLAYVSASASPDLLPIKKGPQQPPQPGPRGKI

SEQ ID NO: 21588 - DNA, 1377 bp, Sorghum bicolor
  misc_feature: Ceres ANNOT ID no. 8734048
  misc_feature: Down-regulated in shoot tissues in response to aminocyclopropane carboxylic treatment
  misc_feature: Down-regulated in shoot tissues in response to salicylic acid treatment
  misc_feature: Encodes the peptide sequence at SEQ ID NO 21589
atggatcccaaggcggcggcgaagtcgaagcgctcgcacacggtgcacggccgccgcgtccaccagacccccgccgccgcggcagcgcacaggcagaagcgtgccgccgccgccaacacctcgtccggcccccgcagccgcaacctcccctcgaactgggatcgctacgacgacgagggcgaggcggaggagtccgcggccgtcggggaatggacaggcgaggtggctccgcgcagcaagggtgccgacttcggattcctgctagagcaggcccgagcgcagccccccggggcccgggacctcagcgcgccgtgtctcccctcccaggacttgccatttgattttatgcaggcttctacctctatgttcgaagctaaaagtgaaggaatattgtcctggtgtgctgatgataactttattttagaggatgacctagcaccagattttgaggtgccttttctctccatggatttgaatgcattggccaatcacctttcaaagattaagctttctcggagactttttatagaagaagatctatttcctgaggatatggctgatgcaccagaagacagtgaaatagcgattgaacctgacacctctgtggaaattgatgctaaaggcagttcagttggacataacttgaactttgaacccaggaaagatacaagtcatcatgagtatggcagcaacatctgttctgatgatcaaatgcaaacacaaagccagtcgcaatgttttgcacaagaaactacaacatctctgaagattagtactcattcagtgaattcagatagtgaagaagataagagctgcaagcgaatcatggatactgatcctggtacgagccatggcaaagggttgaagtttgaggtgggtgctgcagaagaagaacttgacatgctcctcaattcatttagcggaactcacctttccagcgccaatttggacgaaccatttgaacacgcttcaactttgcaggaggtcagtttgtcgaatgagaaggttgaacctagcttgtcttccaaaccgcctttgcttgcacctctcgacgatgctctagatgacttgctttcagagagttcccttgatgtacagagtgaaggtttcgctatgcgaagtacaacttctcagcctactgctaattatggtcagaacattggcttcagatatgctaagaaaatggatgtgacgccatcaattgatgattcagtggatgatttgcttgaagacacttcatcatccttaaatgagccaaagcaaattacaactgcacaagtatcgaacagcaccccacttgatagtgcaccccttcatcctggtcccttaaatacatctgcgtcggatgattttgattcatggtttgattctctatag

SEQ ID NO: 21589 - protein, 458 aa, Sorghum bicolor
  misc_feature: Ceres ANNOT ID no. 8734048
  misc_feature: Down-regulated in shoot tissues in response to aminocyclopropane carboxylic treatment
  misc_feature: Down-regulated in shoot tissues in response to salicylic acid treatment
MDPKAAAKSKRSHTVHGRRVHQTPAAAAAHRQKRAAAANTSSGPRSRNLPSNWDRYDDEGEAEESAAVGEWTGEVAPRSKGADFGFLLEQARAQPPGARDLSAPCLPSQDLPFDFMQASTSMFEAKSEGILSWCADDNFILEDDLAPDFEVPFLSMDLNALANHLSKIKLSRRLFIEEDLFPEDMADAPEDSEIAIEPDTSVEIDAKGSSVGHNLNFEPRKDTSHHEYGSNICSDDQMQTQSQSQCFAQETTTSLKISTHSVNSDSEEDKSCKRIMDTDPGTSHGKGLKFEVGAAEEELDMLLNSFSGTHLSSANLDEPFEHASTLQEVSLSNEKVEPSLSSKPPLLAPLDDALDDLLSESSLDVQSEGFAMRSTTSQPTANYGQNIGFRYAKKMDVTPSIDDSVDDLLEDTSSSLNEPKQITTAQVSNSTPLDSAPLHPGPLNTSASDDFDSWFDSL

SEQ ID NO: 21590 - DNA, 798 bp, Sorghum bicolor
  misc_feature: Ceres ANNOT ID no. 8734076
  misc_feature: Down-regulated in shoot tissues in response to methyl jasmonate treatment
  misc_feature: Encodes the peptide sequence at SEQ ID NO 21591
atggcgagcagcaccatggctctctcctccacggccttcgccggcaaggccgtgaacgtgccgtcgtccctcttcggcgaggcccgcgtgacgatgcgcaagacggcggcgaaggccaagccggcggcggcgtccggcagcccgtggtacggccccgaccgcgtgctctacctgggcccgctctccggcgagcccccgagctacctgactggcgagttccccggcgactacggctgggacacggccgggctgtcggcggaccccgagacgttcgccaagaaccgggagctggaggtgatccactcccgctgggccatgctcggcgcgctcggctgcgtgttcccggagctgctcgcccgcaacggcgtcaagttcggcgaggccgtgtggttcaaggcgggttcgcagatcttcagcgagggcgggctggactacctgggcaacccgagcctgatccacgcgcagagcatcctcgccatctgggcctgccaggtcgtgctcatgggcgccgtcgaggggtaccgcatcgccggcggcccactcggcgaggtcgtcgacccgctctaccccggcggcagcttcgacccactcggcctcgccgacgaccccgaggccttcgccgagctcaaggtgaaggagctcaagaacggccgccttgccatgttctccatgttcggattcttcgtccaggccatcgtcaccggcaagggcccgctcgagaacctcgccgaccacctcgccgaccccgtcaacaacaacgcctgggcctacgccaccaacttcgtgcccggcaagtga

SEQ ID NO: 21591 - protein, 265 aa, Sorghum bicolor
  misc_feature: Ceres ANNOT ID no. 8734076
  misc_feature: Down-regulated in shoot tissues in response to methyl jasmonate treatment
  misc_feature (64)..(232): Pfam ID: Chloroa_b-bind Pfam Description: Chlorophyll A-B binding protein
MASSTMALSSTAFAGKAVNVPSSLFGEARVTMRKTAAKAKPAAASGSPWYGPDRVLYLGPLSGEPPSYLTGEFPGDYGWDTAGLSADPETFAKNRELEVIHSRWAMLGALGCVFPELLARNGVKFGEAVWFKAGSQIFSEGGLDYLGNPSLIHAQSILAIWACQVVLMGAVEGYRIAGGPLGEVVDPLYPGGSFDPLGLADDPEAFAELKVKELKNGRLAMFSMFGFFVQAIVTGKGPLENLADHLADPVNNNAWAYATNFVPGK

SEQ ID NO: 21592 - DNA, 2835 bp, Sorghum bicolor
  misc_feature: Ceres ANNOT ID no. 8734077
  misc_feature: Up-regulated in root tissues in response to methyl jasmonate treatment
  misc_feature: Up-regulated in shoot tissues in response to methyl jasmonate treatment
  misc_feature: Encodes the peptide sequence at SEQ ID NO 21593
atgagcggcggcggagccggagggaagggggcggcggcgcccgtcccgcccgggtcgaggaagctggtgcagagcctcaaggagatcgtgaaccgccccgaggcggagatctatgccgcactgcgcgagtgcggcatggaccccgacgaggcggtcagccggctcctctcccaaggagtaggacttacgaaccagatttggagcggatggctgtggcattcagagctcacattcaggcattcagagcaaatgcaaatgcaaaaacatacaccattcagaaataacattcaccattcagacattcagagtaatatcaggcattcacagggattcagagttcagatccagtggcaatcacagagttcagatcaggcattcctattcatcatccatgtattcaacttgaaaacagaggcttttgctggttctgcttattatgatactttccaagaggtaaagagcaagcgcgacaagaagaaagagattaaagaggttcctgagacaagatatcgatcggcaaatagttctactaatcgaggccttagaagtggtgcagatcgaggtggacggagcaattctgtgcactctagctctactgataacatgacctcaaggccaccagtctcagggtctggaacggcatcagttaattccagtcagaggcaaacaatggcaagttcctctgcaaacaaacatatggttactgatggaccagctgtatcattgcaatcatcgtctgggtttcagcatggtggttggtctgggacgcctggtcagttgtcgatggctgacattgtgaaaatgggtcggcctcagggcaaggcttccagcaaacctgtggtcacagctgacagaggttatgctggacagtacccatctttgccaagcacaaaccagaacctgaaacaatctgtaagcatggttcccccaacagagcttgacaaggggttacaacctgcccaagattcggttcaggttatgaatcacggtcattctgctgctgacagcaagctcccatatggtactgattggtctccacaagacgacccaacatctgcgaaccaatcatcccttcctgagacatctggtgatccgtccttgtatgaagcatcatttcagtcatctacattggttactgatgtagttaattcacatgaaaatttgcacttggatgaagacagcacctttgcaatgagaccagtacctgcctctgagatacacttggaacctagtgatggtatttctgaatacaatgatggaatgttgaacaactcaagttcctatcagcctcaaaattactcttacacagaacaagaagtcgaggattccagtgctgatctatcagcagcagcagcagcagcaaacttccagagtttaagcctgcataatgacgagttagccgcaaaaaagactgccgaagataaccctgcagtgataattcctgatcatttgcaagttacaaatacagaatgtgtcagtttgagctttggcagttttggatctggtgcgttttctgggctactcccacaaaagaccatggatagcaatgtggaattccctgcccgagaggaatctgcaccggtagatcaaatagacgccaggaatcaagattactatgaaagtggtgcagtaacttcaccagtggacgaaaatcttgaggccatgctgggagccaacatagagaatgtcgatgcgccttctgtttcacagcctaatgagcttaggcaggacgtacttgatccttctggacttcaatatgacgtgccatcagtttcaagtcatgcttattcaaacacgaacgcttcacagcctagcacaatggaggatccacaaggaaacaaccaagcacatactttttcccatttgtcaaacttgatgcaagcaaatcctttgagcaccagcagcctattggggtcaaatcaaaatcatgcagctcttcatggcttagagtttgatttaccgccttatctggaagcaaaatataacacaggctcgactacaaatcctagaccagccatatccatgcaggaggccctgaaagcaggggttttctccaatgctcagtctacacagagtcttccaagtaccagcattccaacagggcctcctctccctcagcaattagcacatcacccttactctcagccaactttaccaattacacattttccaaatatggttggctatccgacgtatttgccacaaaactatgctacttacctatcttcaggcaccttccagcaagcatacccgagtaatggaccattccatcagtctgctgctgctttgctcggatctggtatgaagtactcgaccccagagtataagaacaacctgtctgccacaggcttacaacagcaacatcagccgcaaccacaaccaccttcatcagtcatctctggttatggaggcttcggaagctcaggcaacatacaaggaaattttacccttaatcagagtactggctctgcatcaactcttggttttgacgaagcattgagcagacagtacaaagacaccagtcaatacatggctctccagcagggtgacaactccggaatgtggcttcatggctcgggttctagagcgacctcgactcttccacctaaccacttttatggttaccagggacagagtcagctgggtggcttccgtcaggcgcagcagccacagccttcccaatttggaggccatgggtatccaacattctaccagtctcagggtggcctgacgcaggagcacccccagaaccttgctgagggcagcctgaatggcttccaggtcgcaccgtctcagccatctcatccgaactggcagcatcagcacacttactga

SEQ ID NO: 21593 - protein, 944 aa, Sorghum bicolor
  misc_feature: Ceres ANNOT ID no. 8734077
  misc_feature: Up-regulated in root tissues in response to methyl jasmonate treatment
  misc_feature: Up-regulated in shoot tissues in response to methyl jasmonate treatment
MSGGGAGGKGAAAPVPPGSRKLVQSLKEIVNRPEAEIYAALRECGMDPDEAVSRLLSQGVGLTNQIWSGWLWHSELTFRHSEQMQMQKHTPFRNNIHHSDIQSNIRHSQGFRVQIQWQSQSSDQAFLFIIHVFNLKTEAFAGSAYYDTFQEVKSKRDKKKEIKEVPETRYRSANSSTNRGLRSGADRGGRSNSVHSSSTDNMTSRPPVSGSGTASVNSSQRQTMASSSANKHMVTDGPAVSLQSSSGFQHGGWSGTPGQLSMADIVKMGRPQGKASSKPVVTADRGYAGQYPSLPSTNQNLKQSVSMVPPTELDKGLQPAQDSVQVMNHGHSAADSKLPYGTDWSPQDDPTSANQSSLPETSGDPSLYEASFQSSTLVTDVVNSHENLHLDEDSTFAMRPVPASEIHLEPSDGISEYNDGMLNNSSSYQPQNYSYTEQEVEDSSADLSAAAAAANFQSLSLHNDELAAKKTAEDNPAVIIPDHLQVTNTECVSLSFGSFGSGAFSGLLPQKTMDSNVEFPAREESAPVDQIDARNQDYYESGAVTSPVDENLEAMLGANIENVDAPSVSQPNELRQDVLDPSGLQYDVPSVSSHAYSNTNASQPSTMEDPQGNNQAHTFSHLSNLMQANPLSTSSLLGSNQNHAALHGLEFDLPPYLEAKYNTGSTTNPRPAISMQEALKAGVFSNAQSTQSLPSTSIPTGPPLPQQLAHHPYSQPTLPITHFPNMVGYPTYLPQNYATYLSSGTFQQAYPSNGPFHQSAAALLGSGMKYSTPEYKNNLSATGLQQQHQPQPQPPSSVISGYGGFGSSGNIQGNFTLNQSTGSASTLGFDEALSRQYKDTSQYMALQQGDNSGMWLHGSGSRATSTLPPNHFYGYQGQSQLGGFRQAQQPQPSQFGGHGYPTFYQSQGGLTQEHPQNLAEGSLNGFQVAPSQPSHPNWQHQHTY

SEQ ID NO: 21594 - DNA, 1764 bp, Sorghum bicolor
  misc_feature: Ceres ANNOT ID no. 8734154
  misc_feature: Down-regulated in shoot tissues in response to methyl jasmonate treatment
  misc_feature: Down-regulated in root tissues in response to methyl jasmonate treatment
  misc_feature: Down-regulated in shoot tissues in response to salicylic acid treatment
  misc_feature: Encodes the peptide sequence at SEQ ID NO 21595
atggcggcctccaccctcgcgttcggccaccccaaaaccctaggcgccgccgccgcatccgccggtgcgaaggccctcccgacctcctcgtccgtctccttcccggccacccagcagcccgcgtgccacctctcctcgtccgcgtccgcgtccgcgcacggggcccgccgccgggacgtcgccgccatggtctacgcgccgccggccgtcggcaccgccatgccgtcgctcgacttcgacacctccgtcttcaacaaggagaaggtctccctcgccggccacgaggagtacatcgtgcgcggcgggaggaacctgttcccgctgctcccggaggcgttcaagggggtcaagcagatcggagtcattggatggggctcgcagggacctgcccaagctcagaacctgagagattcactggctgaagcaaagtcagacattgttgtgaagattggtctacggaaaggatccaaatcttttgaggaagcacgtgctgctggattcaccgaagagagtggaaccttgggcgatatttgggaaactgtctccgacagcgatcttgtgttgctgctgatttctgatgctgcacaggctgacaactatgagaagatcttctctcacatgaaaccaaacagtatccttggtttatctcatggatttcttctgggacatttgcaatcacttggacttgatttcccaaagaacatcagtgtgattgctgtatgccccaagggaatgggtccatctgtccgcaggctttatgttcagggcaaggaagtcaatggtgctggcatcaactctagctttgctgtgcaccaggatgttgatggaagggcaactgatgttgctctagcatggtcagttgcacttggctccccctttacatttgctactactttagaacaggagtacaagagtgatatctttggagagcgaggcattttgctgggtgcggtccatggtatcgtggaggctctgtttaggagatacacagagcaaggaatggatgaagagtcagcctacaaaaacactgttgagggcataactgggatcatctcgaaaaccatctcaaagaaggggatgcttgaagtgtacaactcattgagtgaggaaggcaaaaaggagttcaacaaggcttacagtgcatcgttttacccgtgcatggatatactctacgaatgctatgaagatgtggcctctggaagtgaaatccggagtgtggtgttggctgggcggaggttttacgaaaaagagggcctcccagcttttccaatgggcaacattgaccaaactcgcatgtggaaggttggtgaaaaggtgcgcgcaacccgtccagaaggtgatcttggcccgctccatgccttcactgctggagtgtacattgccttgatgatggcgcagattgagatcttgaggaagaaggggcactcctactctgagatcatcaacgagagcgtgatcgagtcagtggactcgctgaacccgttcatgcacgcccgtggggtcgccttcatggtggacaactgctccacgacggctcgcctgggatccaggaagtgggcaccacgcttcgactacatcctgacgcagcaggccttcgtgacggtggacaaggacgcccccatcaaccaggacctcatcagcaacttcttgtcagaccctgtccatggcgccatcgaggtctgcgcggagctgaggcccaccgtcgacatctccgtgactgccaacgccgactttgtgcgcccagagctccgacaatcttcctag

SEQ ID NO: 21595 - protein, 587 aa, Sorghum bicolor
  misc_feature: Ceres ANNOT ID no. 8734154
  misc_feature: Down-regulated in shoot tissues in response to methyl jasmonate treatment
  misc_feature: Down-regulated in root tissues in response to methyl jasmonate treatment
  misc_feature: Down-regulated in shoot tissues in response to salicylic acid treatment
  misc_feature (53)..(587): SWISSPROT Homolog: EC 1.1.1.86 Ketol-acid reductoisomerase
  misc_feature (299)..(584): Pfam ID: IlvC Pfam Description: Acetohydroxy acid isomeroreductase, catalytic domain
  misc_feature (112)..(295): Pfam ID: IlvN Pfam Description: Acetohydroxy acid isomeroreductase, catalytic domain
MAASTLAFGHPKTLGAAAASAGAKALPTSSSVSFPATQQPACHLSSSASASAHGARRRDVAAMVYAPPAVGTAMPSLDFDTSVFNKEKVSLAGHEEYIVRGGRNLFPLLPEAFKGVKQIGVIGWGSQGPAQAQNLRDSLAEAKSDIVVKIGLRKGSKSFEEARAAGFTEESGTLGDIWETVSDSDLVLLLISDAAQADNYEKIFSHMKPNSILGLSHGFLLGHLQSLGLDFPKNISVIAVCPKGMGPSVRRLYVQGKEVNGAGINSSFAVHQDVDGRATDVALAWSVALGSPFTFATTLEQEYKSDIFGERGILLGAVHGIVEALFRRYTEQGMDEESAYKNTVEGITGIISKTISKKGMLEVYNSLSEEGKKEFNKAYSASFYPCMDILYECYEDVASGSEIRSVVLAGRRFYEKEGLPAFPMGNIDQTRMWKVGEKVRATRPEGDLGPLHAFTAGVYIALMMAQIEILRKKGHSYSEIINESVIESVDSLNPFMHARGVAFMVDNCSTTARLGSRKWAPRFDYILTQQAFVTVDKDAPINQDLISNFLSDPVHGAIEVCAELRPTVDISVTANADFVRPELRQSS

SEQ ID NO: 21596 - DNA, 2586 bp, Sorghum bicolor
  misc_feature: Ceres ANNOT ID no. 8734170
  misc_feature: Down-regulated in root tissues in response to salicylic acid treatment
  misc_feature: Encodes the peptide sequence at SEQ ID NO 21597
atgccgccgctgaccactaagcccgcactcaatccagtcctcctcccactcgcctcccttggcttgccgcgtgccctcccgccgatcggcctccacgcggagaagcgcctacgccgtctcagctcggccgcggtctcggcggcggcgtccacgtcctcctccgcggacccgagcgcggagctgcgagcgctctgctcccatggccagctcgcgcaggcgctctggctcctcgagtcctcggcggagccgcccgacgaggacgcctacgtcgcgctgttccgcctctgcgagtggcgccgcgcggtggaaccggggctgcgcgcgtgtgcgcacgcggacgaccggcacgcgtggttcgggctccgcctcgggaacgccatgctcagcatgctcgtcaggttcggggagacgtggcacgcgtggagggtgttcgccaagatgcccgagcgggacgtcttctcctggaacgtcatggtgggcgggtacgggaaggccgggttgctggaagaggcgctggacctgtaccacaggatgatgtgggcaggtgtgaggccggacgtgtacacgttcccctgcgtgctgcggagctgtgggggcgtcccagactggaggatggggagggaggtgcatgcacatgttcttcggtttgggtttgcggaggaggtcgatgtcctgaatgcactcatgaccatgtacgccaagtgtggggacgttgtggctgctcgcaaggtgtttgacagtatggccgtgatggactgtatctcatggaacgccatgattgctggtcattttgagaatggtgagtgcaatgcggggttggagttgtttcttaccatgctgcaggatgaggttcagcctaacctcatgacaataaccagtgtgactgttgcatcaggcttgttatctgacataacttttgcaaaggaaatgcatgggcttgcagtgaagaggggttttgccactgatgttgcattctgtaactctttgattcagatgtatgcaagtcttggtatgatggggcaagcaagaacagtgttctcaagaatggatactagagatgccatgtcatggacagctatgatatctgggtatgagaaaaacggcttcccagataaagctcttgaagtgtatgcacttatggaagtgaacaatgtaagtcctgatgatattactattgcaagtgcccttgctgcttgtgcttgcttggggagtttagatgttggcgtcaagttgcatgagcttgctgagagcaagggattcatgagctacgtcgtagttacaaacgcactccttgaaatgtatgcgaagtccaagcgtattgataaggctattgaagtttttaagtgcatgcctgagaaggacgtagtatcgtggagttcaatgatcgcaggattttgcttcaaccataggaactttgaggctctttactatttcaggcatatgctggcagatgtaaagcctaattctgtcacttttattgctgctcttgctgcttgtgctgctactggggctttgaggagtggtaaggagatccatgcacatgttttaaggtgtggtattgcatatgaaggttatttgcccaatgcccttatcgacttgtatgtcaaatgtggccagacgggctatgcttgggcacagttctgtgcacacggtgcaaaggatgttgtgtcgtggaatatcatgattgcaggttttgttgctcatggtaatggggaaacagctttatcgttcttcaatcaaatggtgaaaataggagaatgcccagacgaagttacgtttgttgctctgctatgtgcgtgtagtaggggtggaatggtcagcgaaggttgggagctttttcacagcatgactgataaatactctattgttccaaatctcaagcactatgcatgcatggtggatcttctaagtcgtgttgggcaactgacagaagcttacaacttcataaatgaaatgcctatcacaccagatgctgctgtttggggagccttgctaaatggatgccggatacaccggcatgtcgaacttggggagcttgctgcaaaatatgttcttgaattggagcctaatgatgctggatatcatgttcttttgtgtgatctgtatgctgatgctggtatatgggataaattggctagggtgaggaaaaccatgcgggagaaaggattggatcatgattctggatgtagctgggttgaggttaaaggagtagtccatgcatttcttacggatgatgaatcgcatccacagatcagagaaataaatactgttctagaaggaatatatgagcggatgaaagcatctggatgtgctcctgtcgaatctcattctccagaagataaagtattgaaggatgacatcttttgtggtcacagcgaaagacttgctgttgcttttggtttgatcaataccacacctggcacctcaatttctgtcaccaaaaaccagtacacatgtcagagttgtcacaggatattgaagatgatttcttacatagtacgaagagatataattgttagggacagtaagcaagtccaccattttaaggatggaagttgctcgtgtggagatgaaggtttggggtga

SEQ ID NO: 21597 - protein, 861 aa, Sorghum bicolor
  misc_feature: Ceres ANNOT ID no. 8734170
  misc_feature: Down-regulated in root tissues in response to salicylic acid treatment
  misc_feature (153)..(187): Pfam ID: PPR Pfam Description: PPR repeat
  misc_feature (355)..(389): Pfam ID: PPR Pfam Description: PPR repeat
  misc_feature (556)..(590): Pfam ID: PPR Pfam Description: PPR repeat
  misc_feature (254)..(288): Pfam ID: PPR Pfam Description: PPR repeat
MPPLTTKPALNPVLLPLASLGLPRALPPIGLHAEKRLRRLSSAAVSAAASTSSSADPSAELRALCSHGQLAQALWLLESSAEPPDEDAYVALFRLCEWRRAVEPGLRACAHADDRHAWFGLRLGNAMLSMLVRFGETWHAWRVFAKMPERDVFSWNVMVGGYGKAGLLEEALDLYHRMMWAGVRPDVYTFPCVLRSCGGVPDWRMGREVHAHVLRFGFAEEVDVLNALMTMYAKCGDVVAARKVFDSMAVMDCISWNAMIAGHFENGECNAGLELFLTMLQDEVQPNLMTITSVTVASGLLSDITFAKEMHGLAVKRGFATDVAFCNSLIQMYASLGMMGQARTVFSRMDTRDAMSWTAMISGYEKNGFPDKALEVYALMEVNNVSPDDITIASALAACACLGSLDVGVKLHELAESKGFMSYVVVTNALLEMYAKSKRIDKAIEVFKCMPEKDVVSWSSMIAGFCFNHRNFEALYYFRHMLADVKPNSVTFIAALAACAATGALRSGKEIHAHVLRCGIAYEGYLPNALIDLYVKCGQTGYAWAQFCAHGAKDVVSWNIMIAGFVAHGNGETALSFFNQMVKIGECPDEVTFVALLCACSRGGMVSEGWELFHSMTDKYSIVPNLKHYACMVDLLSRVGQLTEAYNFINEMPITPDAAVWGALLNGCRIHRHVELGELAAKYVLELEPNDAGYHVLLCDLYADAGIWDKLARVRKTMREKGLDHDSGCSWVEVKGVVHAFLTDDESHPQIREINTVLEGIYERMKASGCAPVESHSPEDKVLKDDIFCGHSERLAVAFGLINTTPGTSISVTKNQYTCQSCHRILKMISYIVRRDIIVRDSKQVHHFKDGSCSCGDEGLG

SEQ ID NO: 21598 - DNA, 957 bp, Sorghum bicolor
  misc_feature: Ceres ANNOT ID no. 8734176
  misc_feature: Up-regulated in shoot tissues in response to methyl jasmonate treatment
  misc_feature: Up-regulated in root tissues in response to methyl jasmonate treatment
  misc_feature: Up-regulated in root tissues in response to salicylic acid treatment
  misc_feature: Up-regulated in shoot tissues in response to salicylic acid treatment
  misc_feature: Encodes the peptide sequence at SEQ ID NO 21599
atgggcggcaaggcgaagcggctcccccaaatcgacttctcccgcgttgtcccgtccgcgccgggcggcaaggcctggtcggatgtgcgcggcgaggtgatgaaggcgctgtccactttcggctgcttcgaagcgcagtacccggctctgacccctcagctccgcgccgagctcttcgacggcgccgtgaggccgctcttcgcgctgcccgccgacgccaagcgccgcaactactacggcgccgacaggccgttccacggctacctcggtgacatcccggggttccctggctacgagagcctcgccatcgtggacgccaccaaggacgactccgtccgtgacttcgccggcctcatgtggcctgacgccggcgacaacaacgacggcttctgcggcactgtcggtgaggcggcgcggcggatctttgaggtggaggaggccgtgcggcggatggtgatggaagggctcgggatggccaagcaccacgacgcgctgagcgcgtccatgtggcacctgttccggatggcggagtacaaggcgcccaacgccgcggagaaggtggtcaggtacggggcgcaccaggacaccaactggctcagcgtcgtctgccagcacgaggtggccgggctggagatgcagagcagggacggcgactggatcgtcgtcgagccgtcgcccacgtcgctggttttcatggtcggcaacgccctccgggcatggacaaacgaccgtctatacgctccattccaccggattactgtcgccggtgatgtcgccagatactcagcgatgctgttctcggtccccagctacaaggttcaggtggcagatgagcttgtggacgacgaacaccctccccgtttcaagccccatgacaacaacgacttcgtctgcttctgtgtttccgaagaaggcgctcgccaccaagacaaactcaaggccttctgtggagtgtaa

SEQ ID NO: 21599 - protein, 318 aa, Sorghum bicolor
  misc_feature: Ceres ANNOT ID no. 8734176
  misc_feature: Up-regulated in shoot tissues in response to methyl jasmonate treatment
  misc_feature: Up-regulated in root tissues in response to methyl jasmonate treatment
  misc_feature: Up-regulated in root tissues in response to salicylic acid treatment
  misc_feature: Up-regulated in shoot tissues in response to salicylic acid treatment
  misc_feature (191)..(304): SWISSPROT Homolog: EC 1.14.11.11 Hyoscyamine (6S)-dioxygenase
  misc_feature (169)..(269): Pfam ID: 2OG-FeII_Oxy Pfam Description: 2OG-Fe(II) oxygenase superfamily
MGGKAKRLPQIDFSRVVPSAPGGKAWSDVRGEVMKALSTFGCFEAQYPALTPQLRAELFDGAVRPLFALPADAKRRNYYGADRPFHGYLGDIPGFPGYESLAIVDATKDDSVRDFAGLMWPDAGDNNDGFCGTVGEAARRIFEVEEAVRRMVMEGLGMAKHHDALSASMWHLFRMAEYKAPNAAEKVVRYGAHQDTNWLSVVCQHEVAGLEMQSRDGDWIVVEPSPTSLVFMVGNALRAWTNDRLYAPFHRITVAGDVARYSAMLFSVPSYKVQVADELVDDEHPPRFKPHDNNDFVCFCVSEEGARHQDKLKAFCGV

SEQ ID NO: 21600 - DNA, 1965 bp, Sorghum bicolor
  misc_feature: Ceres ANNOT ID no. 8734277
  misc_feature: Up-regulated in root tissues in response to salicylic acid treatment
  misc_feature: Encodes the peptide sequence at SEQ ID NO 21601
atggacagggcctccctaaaccttggatctggtggtaacattaactccttgaacgatccttgtcactggagcacagttcagcaagcagttgagtacaaaggtactgccattggcacactagtgtattccaacttctctagggacaatctgagagcactgaaaaggaagtgggttgatatggctggagtggaaggtcctgaaaatccactgctcacccttggtctgggccgttcaccaagttcctccgaaaatagcaaggttagctcccccacagcttgtatgatgtctccatcttcagtgaaagagactgatgaggagtcatcgatggatcttggtctcaactttgatctttgtcttggtcatgatactgcacatcatcacaagaagccatgtgctgagcatgtgccatcagcaggtgctccgaaattggatcttcagttgagtttgtccacttgtattcctgaatcagctgtgaccaatgcaagtactgcatcaataaatgttaatgatggcttagagacagtggtgcctaatttggtgacagatgctattggggaaaaactagagccctcctctagttggattttcaggcattacatggcttcatcatcatatgcttctgaagcaacctacaacttttcattgccaaagatacccgaaaaggttgatgatgctgtgccttctccagatgtctcatcagccattacagtgagtgtgaaaagcccggctgcctgtacttctggggcaactaactcccagaaacggagcattaacactaaatgctgccagttcccaggatgtgagaaaggagcaagaggagcctctggttattgtatttcccatggaggtggtaggcgatgccagaaacctggttgccagaagggagctgagggaaggaccatctactgcaaagcccatggtggtggtaggcgatgccagtatcttggctgtacgaagagtgctgaaggccgcactgaccactgcatagcccatggtggcggtcgccgttgtagtcaggaaggctgttcacgcgccgcacgtggaaagtctggcctgtgcatcaagcatggaggcggcaagaggtgccagagggagaactgcaaaagaagtgcagaaggatattctggcctctgcatctctcatggtggtggaaggcgctgtcagtttccggattgtacaaagggtgcccagggaagcacaaagttctgcaaggcacatggtgggggaaagcgctgcacgttccctggctgtaccaaaggagctgaaggtagcacttctctctgcaaggggcacggtggaggtaagcgctgcgcctaccagggtggcggtgtgtgcccaaagagtgtccatggtgggacgcagtactgtgttgctcacggtggtgggaagaggtgcttagtctcaggctgtaccaagagtgccagagggaggacagaatactgtgtccgccacggcggtggcaagaggtgcaagtttgagggctgtgccaagagtgcgcaggggagcactgatttctgcaaggcccatggtggaggcaaacgctgctcatggggccaggagggctcaagctttggggtcggtgggccgccgtgtgacaagtttgctcgtagcaagattggtctttgtgcaggtcacagcgctttggttgaggatcactgcgtccacggtggtggctcgttaggtcctgcgatcagacagttgacagctgattgcaaccctgatgagattcaagccgctgcaatgaaggatgatgctgatatggcgaatggagaagacgaagctttcctgggatggaacgatgatgatgacaacgtcgaggcgcagcccagcgcacctccgctcccagagggcagggtccatggcagtgggctgctagctctgctctcgggtagaggccatgttagtgccgccagctgctctgacaatggcgcctcgacttcgtctgccatgcgcacctggatgtga

SEQ ID NO: 21601 - protein, 654 aa, Sorghum bicolor
  misc_feature: Ceres ANNOT ID no. 8734277
  misc_feature: Up-regulated in root tissues in response to salicylic acid treatment
MDRASLNLGSGGNINSLNDPCHWSTVQQAVEYKGTAIGTLVYSNFSRDNLRALKRKWVDMAGVEGPENPLLTLGLGRSPSSSENSKVSSPTACMMSPSSVKETDEESSMDLGLNFDLCLGHDTAHHHKKPCAEHVPSAGAPKLDLQLSLSTCIPESAVTNASTASINVNDGLETVVPNLVTDAIGEKLEPSSSWIFRHYMASSSYASEATYNFSLPKIPEKVDDAVPSPDVSSAITVSVKSPAACTSGATNSQKRSINTKCCQFPGCEKGARGASGYCISHGGGRRCQKPGCQKGAEGRTIYCKAHGGGRRCQYLGCTKSAEGRTDHCIAHGGGRRCSQEGCSRAARGKSGLCIKHGGGKRCQRENCKRSAEGYSGLCISHGGGRRCQFPDCTKGAQGSTKFCKAHGGGKRCTFPGCTKGAEGSTSLCKGHGGGKRCAYQGGGVCPKSVHGGTQYCVAHGGGKRCLVSGCTKSARGRTEYCVRHGGGKRCKFEGCAKSAQGSTDFCKAHGGGKRCSWGQEGSSFGVGGPPCDKFARSKIGLCAGHSALVEDHCVHGGGSLGPAIRQLTADCNPDEIQAAAMKDDADMANGEDEAFLGWNDDDDNVEAQPSAPPLPEGRVHGSGLLALLSGRGHVSAASCSDNGASTSSAMRTWM

SEQ ID NO: 21602 - DNA, 876 bp, Sorghum bicolor
  misc_feature: Ceres ANNOT ID no. 8734380
  misc_feature: Down-regulated in root tissues in response to salicylic acid treatment
  misc_feature: Down-regulated in shoot tissues in response to salicylic acid treatment
  misc_feature: Encodes the peptide sequence at SEQ ID NO 21603
atgaagacacggcccaataacgcggttctctcgagagctatgcgctcgaggaagagcgtggtggccgtgatcgttgagaggtcaccatccccacccgacactgaaccagtcatgtcgtatggcagtggcttcatcatcaaggatgggcctccaacctcacttgttctcacgtgtcagcatgtggtggtagatgccgtgtccgtgcgcataaggagggtggtggtgggagtcggagtggaagaatttgaagctacagtgatcaatggcaatagcggcacagacgttgctgttctccgcgttcgagggctgaggagtgagcgcgctttctctctcgcgctaagcttcacatctccacttcaagtcaacgagcctgcagttacaattggatactgcaacccggaaaatttgttggatgaaatctctctcgcagggcttccagccacttcacctggatgtatccgggaggctcctgatgatttcctcgaggcgttaagggaggaggatggcaaacgaatgctcggaaaaggaccaggtggtgtagtgcacgaactgattcttctgaactgcgttagcatgagtggcgtgtcaggtggaccagttgttgataggcacggcgtcgttgggatggctaaaatggtgggggcccgctactatggaggaggtggtctctcgcttgggacgcctgtgatctgcctgccacccccaacaacaaccccttttctgctaagtccagcagtgataaatgtttccttcccccaacagcccgaaacactcaccactctggccaccattgttgctgcttcatgtgcttcgtcgattaaaatcgactttgatttcatcagtcgattgaagaaaaggatttccgtctttaattaa

SEQ ID NO: 21603 - protein, 291 aa, Sorghum bicolor
  misc_feature: Ceres ANNOT ID no. 8734380
  misc_feature: Down-regulated in root tissues in response to salicylic acid treatment
  misc_feature: Down-regulated in shoot tissues in response to salicylic acid treatment
MKTRPNNAVLSRAMRSRKSVVAVIVERSPSPPDTEPVMSYGSGFIIKDGPPTSLVLTCQHVVVDAVSVRIRRVVVGVGVEEFEATVINGNSGTDVAVLRVRGLRSERAFSLALSFTSPLQVNEPAVTIGYCNPENLLDEISLAGLPATSPGCIREAPDDFLEALREEDGKRMLGKGPGGVVHELILLNCVSMSGVSGGPVVDRHGVVGMAKMVGARYYGGGGLSLGTPVICLPPPTTTPFLLSPAVINVSFPQQPETLTTLATIVAASCASSIKIDFDFISRLKKRISVFN

SEQ ID NO: 21604 - DNA, 1722 bp, Sorghum bicolor
  misc_feature: Ceres ANNOT ID no. 8734412
  misc_feature: Up-regulated in root tissues in response to salicylic acid treatment
  misc_feature: Encodes the peptide sequence at SEQ ID NO 21605
atgccgggccgctcggtggtctccatcctcctccttgtcctccatggcctcctctgcctgcagctgctggttgccttgcccgagatggagatggaggacggccgcgtcatggaggagggcagctgcatgcatttcagtgtctccccgccgcctgctccgcccgaggacgcggaggagcggcgcgaatatttccgcgccatggcggccaaggatctgttccggcacgagcagctcatcgcgatgatgggcagcggcgacgaccggcggcggaacggcagcagcagcagcagccggaggcggcaggcgaaggaggagtcgtcgtcgtcgtcgtcgtccaaggtgccaaagctgatgtccaccacgtccacgttcgagctgccgatgcggagcgcgctcaacacagcgcacgtgggcatgtacctggtgtcggtgcgcttcggcacgccggcgctgccgtacaacctggtgctggacaccgccaacgacctgacgtggatcaactgccggctgcggcgacgcaagggcaagcactacgggcggcagtcgtccaagacgatgtcggtgggcggggatgacgacgtggtggcggcgctggcgaagaaggaggcgagaaagaactggtaccggccggccaagtcgtcgtcgtggcgccggatccggtgctcggagcagcagtgcgcgcacctgccgtacaacacgtgccagagccccagcaagctggagtcgtgcagctactaccaaaagacgcaggacgggacggtgacgatcggcatctacggcaacgagaaggcgacggtgacggtgtccgacgggcggatggccaagcttccgggcctcgtgctgggctgctccgtcctggaggctggcgccagcgtggacgcccacgacggcgtgctctcgctgggcaacggccatatgtcgttcgccatccacgccgtgctgcgcttcgggggacgcttctccttctgcctcctcagcgccaacagctcccgcgacgcctccagctacctcaccttcggtcccaacccggcggtgatggggccgggcaccatggagacggagatcctttacaacgtcgacgtgaaggcggcgtacgggccccgggtgacggccgtcttggtgggcggcgagcgcctggacatccccgacgacgtctggaacatcgacaaggggctcggctccggcgtcatcctggacaccagcacgtcggtgacgtcgctggtgccggaggcgtacgagccgctagtggccgcactcgacaggcacctggcacacctgccccgggagagttttgcaggcttcgagtactgctacaggtggaccttcaccggcgacggcgtcgacccggcgcacaacgtcaccatacccaaggtgacggtggagatgaccggcggcgccaggctggagccggaagccaagagcgtggtcatgccggaggtggggcacggggtggcgtgcctcgccttcaggaagctgccctggggaggaggaccctgcatcatcggcaacgtgctcatgcaggagtacatctgggagatcgaccactcaaaggccacgttcaggttcaggaaggacaagtgcaacacacgtcatctacacaccagcaccggaggagaagtcaccaacaatggcagcagcggtggaaataatcagcaggccaatggcggcaccagcagcgatgccccctcctcctcctccaccgtcgtgcatagcgtcaattga

SEQ ID NO: 21605 - protein, 573 aa, Sorghum bicolor
  misc_feature: Ceres ANNOT ID no. 8734412
  misc_feature: Up-regulated in root tissues in response to salicylic acid treatment
  misc_feature (208)..(520): SWISSPROT Homolog: EC 3.4.23.12 Nepenthesin
MPGRSVVSILLLVLHGLLCLQLLVALPEMEMEDGRVMEEGSCMHFSVSPPPAPPEDAEERREYFRAMAAKDLFRHEQLIAMMGSGDDRRRNGSSSSSRRRQAKEESSSSSSSKVPKLMSTTSTFELPMRSALNTAHVGMYLVSVRFGTPALPYNLVLDTANDLTWINCRLRRRKGKHYGRQSSKTMSVGGDDDVVAALAKKEARKNWYRPAKSSSWRRIRCSEQQCAHLPYNTCQSPSKLESCSYYQKTQDGTVTIGIYGNEKATVTVSDGRMAKLPGLVLGCSVLEAGASVDAHDGVLSLGNGHMSFAIHAVLRFGGRFSFCLLSANSSRDASSYLTFGPNPAVMGPGTMETEILYNVDVKAAYGPRVTAVLVGGERLDIPDDVWNIDKGLGSGVILDTSTSVTSLVPEAYEPLVAALDRHLAHLPRESFAGFEYCYRWTFTGDGVDPAHNVTIPKVTVEMTGGARLEPEAKSVVMPEVGHGVACLAFRKLPWGGGPCIIGNVLMQEYIWEIDHSKATFRFRKDKCNTRHLHTSTGGEVTNNGSSGGNNQQANGGTSSDAPSSSSTVVHSVN

SEQ ID NO: 21606 - DNA, 2469 bp, Sorghum bicolor
  misc_feature: Ceres ANNOT ID no. 8734458
  misc_feature: Up-regulated in root tissues in response to methyl jasmonate treatment
  misc_feature: Up-regulated in shoot tissues in response to methyl jasmonate treatment
  misc_feature: Encodes the peptide sequence at SEQ ID NO 21607
atggccgcaaataacaacccgtggaggggccctttgccaccactgctcaatgctcgtgctggttttggtgatacaagcctcttctcaagctcactgccggttctttctcacgaaaagttgatcttttctgattctgctcatggtaccccatcaatggatgacacttcggccaaaatgaaattgcttgctgatgatcctgatgagaaggactacaagtttgattttgatcttcgacagatagatgacttgttgcctgatgaagatgagtttttcgcggggatcacagatgagactgagcctgttgggcagacaaataccacagaggaattggaggagtttgatgtctttggcaatggagggggcatggagctggacattgaccctgtggagagcatcacagttggttttgcaaattcaagtattgttgacggggctagaggcaatggcatcaacccttttggtgtcccaagcacagtaggaactgtggctggggagcatccatttggagagcacccttccaggaccttgtttgtaaggaacatcaatagtaatgtcgaggactccgagctgcgatctttgtttgagcaatatggggacatccggaccctttacactgcaacaaagcacaggggctttgtaatgatttcttatttcgatatcagagctgcacggaatgcaatgcgagcattgcagaacaaacctctgaggagaagaaagctggacattcatttttccatcccaaaggagaatccatctgacaaagatttaaaccagggaactcttgttatttttaacttggatccatcagtttctaatgaagaggttcgccagatttttggggcatatggggaagtaaaggagataagagagacaccaaacaagaaacatcataagtttatagagttctatgatgtaagagcagcagaggctgcacttcggtcactgaataaaagtgagatagctggaaagcggatcaagttggaaccaagtcgtcctggtggaacacgcagaaacttcatgcagcagcttggtcatgatttggaccaagaggagcccagaagctacagacattctcatgttggttcacctgttgctaactctcctccaggggcatgggcctatagtagtccaacagataacaatatgctgcaagctttcacaagatctccaacaggaaatggaatgagccctatcggaatgccttcactgatttcaaatgctccaaagattgctcctattggcaaggatagcaattggtctaaatatgatcaagtcttctcaaatggtaaccagtcccagggagctgcatttcagcactcccactcataccaagatcacaacagtgaatacatgagttctagtcctgggactttatcagggccccagtttctctggggcagtccaaagccatattcagaacattcaaaatcccctatttggcgtccaccagcaattggacctgcattgtcatccagcagtcgcactcagggccaaggattcttgtacagtagccgtcaggcttcattatttggttcttcagatcagcaccatcatcatgttggctctgccccttcaggtgctccattcgagagccattttggcttcttacctgaatcgccagagacatcttttatgaagcaagtcaggtttgggaacatgggtaatgttggtactggccgaaatgggggagccctcatgctgggcatggctggtcgtgcttctgtgaatcctggttcttctctaattggaagtctgacagataacagctctactaacttcagaccgatattgtcaccgagattgggacaggctttttacactaatcctccataccatgggcctggtacattcggacttgacaactccattgaccgtgcccgtaaccgccgagttgacagtagtgtgctgcaagctgatagcaagaggcagtatcagcttgacttggagaagattcgcagaagtgatgatactcggacaacattgatgattaagaacatcccgaacaaatatacatctaagatgctcctggctgcaattgatgagtttcataaaggaacttatgacttcttctacctgccaattgatttcaagaacaaatgcaatgtcggatatgcattcattaacatgatatcacctgtgcacattatatccttttaccaggcttttaatggtaagaaatgggagaagttcaacagcgagaaagtagcctcgctggcttatgctagaattcaaggacggtctgcactgatatcacattttcaaaattcaagtttgatgaatgaggataagaggtgccgccccattctttttaatcccaatggccaggactctgtgaatcaggaagcatttccaatcaatggcatatgcatccacatgcctctggaagatgattgccttgacaatgaagaagacaagaaccagaatgagaagacaggagagagctccaccgatatcggtgggagtttgtga

SEQ ID NO: 21607 - protein, 822 aa, Sorghum bicolor
  misc_feature: Ceres ANNOT ID no. 8734458
  misc_feature: Up-regulated in root tissues in response to methyl jasmonate treatment
  misc_feature: Up-regulated in shoot tissues in response to methyl jasmonate treatment
  misc_feature (658)..(754): Pfam ID: RRM_2 Pfam Description: RNA recognition motif 2
  misc_feature (176)..(242): Pfam ID: RRM_1 Pfam Description: RNA recognition motif. (a.k.a. RRM, RBD, or RNP domain)
  misc_feature (261)..(327): Pfam ID: RRM_1 Pfam Description: RNA recognition motif. (a.k.a. RRM, RBD, or RNP domain)
MAANNNPWRGPLPPLLNARAGFGDTSLFSSSLPVLSHEKLIFSDSAHGTPSMDDTSAKMKLLADDPDEKDYKFDFDLRQIDDLLPDEDEFFAGITDETEPVGQTNTTEELEEFDVFGNGGGMELDIDPVESITVGFANSSIVDGARGNGINPFGVPSTVGTVAGEHPFGEHPSRTLFVRNINSNVEDSELRSLFEQYGDIRTLYTATKHRGFVMISYFDIRAARNAMRALQNKPLRRRKLDIHFSIPKENPSDKDLNQGTLVIFNLDPSVSNEEVRQIFGAYGEVKEIRETPNKKHHKFIEFYDVRAAEAALRSLNKSEIAGKRIKLEPSRPGGTRRNFMQQLGHDLDQEEPRSYRHSHVGSPVANSPPGAWAYSSPTDNNMLQAFTRSPTGNGMSPIGMPSLISNAPKIAPIGKDSNWSKYDQVFSNGNQSQGAAFQHSHSYQDHNSEYMSSSPGTLSGPQFLWGSPKPYSEHSKSPIWRPPAIGPALSSSSRTQGQGFLYSSRQASLFGSSDQHHHHVGSAPSGAPFESHFGFLPESPETSFMKQVRFGNMGNVGTGRNGGALMLGMAGRASVNPGSSLIGSLTDNSSTNFRPILSPRLGQAFYTNPPYHGPGTFGLDNSIDRARNRRVDSSVLQADSKRQYQLDLEKIRRSDDTRTTLMIKNIPNKYTSKMLLAAIDEFHKGTYDFFYLPIDFKNKCNVGYAFINMISPVHIISFYQAFNGKKWEKFNSEKVASLAYARIQGRSALISHFQNSSLMNEDKRCRPILFNPNGQDSVNQEAFPINGICIHMPLEDDCLDNEEDKNQNEKTGESSTDIGGSL

SEQ ID NO: 21608 - DNA, 1410 bp, Sorghum bicolor
  misc_feature: Ceres ANNOT ID no. 8734459
  misc_feature: Up-regulated in shoot tissues in response to salicylic acid treatment
  misc_feature: Encodes the peptide sequence at SEQ ID NO 21609
atggccatggaggagcagcagccacctcctgctcctgctcctgcgccgccggagctgcgctacctctcggggctgggcaacagcttctcgtcggaggcggtgccggggtcgctccccgtggggcagaacagcccgctggtgtgcccgctgggactctacgccgagcagctctccggcacctccttcaccaccccgcgcgcccggaacctccgcacgtggctgtaccggatcaagccatcggtgacccacgagcccttctacccgcggaaccccaccaacgagcgcctcgtcggcgagttccaccgggccaccaccgtcgccacgcccacgcagctgcgctggagacccgccgacgtgcccctccacccggacctcgacttcatcgacgggctctacaccgtctgcggcgccggcagctcttgcctccgacacggatacgccatccacatgtatgctgctaacaagtccatggatggatgcgccttctgcaatgccgacggtgacttcctcattgttccccagcaaggaaggctattgatcacaactgagtgcggaaagctgctcgtttcacccggcgagatcgtcgtgattcctcaaggtttccgctttgctgttgacttgccggatggcccctcgcgtggctatgtctctgagatcttcggcacccattttcagctccctgatcttggcccaattggtgctaatggtttggcttcaccgagggatttcctttccccgacagcatggtttgagcaggaccaccaccctggatacacaatagtgcagaagtatggcggtgagctgttcactgccacgcaggatttttctccattcaatgtggtcgcatggcatgggaattatgtcccttacaagtatgatctgagtaagttctgtccattcaacaccgtcctctttgaccatggcgacccatcggtaaacacagttctaactgcgccaactgataagcctggcgtcgcgttgcttgattttgtaatattcccacctagatggctggttgctgaaaatacattccggcctccgtactaccaccgcaactgcatgagcgaattcatgggcctcatttatgggatatatgaggctaaggccgatggttttcttcctggaggtgccagtcttcacagctgcatgacaccacatgggccagacaccaagacatatgaggcaacaatcagccgtgctggtgccaacgagccattcaggctcagtggaacgttggccttcatgtttgagtcttcgcttatccctcgcgtgtgtcgatgggctctggattccccgtgtcgagatctcgattactaccagtgctggattggattgaagtcccacttttcacatgacaacggtggagtggcgaccatcgagcctgctgctggcacggatgagaaagagtag

SEQ ID NO: 21609 - protein, 469 aa, Sorghum bicolor
  misc_feature: Ceres ANNOT ID no. 8734459
  misc_feature: Up-regulated in shoot tissues in response to salicylic acid treatment
  misc_feature (18)..(461): SWISSPROT Homolog: EC 1.13.11.5 Homogentisate 1,2-dioxygenase
  misc_feature (18)..(449): Pfam ID: HgmA Pfam Description: homogentisate 1,2-dioxygenase
MAMEEQQPPPAPAPAPPELRYLSGLGNSFSSEAVPGSLPVGQNSPLVCPLGLYAEQLSGTSFTTPRARNLRTWLYRIKPSVTHEPFYPRNPTNERLVGEFHRATTVATPTQLRWRPADVPLHPDLDFIDGLYTVCGAGSSCLRHGYAIHMYAANKSMDGCAFCNADGDFLIVPQQGRLLITTECGKLLVSPGEIVVIPQGFRFAVDLPDGPSRGYVSEIFGTHFQLPDLGPIGANGLASPRDFLSPTAWFEQDHHPGYTIVQKYGGELFTATQDFSPFNVVAWHGNYVPYKYDLSKFCPFNTVLFDHGDPSVNTVLTAPTDKPGVALLDFVIFPPRWLVAENTFRPPYYHRNCMSEFMGLIYGIYEAKADGFLPGGASLHSCMTPHGPDTKTYEATISRAGANEPFRLSGTLAFMFESSLIPRVCRWALDSPCRDLDYYQCWIGLKSHFSHDNGGVATIEPAAGTDEKE

SEQ ID NO: 21610 - DNA, 5700 bp, Sorghum bicolor
  misc_feature: Ceres ANNOT ID no. 8734499
  misc_feature: Up-regulated in shoot tissues in response to aminocyclopropane carboxylic treatment
  misc_feature: Up-regulated in shoot tissues in response to salicylic acid treatment
  misc_feature: Encodes the peptide sequence at SEQ ID NO 21611
atggcctcggattttgacgagaccgacgaagccttcttcgacaagctagtcaactccgacgacgacgacgacgatcccccggtcgccaccgccgccgcctccgcctccgcgaggggcctcgccgcgctatcgctgaccgaccaacccgacgcggcgccgccgcctcgtgaccagcctgcggtggcggcgccaccgacggaggagccggagcgtggcccctcgccggaggttgaccctgcggccgtgctgcagcatccggagacccaggctcgggccgcggagccggtccccgacctcgctgcgaccgccggggcagatccgtccggggacctcctgccggaagacggagaagccttattcggggctgcggctgtgcccggggatcaccagggcctgcaggcgtcgccgttgctgtcgcttccagcaggtaccggcgatgtcagcgcgccggatcgcaccgtctctcaacatacggatagcaatgccagttcccagttggattccagcacagctgcggaggggtctggggatcagagcgccaatgtgcagttggaatccaccgatcccaggtatctagagagcctctaccctggctggaagtacgacgacgccacgcagcagtggtaccaggtagatactcttagcgcgcagagctatgctgctcagaatactggtgcggctgtggcaggccatgggagtgatgttcatcttcagcagcagcagcggcagcttggtgcttcgtacatgcaaaacacttcacattcagagactgtgcttgaacctacgcagccgacttctcagcctgagactgaggctgacaatcagcctgctgtggcgccactgaaagaggaggaggcagattgtgaacccgtgcagatgcatcatgtggctcatacaggggtgggatatggggagaacaatgccagttctcagttccaaacaacgagcaatgccagctcccagtttgattccagcataactgctgagggatacggggaccagagcgccaatgcgcagttggaatacaatgatcccagatatctagagagcctctaccctggctggaagtacgacgaggccacacagcagtggtatccgttagatactctcaacacacagacttatgctgctcatgatactggtggtgcagtgacagaccttgcgagtggtagtgttcagcagcaacaacagtctagtggttcgtacctagaaaacacttcacatgcagagcctgtgcttgaacctacagagccgacctctgagccgaagcctcagcttgagcctgtggtagcccctcctgggactgaggttgataatcagcctacagtggccccacagaaagaggagcgggtggagcatgaacccatgctggtgtatacaaagccggaagctgaggagattcctgcttatgctggtgacactgccacagcgaaagagggtgtgtccccagggtcagagaaaggtatccataccgccatcaagcaggtgcagtggaatgactttggtgccagcactggtggtggtggggcagatctgtttggggacctcctgcccgatggagctggggatgacttctttgggggcactgtccctggcaaccaaggtgtccagtcatccttggtaggtgctaaaaatgttagtgcaccagatcacagcttctctacaggactggataacagtgccatgattagtgctggacacaacttctctggcggagtcaataaaaatgccaacactcatttcagttccagtggaagtagtgcagggtatggggatcagagcactaatgcacaattgaactccactgatcccaaatacctggagagcctctacccagggtggaagtacgatgaggcgacacagcagtggtatcaggtaggtacccacagtgcacagagttacattgctgataatactggtgctgttgtagcccttgggactgacaatacccagcaaaatcagcagcagtttagtgcatcgtacttgcaaagcaatttacatgcagtacttgagaccattgcggaggagagcagcaccaatgccacgagctggccccagggtgggaccaacccagggcctgcagaatacccatcgaacatgctgttctatgcagaatacccaggatggtactttgacaccaacactcaacaatggcaaacacttgagtcataccagcaaagtgttgcacaggttgcaactactgtagcagcctcagatgtgttcgcaggggcaggccatagtgtagctcattacactgaggattcttatgcaagtagctataaccagcagagccagtggcagccaaattcgttgggtaacaccatgcagcctgatgtttcggggggtaagagcttgttaggtagttcctatagttccaatcagcaggctgggaatccgattgggcagcaagccaatgctgagtctttggcatcgtctatagttcacgagcctaatcatatagagacattcatgccttctacagggaaccagagttggtacaggggtttggagcattctacaagtaaggagttaaggtacaaagggtttgaaccttcaacaggtttccagaatagtcgcaaggaattccagcctcctaaagatcaccaggatggccacatggcagacgaacctttgataagagatgggtatgttagttcaaatggggttgccaatacacaaaattttgtaccaaaagaaagcatatacaagacacaaatgcatgatgattccactgcacatactcatttggcaagtaactattggggtactcagacctcatcgggcattgctcaacagcaactgattggtacaaatgatccatcccaacattttggtttctcaccacacgagcagagatcatcagctggacgcccaccacacactgtggtatcctttggatttggggggaagcttgtagttcttaaagaaaccagctccatggctgcagactttgacagcggaaatcagggcaattctggtcgaacaatatcagttcttaatattccagaggttgttgctgataaaattgaccactcaagcatcactaacagtggtgcatttagctacttccatgctttgtgtcgccatcctattcctggccctcttgttggtggaagtgctgcatcaaaggatgtgaacaaatggcttgatgatatgactggagtatatgaatcttctcagacggaattccagggaggggatgttcagaaggtgcttatttcattgttgaaaatattgtgtcaacactatggaaagcttcgttcaccctttgggtctgacccatcacaagaggagagctgtgcatcattatattataagaaaagcctgatgaatcatgttgtgcgaagggctcttttgaacaagatgcttcactctatttattttctaatggaatactcattttgtttgaactatttgctaaagggtatagatggcccagagatggcagtgacgaaacttttttcatcttgcaagagcagtgctaatatgaaagggtatggagctgttgtccattgcatgagaaatcttccctcagaaagccagattcagacaaataccctattgcagactactgcccaggaggttcaaaatcttctggtttctggtagaaggaaagaggcccttcagcatgcacaggaaggtcagctttggggccctgcactgatccttgctttacaacttggtcataagttttatgcggatactgtgaagaaaatggctcactgccattttgtttccggatcacccttgaggacattgtgccttcttattgctggacaacctgcagatgctgctcctaagggtatgctggatgactggcaagagaatttggcaattataacagcaaacaggacaaaaggtgatgaccttgtaattacccaccttggggattgcctctggaaagagaaaaatgaggttgcatctgctcactcatgctatttagttgctgaactaaatattgattcgtactctgaaagtgcaaggatgtgccttattggtgcagatcacttgagatgtccgcgcacatttaccagccctgaagcaatccagagaacagaggtttatgagtatgcaaaggttcttggcaattctcagtatattcacttgtcatttcaaccatacaagctgatatatgcatatatgcttgcggaggttgggaagatttctgattcactaaagtattgtcaagcatctctaaaggtgctgaagtcctctggtcgtgcacctgaactagaagcatggaagcaattgtttatgaccctggaggaccggatacgtacccatcaacagggtggatatgcaacaaatcttgccccaggaaagattgttggaaagcttttcacatcacttgataaatctttgtcccgcatgatgggtacacaagctgcaccgttgcctcaactgccgcagggtgttgcaaatgagagagatgtttattctcctcctgatacaaaagttgtaaatagtcagtcagtgatgtccatgacacctttagtgtcctctgcttcggagcagtctatgagtgaaattggaggaaatagtggctatggcagggaagttgcgcataacagaagtatttctgagccagactttggcaaaagcccccaacatggtgttgtatcaagtaaggcacaaagcacatcaggttcaggcagttcacgctttggatggttggtggagaagacaatggggcttgtttcgaaatctcaccgccaggcaaagctaggggaacagaacaagttctactatgacgagaagctgaagcggtgggtggaagaaggcgctgagatacctgctgaggagcctccacttcccccacctccgtcaaaagtgccattccagagcagtgttccatatcccaactcgaatgctcctcccactggtggaggttattcctcaaatcccccggagcctagttccgggatgccacccatgcctcccacccagaaccagttctcagcgcgtggaaggattggtgttagatcaagatatgtggatacttttaacaaaggtggtggtggtgtaaatgcctttggagcagcaacatcatatagcaaaccagcagctccatctataaatccaatgtctggtgcaaagttctttgtgccaactccagctactgttgcttcagaactgatggctgagccaggtgcccacagtgaaaccacgcgacaggatgaaccatcttcctcaccagcgatggagacagcattcagttcgccgccagcactgataccgatgcagtcaaccattcagcggtacccaagtggtgacaacattcagcggtacccaagcggtgacaacattccacagcacccaagcagtgacagcattcagcggtacccaagcggtgacaacattccacagcacccaagcagtgacagcattcagtggtacccaagcggtgacaacattccacggcactcaagtagtgacaacattcagcggtacccaagtatggacaacattgtgtctccctcaggtagcgttaacagctcaatgtcaaggtcaagagcgtcgtcatggagcggaacattaccagagcagttgagcagcactgctgctaccaggtcacctgatggacagatcatgcagtcaccatcgatgcctggaaaaaggcctccgcacagccgttccagcagcacttcttctgcccagttcaatggtttgggtgaagaacttcacgaggtggagctctga

SEQ ID NO: 21611 - protein, 1899 aa, Sorghum bicolor
  misc_feature: Ceres ANNOT ID no. 8734499
  misc_feature: Up-regulated in shoot tissues in response to aminocyclopropane carboxylic treatment
  misc_feature: Up-regulated in shoot tissues in response to salicylic acid treatment
MASDFDETDEAFFDKLVNSDDDDDDPPVATAAASASARGLAALSLTDQPDAAPPPRDQPAVAAPPTEEPERGPSPEVDPAAVLQHPETQARAAEPVPDLAATAGADPSGDLLPEDGEALFGAAAVPGDHQGLQASPLLSLPAGTGDVSAPDRTVSQHTDSNASSQLDSSTAAEGSGDQSANVQLESTDPRYLESLYPGWKYDDATQQWYQVDTLSAQSYAAQNTGAAVAGHGSDVHLQQQQRQLGASYMQNTSHSETVLEPTQPTSQPETEADNQPAVAPLKEEEADCEPVQMHHVAHTGVGYGENNASSQFQTTSNASSQFDSSITAEGYGDQSANAQLEYNDPRYLESLYPGWKYDEATQQWYPLDTLNTQTYAAHDTGGAVTDLASGSVQQQQQSSGSYLENTSHAEPVLEPTEPTSEPKPQLEPVVAPPGTEVDNQPTVAPQKEERVEHEPMLVYTKPEAEEIPAYAGDTATAKEGVSPGSEKGIHTAIKQVQWNDFGASTGGGGADLFGDLLPDGAGDDFFGGTVPGNQGVQSSLVGAKNVSAPDHSFSTGLDNSAMISAGHNFSGGVNKNANTHFSSSGSSAGYGDQSTNAQLNSTDPKYLESLYPGWKYDEATQQWYQVGTHSAQSYIADNTGAVVALGTDNTQQNQQQFSASYLQSNLHAVLETIAEESSTNATSWPQGGTNPGPAEYPSNMLFYAEYPGWYFDTNTQQWQTLESYQQSVAQVATTVAASDVFAGAGHSVAHYTEDSYASSYNQQSQWQPNSLGNTMQPDVSGGKSLLGSSYSSNQQAGNPIGQQANAESLASSIVHEPNHIETFMPSTGNQSWYRGLEHSTSKELRYKGFEPSTGFQNSRKEFQPPKDHQDGHMADEPLIRDGYVSSNGVANTQNFVPKESIYKTQMHDDSTAHTHLASNYWGTQTSSGIAQQQLIGTNDPSQHFGFSPHEQRSSAGRPPHTVVSFGFGGKLVVLKETSSMAADFDSGNQGNSGRTISVLNIPEVVADKIDHSSITNSGAFSYFHALCRHPIPGPLVGGSAASKDVNKWLDDMTGVYESSQTEFQGGDVQKVLISLLKILCQHYGKLRSPFGSDPSQEESCASLYYKKSLMNHVVRRALLNKMLHSIYFLMEYSFCLNYLLKGIDGPEMAVTKLFSSCKSSANMKGYGAVVHCMRNLPSESQIQTNTLLQTTAQEVQNLLVSGRRKEALQHAQEGQLWGPALILALQLGHKFYADTVKKMAHCHFVSGSPLRTLCLLIAGQPADAAPKGMLDDWQENLAIITANRTKGDDLVITHLGDCLWKEKNEVASAHSCYLVAELNIDSYSESARMCLIGADHLRCPRTFTSPEAIQRTEVYEYAKVLGNSQYIHLSFQPYKLIYAYMLAEVGKISDSLKYCQASLKVLKSSGRAPELEAWKQLFMTLEDRIRTHQQGGYATNLAPGKIVGKLFTSLDKSLSRMMGTQAAPLPQLPQGVANERDVYSPPDTKVVNSQSVMSMTPLVSSASEQSMSEIGGNSGYGREVAHNRSISEPDFGKSPQHGVVSSKAQSTSGSGSSRFGWLVEKTMGLVSKSHRQAKLGEQNKFYYDEKLKRWVEEGAEIPAEEPPLPPPPSKVPFQSSVPYPNSNAPPTGGGYSSNPPEPSSGMPPMPPTQNQFSARGRIGVRSRYVDTFNKGGGGVNAFGAATSYSKPAAPSINPMSGAKFFVPTPATVASELMAEPGAHSETTRQDEPSSSPAMETAFSSPPALIPMQSTIQRYPSGDNIQRYPSGDNIPQHPSSDSIQRYPSGDNIPQHPSSDSIQWYPSGDNIPRHSSSDNIQRYPSMDNIVSPSGSVNSSMSRSRASSWSGTLPEQLSSTAATRSPDGQIMQSPSMPGKRPPHSRSSSTSSAQFNGLGEELHEVEL

SEQ ID NO: 21612 - DNA, 939 bp, Sorghum bicolor
  misc_feature: Ceres ANNOT ID no. 8734502
  misc_feature: Up-regulated in root tissues in response to methyl jasmonate treatment
  misc_feature: Up-regulated in root tissues in response to salicylic acid treatment
  misc_feature: Encodes the peptide sequence at SEQ ID NO 21613
atggcgttcacgccgccgcgcctcctcccgctaccccttccgccggcggcggcaccggcatccacgcgggccgtctcggcgcgccaccacggagggcgcacggcgccggagctctcgggcccgaccccgcgcgtggtggtcgtcacctccgggaaaggcggcgtcggcaagaccaccactaccgccaacctcgccgcctcgctcgcgcgcctcggactccccgccgtcgccgtcgacgccgacgccggcctccgcaacctcgacctcctgctcggcctcgagaaccgcgtccacctcaccgccgccgacgtcctcgctggggactgcaggctcgaccaggcgctcgtccgacaccgcgcgctccaggacctccacctcctctgcctctccaagccacgctccaagctgcccctcgcgttcggatccaagaccctcacctgggtcgccgacgcgcttcggcgctcgcctaacacgcccgccttcatcctcatcgactgccccgcaggtgttgatgccgggtttgtcactgccattgcacctgcagaagaggcagtgctcgttaccacccctgacattacggctctccgtgatgctgaccgtgtcgcaggactgttggagtgcgatggcatcaaagatatcaagattattgtcaaccgagtgcggccagacctggtgaagggggaggacatgatgtcagcacttgatgtccaagaaatgcttgggttgcccttgcttggtgtggttcctgaggatgcggaagtaatccggagtacaaataggggtgtaccattggtgctcaacgacccgcccacgcctgcgggccttgctctggaccaggctacttggcgattggtggaaagagatgtgatgacagcagtcatggttgaggagcaggagaggcccaagaagaaaggcggcttcttttcgttcttcgggtag

SEQ ID NO: 21613 - protein, 312 aa, Sorghum bicolor
  misc_feature: Ceres ANNOT ID no. 8734502
  misc_feature: Up-regulated in root tissues in response to methyl jasmonate treatment
  misc_feature: Up-regulated in root tissues in response to salicylic acid treatment
  misc_feature (46)..(256): Pfam ID: CbiA Pfam Description: CobQ/CobB/MinD/ParA nucleotide binding domain
MAFTPPRLLPLPLPPAAAPASTRAVSARHHGGRTAPELSGPTPRVVVVTSGKGGVGKTTTTANLAASLARLGLPAVAVDADAGLRNLDLLLGLENRVHLTAADVLAGDCRLDQALVRHRALQDLHLLCLSKPRSKLPLAFGSKTLTWVADALRRSPNTPAFILIDCPAGVDAGFVTAIAPAEEAVLVTTPDITALRDADRVAGLLECDGIKDIKIIVNRVRPDLVKGEDMMSALDVQEMLGLPLLGVVPEDAEVIRSTNRGVPLVLNDPPTPAGLALDQATWRLVERDVMTAVMVEEQERPKKKGGFFSFFG

SEQ ID NO: 21614 - DNA, 573 bp, Sorghum bicolor
  misc_feature: Ceres ANNOT ID no. 8734513
  misc_feature: Down-regulated in shoot tissues in response to methyl jasmonate treatment
  misc_feature: Down-regulated in root tissues in response to methyl jasmonate treatment
  misc_feature: Down-regulated in shoot tissues in response to salicylic acid treatment
  misc_feature: Encodes the peptide sequence at SEQ ID NO 21615
atgaagacgatcctggcatcggagacgatggacatcccggagggcgtgacggtgacggtggccgcgaagctggtgacggtggaggggccccgcgggaagctgacccgcaacttcaagcacctcaacctcgacttccagctgcaggagggcgggcgcaagctcaaggtggacgcgtggttcggcacccgccgcaccatggccgccatccgcaccgccatctcccacgtccagaacctcatcaagggtgtcaccaaggggtaccgctacaagatgaggttcgtctacgctcacttccccatcaacgcctccatcaccaacagcaacaccgccatcgagatcaggaacttcctcggcgagaagaaggtcaggaaggtggacatgcttgatggcgtgaccatcctgcggtccgagaaggttaaggatgagctcatcctcgacggcaacgacatcgagctcgtctctcgctccgccgccctcatcaaccagaaatgccatgtcaagaagaaggatatcagaaagttcttggacggtatctatgtcagcgacaagggtgtgatcgaggaggagcagtga

SEQ ID NO: 21615 - protein, 190 aa, Sorghum bicolor
  misc_feature: Ceres ANNOT ID no. 8734513
  misc_feature: Down-regulated in shoot tissues in response to methyl jasmonate treatment
  misc_feature: Down-regulated in root tissues in response to methyl jasmonate treatment
  misc_feature: Down-regulated in shoot tissues in response to salicylic acid treatment
  misc_feature (12)..(86): Pfam ID: Ribosomal_L6 Pfam Description: Ribosomal protein L6
  misc_feature (98)..(177): Pfam ID: Ribosomal_L6 Pfam Description: Ribosomal protein L6
MKTILASETMDIPEGVTVTVAAKLVTVEGPRGKLTRNFKHLNLDFQLQEGGRKLKVDAWFGTRRTMAAIRTAISHVQNLIKGVTKGYRYKMRFVYAHFPINASITNSNTAIEIRNFLGEKKVRKVDMLDGVTILRSEKVKDELILDGNDIELVSRSAALINQKCHVKKKDIRKFLDGIYVSDKGVIEEEQ

SEQ ID NO: 21616 - DNA, 3000 bp, Sorghum bicolor
  misc_feature: Ceres ANNOT ID no. 8734581
  misc_feature: Down-regulated in shoot tissues in response to methyl jasmonate treatment
  misc_feature: Down-regulated in root tissues in response to methyl jasmonate treatment
  misc_feature: Down-regulated in shoot tissues in response to salicylic acid treatment
  misc_feature: Encodes the peptide sequence at SEQ ID NO 21617
atggctgccgctcctcctcacggccacactccagtgggggccgcagcggccacgtccgccgccgtatccattgcctgctcgtcttccgccgcttcctgttacgaagatgacgatgactacggcggcgcatcgtcctcctggtcgctgtcgtcgccgcggcgccggcagccgtaccggcgcctcctccgcgacgaggcgcagcggctccggcgcgcgcgccggggccagggcccgggcgccgacacgccgcggtgggtgcgccgcaccacggaccagatggcccggtacgtcgaggacgaccgcgcggggcacgtgtacggccggcacgtcgtcgccgccgtccgcgcggtgcgcgccacggcgtcgcgcccctccgcggacatgcgcctggccatggcgtcgttcgtgacaaggctcaccttccgcgagatgtgcgtcgtgctccgcgagcagcgcggatggcgccaggcgcgcgacttcttcgcttggatgaagcttcagctgtgctacgaaccaagcgttgtagcttacaccattctgctgcggctgtatggcaaggttgggaagatcaagcttgctgaagagacatttcttgagatgctccaggttggctgcgagcctgatgcagtggcttgcgggaccctcttgtgcatgtatgctaggtgggggcggcacaaggacatgatgctgttctactcggccgtgcgcaggcgcgacctagttcccccggtctcggtctacaactacatgatctcgtctttgcagaagcaaaagctgcatggcaaggtcatccatgtgtggaagcagatgcgggaagctggcgcgctgcctaatcaattcacatatacagttgtcatcagctcctttgtcaaggaagatctcttggagaaggccatggatgtgtttggtgagatgcggcagtgtaggtttgttccggaagaggcgacttatagccttttgatcagtgcgagctccagacatggcaaaggagagcaggcgttgcggctttttgaagagatgaaggctcagggaattgtccccagtaactacacctgtgcatctctcttggcactttattataagaatgaagactactcaaaggcactttcgctattatctgagatggaaaatagtaaggtcattcctgatgaggttatctatggaattcttattaggatatatggtaagcttgggctttatgaggaggcagagcaaacgtttgagaaaattgagaaggcgggtcttctgagcgacgagcagacttatgtagcaatggctcaagttcacttgaatgctggagattatgatagagcattggaggtgttagaatctatgatgatgaggaatgtgaagccttcacacttttcttatagtgctattctccgatgttatgttgcaaaggaagacatagttgctgcagaagataccttcagagctctctcccaacatggcctccctgatgtgttttgctgtaatgacctgctcagattgtatatgaggctgggacatctagagaaggccagggcactagttttaaagatgagggaagatgattttcggcttgatgaggacctctctatgacagtgatgaaattttattgcaaaagcaatatgattaatgatgcagagaaaatattcaaagatattcagagaaacaacaaaactgtgaagattccaacaatgcttttgcttatagagatgtatgctagaaacaaatccagtgtgattcttagagaacacagctcatcaaaggcactcgatggaactgacagttcagcagctagtgtggcgttgaaatccttgttggacatgcctgggggcttgtccagtgtgtccctactgatcagcaaattggctagggaagggagcacagatgaggcaaaattcatttatgaccagctgactgaattgggattcaagcctgatcataccgcaattgctactttggttgtccaatatggacagggcaagcagttagagcaagcacaagaactattcgagtcagcatcagcgctctttccagaaggagcaaatgtttacaatgccatggttgatgcattctgtaaatgtggcaaaactgaagatgcatatcatcttttcatggaaatggtcgatcaaggcagtaatagagatgctgtgacagttagcattcttgtcactcacctaactaaacatggtaaactgcattcagccatcagcatatatgatcgtatgatatcctctggcacttctcagtctatgcagacatttaatttaatgataagtgtttttggcaaaggaggaaagctggacaaggctgttgaaatgtttgctgctgcacaggagctaggcttgccgattgatgaaaagatgtacaccaacatgcttagcttatatggaaaagccggtaggcatcaggaggcgtctttaatgttcaaaagaatgaaggaagatggcatcaggcctggaaagatcagcttcaattccatgatcaatgcttatgccacttcaggattgtgcagcgaggcgaagagtacattccatgagatgcaggactgtggtcacgctcccgactcattctcctatctcgcactgatcagagcatacacagaggctaaactatacatggaggcagaagaagccatccggatgatgctgaacagcagcacaaccccttcctgtcctcatttcagccacctgattttcgcctttctgaaggaaggccagattggtgaagcccagaggatctacaaccaaatgaaggaggcaagtgtggctcctgatctggcctgctgtaggaccatgatgagggtgtacatggagcacggtctcatggacgaaggcatcactctctatgagacgacgcgtgggtcgctgaaacctgacagcttcatcttgagcgctgcgtttcatctatatgatcatgcaggcagggagtctgaagcccaggatgtcctggatgccatcagtgtgagtggtacctccttcctgaggaacatgaaaattggatcgaagctttga

SEQ ID NO: 21617 - protein, 999 aa, Sorghum bicolor
  misc_feature: Ceres ANNOT ID no. 8734581
  misc_feature: Down-regulated in shoot tissues in response to methyl jasmonate treatment
  misc_feature: Down-regulated in root tissues in response to methyl jasmonate treatment
  misc_feature: Down-regulated in shoot tissues in response to salicylic acid treatment
  misc_feature (818)..(852): Pfam ID: PPR Pfam Description: PPR repeat
  misc_feature (315)..(349): Pfam ID: PPR Pfam Description: PPR repeat
  misc_feature (175)..(209): Pfam ID: PPR Pfam Description: PPR repeat
  misc_feature (280)..(314): Pfam ID: PPR Pfam Description: PPR repeat
  misc_feature (783)..(817): Pfam ID: PPR Pfam Description: PPR repeat
  misc_feature (678)..(712): Pfam ID: PPR Pfam Description: PPR repeat
  misc_feature (385)..(419): Pfam ID: PPR Pfam Description: PPR repeat
  misc_feature (350)..(384): Pfam ID: PPR Pfam Description: PPR repeat
  misc_feature (748)..(782): Pfam ID: PPR Pfam Description: PPR repeat
  misc_feature (489)..(523): Pfam ID: PPR Pfam Description: PPR repeat
  misc_feature (888)..(922): Pfam ID: PPR Pfam Description: PPR repeat
  misc_feature (420)..(454): Pfam ID: PPR Pfam Description: PPR repeat
  misc_feature (609)..(643): Pfam ID: PPR Pfam Description: PPR repeat
MAAAPPHGHTPVGAAAATSAAVSIACSSSAASCYEDDDDYGGASSSWSLSSPRRRQPYRRLLRDEAQRLRRARRGQGPGADTPRWVRRTTDQMARYVEDDRAGHVYGRHVVAAVRAVRATASRPSADMRLAMASFVTRLTFREMCVVLREQRGWRQARDFFAWMKLQLCYEPSVVAYTILLRLYGKVGKIKLAEETFLEMLQVGCEPDAVACGTLLCMYARWGRHKDMMLFYSAVRRRDLVPPVSVYNYMISSLQKQKLHGKVIHVWKQMREAGALPNQFTYTVVISSFVKEDLLEKAMDVFGEMRQCRFVPEEATYSLLISASSRHGKGEQALRLFEEMKAQGIVPSNYTCASLLALYYKNEDYSKALSLLSEMENSKVIPDEVIYGILIRIYGKLGLYEEAEQTFEKIEKAGLLSDEQTYVAMAQVHLNAGDYDRALEVLESMMMRNVKPSHFSYSAILRCYVAKEDIVAAEDTFRALSQHGLPDVFCCNDLLRLYMRLGHLEKARALVLKMREDDFRLDEDLSMTVMKFYCKSNMINDAEKIFKDIQRNNKTVKIPTMLLLIEMYARNKSSVILREHSSSKALDGTDSSAASVALKSLLDMPGGLSSVSLLISKLAREGSTDEAKFIYDQLTELGFKPDHTAIATLVVQYGQGKQLEQAQELFESASALFPEGANVYNAMVDAFCKCGKTEDAYHLFMEMVDQGSNRDAVTVSILVTHLTKHGKLHSAISIYDRMISSGTSQSMQTFNLMISVFGKGGKLDKAVEMFAAAQELGLPIDEKMYTNMLSLYGKAGRHQEASLMFKRMKEDGIRPGKISFNSMINAYATSGLCSEAKSTFHEMQDCGHAPDSFSYLALIRAYTEAKLYMEAEEAIRMMLNSSTTPSCPHFSHLIFAFLKEGQIGEAQRIYNQMKEASVAPDLACCRTMMRVYMEHGLMDEGITLYETTRGSLKPDSFILSAAFHLYDHAGRESEAQDVLDAISVSGTSFLRNMKIGSKL

SEQ ID NO: 21618 - DNA, 1791 bp, Sorghum bicolor
  misc_feature: Ceres ANNOT ID no. 8734607
  misc_feature: Down-regulated in root tissues in response to aminocyclopropane carboxylic treatment
  misc_feature: Down-regulated in shoot tissues in response to salicylic acid treatment
  misc_feature: Encodes the peptide sequence at SEQ ID NO 21619
atgtcggagcagcagccattaccgcagcctcggagcagcatgcgggaggcgctggagaaggaggacaaggagaaggccgcggccgccgcggccaaggagaaggcggccgtacccaagaacggcggcaacggtgggggtggcaagaatggcggcgggggtaacggcggcggcgtgggtggcggcaacggcggaggcgccccgccgtccggggaggagacggcccgggagattcaggtggtgagggaggcgtaccggcgcgagacggccgcgccggcgtacgtcatccccgaggagccgccggccatggtggagctggtgggctggtacatctacggcttctgctcctacttcatcacccacctgctgctgccggtgctcttccctgccatcatcacgcaggtcgccttccccaactccgacttcacgccggaccccaagtacaccctcaagggcgtcacctgctccgtccatgagatgtccatgtaccaaaggcttaccaagcactctattgtgattgatgattcccggatgtcaccactgggctggagtggtctatcatgggcaattggcattctcatcgtggcgccgctcctcactcagactgctcaccatcttgaccgtggccaatatcagtcactgatcctcattgctgccacgtcttttgggtcgttcttctgcctgctcacaggcttcttcaagacagtctgggtgttcctgttctacatcctcttcattgcgggctcaatcattattgcggaggcagtgcatacccgcaaccttggactgatgatccgtgggcttgctgcgcatgactcaggcaagcaccttgttcttcgccgccgtgctgctgcgagccagctcagcctgtactgcactgccattggaggcattggagcagccctcatggctgcattcatgtaccacatgctgcggcgcactgatcagctcactggcctctgggttgtgtccatcttctgtggccttatctggttcattggcatttgccatggtctcttcacaaacaggcccagcagctcatcacccaccactgcatttgagcccaacttcttcaccaagctcagctatagtatgacccttctgcgctacccacaggccattggcagcttggttgctgtgttcctgtcctcttttgccacaatgtgcatcttcaccagtggcacactctatgctatcggtggtgtttgcatcaagccagtgcttgtgcttgtgctatggatcctttacttcctgtttcccttgatctcacttccacttctccacccaatccagataataatccgtgctgacgctgttcgcatgcagctgcttggtttcataatctgcctatttgtatctggtgctgggttctacttcaagagccacaggtggagagctgcccacatcattgttatcgcccttgtccagagcactgccaatggcatattgtacgcatttggccgcattctgctccttgatgcctcaccaccagggaaggagggtgcattctcggtctggtatgcatttgtccgtgttactggtgccatgattggcttcgctgcttcttctgctggccctgggcgtgccggaggatcatttgctgctgcattccttgggagcttcctgggcatcattgtgctgatcttcggcaatgtcagcaacattggagcgctgaaggctgctgggcacctcaagggaatggacgatgagaagaggatgggcggacttggggagaaaggtgaaggcatgggtagcgccgtcgctgattcgggtgaaagcagggggagggtatga

SEQ ID NO: 21619 - protein, 596 aa, Sorghum bicolor
  misc_feature: Ceres ANNOT ID no. 8734607
  misc_feature: Down-regulated in root tissues in response to aminocyclopropane carboxylic treatment
  misc_feature: Down-regulated in shoot tissues in response to salicylic acid treatment
MSEQQPLPQPRSSMREALEKEDKEKAAAAAAKEKAAVPKNGGNGGGGKNGGGGNGGGVGGGNGGGAPPSGEETAREIQVVREAYRRETAAPAYVIPEEPPAMVELVGWYIYGFCSYFITHLLLPVLFPAIITQVAFPNSDFTPDPKYTLKGVTCSVHEMSMYQRLTKHSIVIDDSRMSPLGWSGLSWAIGILIVAPLLTQTAHHLDRGQYQSLILIAATSFGSFFCLLTGFFKTVWVFLFYILFIAGSIIIAEAVHTRNLGLMIRGLAAHDSGKHLVLRRRAAASQLSLYCTAIGGIGAALMAAFMYHMLRRTDQLTGLWVVSIFCGLIWFIGICHGLFTNRPSSSSPTTAFEPNFFTKLSYSMTLLRYPQAIGSLVAVFLSSFATMCIFTSGTLYAIGGVCIKPVLVLVLWILYFLFPLISLPLLHPIQIIIRADAVRMQLLGFIICLFVSGAGFYFKSHRWRAAHIIVIALVQSTANGILYAFGRILLLDASPPGKEGAFSVWYAFVRVTGAMIGFAASSAGPGRAGGSFAAAFLGSFLGIIVLIFGNVSNIGALKAAGHLKGMDDEKRMGGLGEKGEGMGSAVADSGESRGRV

SEQ ID NO: 21620 - DNA, 3021 bp, Sorghum bicolor
  misc_feature: Ceres ANNOT ID no. 8734703
  misc_feature: Down-regulated in shoot tissues in response to methyl jasmonate treatment
  misc_feature: Down-regulated in shoot tissues in response to aminocyclopropane carboxylic treatment
  misc_feature: Down-regulated in root tissues in response to methyl jasmonate treatment
  misc_feature: Encodes the peptide sequence at SEQ ID NO 21621
atggccgacgcgtactggaggtacgctgccgccgacccgcgccagcagcagcagcagcagccgcagccgccctccgccggcgggggcatcgggcaccccggcatgggcggcggcgcaccgcagatggcccccgccgtggggcagcagcagcagcagcagcccatgaagcgaccccgccccgccgacttctcagatgtacccggtgcacctgacatgactggctattatccacgtgatgaagaaagggcaggatatcgtcctgctagagatactgaggctcttaacgcgtcctacgaacgttttctgcgtactgggcaaattcaatcctttggtggtggacctgctggagaacctattaggcctgctgttggtggcaatgctggctacccagttgatgaccgttcgatgatggctgctaggggtatggatagcagaaatattggtttcggtggtggaatgccagagccaccccttccacctgatgcctcaaacaccttatatattgaaggcattccaactggctgtacacgtcgagaagtttcacacatcttccgaccatttgttggctttcgtgaggttaggcttgtaaacaaagaaccgaaacatcctggtggtgaccctattgtcctgtgttttgttgatttcgcggaacctacacaatctgctattgccatggaggctttgcaaggctataagtttgatgagcatgatcgcaattcacccaatttgcggctgcaatttgctcgatttacgggtccaagggggaattcaggacctggtggcggtcgtgtgcaaccgtcgccgcgtcgccggcatggctcaccggaggaagaggagcgtgaggcgggggacgacgacgacgacgacgactcctcgccgatcgagcaggtggcgctgacggtgccggttggggacgacccggcgacgccggtgctgacgttccggatgtggatgctgggcacagcgtcctgcgccggactttccttcctcaacgctttcttcgggtatcgcaaggagccgctcaccatcaccgccgtctcggcgcagatcgccgtgcttccgttgggccgcctcatggcggcagcactgccggagggcgccttcttccggggccggccgtgggcgttcaccctcaatccggggccattcaacatgaaggagcatgtcctgatcaccatcttcgccaacgccggcgctggcgcagtgttcggcatgaatctcgtgacctctgtacgcgtcttctacggccagcacatgtccttcttcgtcgccctcctcctcatcctcaccagccaggtgctggggtttggttgggcgggaatattccggcggtatctggtggagccggcggcgatgtggtggccctccaacctcgtgcaggtctccctcttcagggcacttcatgagaaggagcgaaggagaaaaggtagaatgacacgcaaccagttctttctggtggcattcatctgcagttttgcctactacatcttcccaggctatctgttccagatgcttacctccctgtcctggatctgttgggtatttcccatctccgtgattgcccaacagcttggctcaggcctccatggtcttggcattggtgcaattggactcgactggtcatccatctcctcctaccttggaagcccccttgctagcccctggtttgccacagccaacattgcagctggcttcttcatagtcatgtacataatcacaccgatcaactactggtttaatgtttacaaggcacgcaacttccccatctactcagatggtctctacacagagtctggacaaaagtacaacgtctccagcattatggactcccaattctattttgatacagatgcctatgagaagaatggaccattatacatcagcacattcttcgcttccagctatggccttggttttgcatgccttaccgcaacggtttcccacgttctccttttccatggaagtgaaatctgtcagttaagcaaatcagctttcgaggataagaagatggatatacatacaaagcttatgaggagatacaggcaggtccctgagtggtggttcatatgcatccttgtggccagtgttgcagtcaccatgcttacctgtgagtactacattgagcaactgcagttaccttggtggggagtactgcttgcatgtgcccttgccattttctacacccttccgattggaattatcaaagcaacaactaaccaggctccaggcttgaatatcatcacagagtacatcatggggtacctatatcctggacgacccattgccaacatgtgcttcaaagtatatggctacgttggcccacgtcaagcactagaatttttgcaagactttaagttgggacactacatgaagattcccccaaggaccatgttcatggctcaggtcgtgggcactttgattgcgggttctgtataccttggaacgacatggtggctcatggacacaatacctaatgtgtgcaacagggagtttctcccagcagacagcccttggacatgcccttatgatcatttgttttatgatgcatcagtattatggggccttattggcccacgcagaatatttggtgatttaggcacttactctgctgtgaactggttcttcctaggcggcgccattgctcccttccttgtctggtgtacacagaaagcattcccggctcagaaatggatccgacatgtcaatgtgcctgtattgattggtgcaaccagcttgatgccgcctggcactgcagtcaactataccacatggatactcattgcatttttgtcaggttacgtggtctataggtaccgacgtaattggtgggagcgacacaattacctgctctcaggtgcccttgacgctggtttggcattcatggctgtattgctatatctatgcctgggactggagaacaaaagtttgaactggtggggcaatgatttggatggatgccctcttgcttcatgccccactgcaaagggcataactgtggatggatgcccagcacataattga

SEQ ID NO: 21621 - protein, 1006 aa, Sorghum bicolor
  misc_feature: Ceres ANNOT ID no. 8734703
  misc_feature: Down-regulated in shoot tissues in response to methyl jasmonate treatment
  misc_feature: Down-regulated in shoot tissues in response to aminocyclopropane carboxylic treatment
  misc_feature: Down-regulated in root tissues in response to methyl jasmonate treatment
  misc_feature (311)..(969): Pfam ID: OPT Pfam Description: OPT oligopeptide transporter protein
  misc_feature (166)..(240): Pfam ID: RRM_1 Pfam Description: RNA recognition motif. (a.k.a. RRM, RBD, or RNP domain)
MADAYWRYAAADPRQQQQQQPQPPSAGGGIGHPGMGGGAPQMAPAVGQQQQQQPMKRPRPADFSDVPGAPDMTGYYPRDEERAGYRPARDTEALNASYERFLRTGQIQSFGGGPAGEPIRPAVGGNAGYPVDDRSMMAARGMDSRNIGFGGGMPEPPLPPDASNTLYIEGIPTGCTRREVSHIFRPFVGFREVRLVNKEPKHPGGDPIVLCFVDFAEPTQSAIAMEALQGYKFDEHDRNSPNLRLQFARFTGPRGNSGPGGGRVQPSPRRRHGSPEEEEREAGDDDDDDDSSPIEQVALTVPVGDDPATPVLTFRMWMLGTASCAGLSFLNAFFGYRKEPLTITAVSAQIAVLPLGRLMAAALPEGAFFRGRPWAFTLNPGPFNMKEHVLITIFANAGAGAVFGMNLVTSVRVFYGQHMSFFVALLLILTSQVLGFGWAGIFRRYLVEPAAMWWPSNLVQVSLFRALHEKERRRKGRMTRNQFFLVAFICSFAYYIFPGYLFQMLTSLSWICWVFPISVIAQQLGSGLHGLGIGAIGLDWSSISSYLGSPLASPWFATANIAAGFFIVMYIITPINYWFNVYKARNFPIYSDGLYTESGQKYNVSSIMDSQFYFDTDAYEKNGPLYISTFFASSYGLGFACLTATVSHVLLFHGSEICQLSKSAFEDKKMDIHTKLMRRYRQVPEWWFICILVASVAVTMLTCEYYIEQLQLPWWGVLLACALAIFYTLPIGIIKATTNQAPGLNIITEYIMGYLYPGRPIANMCFKVYGYVGPRQALEFLQDFKLGHYMKIPPRTMFMAQVVGTLIAGSVYLGTTWWLMDTIPNVCNREFLPADSPWTCPYDHLFYDASVLWGLIGPRRIFGDLGTYSAVNWFFLGGAIAPFLVWCTQKAFPAQKWIRHVNVPVLIGATSLMPPGTAVNYTTWILIAFLSGYVVYRYRRNWWERHNYLLSGALDAGLAFMAVLLYLCLGLENKSLNWWGNDLDGCPLASCPTAKGITVDGCPAHN

SEQ ID NO: 21622 - DNA, 1431 bp, Sorghum bicolor
  misc_feature: Ceres ANNOT ID no. 8734723
  misc_feature: Down-regulated in shoot tissues in response to salicylic acid treatment
  misc_feature: Encodes the peptide sequence at SEQ ID NO 21623
atgcggcggaacgcgctctaccgcccggcgctcaagctttctgaagttatgacaagaagaggcatgaatcctactgttagtgatcaagcaatctgcctggatctcattgccaaatcgagaggcattgctgctgccgagaagtactttttggacctcccagaaacgtccaagactcatcttacatatggcgctcttctcaattcttactgcaaagagttgatgactgagaaggccgagtcccttatggcgaaaatgagtgagctcaactttgcttttactgccatgccctttaacagcctaatgactatgtacaccaaagttaaccaacctgagaaggtccctggtatcattcagtacatgaaggcagatgacgtattgccacatgtctttacttataatgtttggatgagggcgcttgcagctctcaatgacataccaggggttgagagggtgattgaagagatgaaacgggatggccgtgttgctcctgattggacaacatacagcaacctggcttccatatatgttgatgctgggctgtttgagaaggcagaggctgctcttaaggagcttgagaagcggaacaccagcaatgacgtggaagcctaccagtttctcattacattgtatgggcgtacacagaacttagtggaagttcaccgtgtctggcgatcactgaagcggaataaccctagaatggcaaacatgagctaccttaacatgattcaggttttggccaacttgaaggaccttcctgctgctgaagcctgtttcaaggagtgggaagcccggcacatccatccacccaagaccaaagcaaaggactctggggcagataatatatccactacagatccagaatcttcaagtaacctgcctaataatcagtctggcatcaaggaaactggggatgaggcagcgaaggacctccaactgaagcatccaaagtatgacatccgggtagcaaatgctatgatcaaagcatacattgctgagggcatgcttgacaaagctgtcgccgtgaagaagcgcgccaagatgcatggcggaagactgaatgccaagacatgggagatcttcatggagcatcacctcaagacgggggatctcaagatggcccattggtgtgcggaccgcgcgatgaagaaagggcacagcagcggcaggatctgggtgccgccacccgcggtgacggagaccctgatgagctacttcgaggagaacaaggatgttgatggggccgagcagtatgtggagtctctgaagaaggtgcagaaggatctgggcacgccggtgttcgagccgctgttgcggacgtacgctgctgccgggaagaagttccctgggatgcggcagcggctgaagatcgaaaacgtggaggtcggggaggaaacggaccagctgcttgactctatctgcgccgatcaatag

SEQ ID NO: 21623 - protein, 476 aa, Sorghum bicolor
  misc_feature: Ceres ANNOT ID no. 8734723
  misc_feature: Down-regulated in shoot tissues in response to salicylic acid treatment
  misc_feature (60)..(94): Pfam ID: PPR Pfam Description: PPR repeat
  misc_feature (130)..(164): Pfam ID: PPR Pfam Description: PPR repeat
MRRNALYRPALKLSEVMTRRGMNPTVSDQAICLDLIAKSRGIAAAEKYFLDLPETSKTHLTYGALLNSYCKELMTEKAESLMAKMSELNFAFTAMPFNSLMTMYTKVNQPEKVPGIIQYMKADDVLPHVFTYNVWMRALAALNDIPGVERVIEEMKRDGRVAPDWTTYSNLASIYVDAGLFEKAEAALKELEKRNTSNDVEAYQFLITLYGRTQNLVEVHRVWRSLKRNNPRMANMSYLNMIQVLANLKDLPAAEACFKEWEARHIHPPKTKAKDSGADNISTTDPESSSNLPNNQSGIKETGDEAAKDLQLKHPKYDIRVANAMIKAYIAEGMLDKAVAVKKRAKMHGGRLNAKTWEIFMEHHLKTGDLKMAHWCADRAMKKGHSSGRIWVPPPAVTETLMSYFEENKDVDGAEQYVESLKKVQKDLGTPVFEPLLRTYAAAGKKFPGMRQRLKIENVEVGEETDQLLDSICADQ

SEQ ID NO: 21624 - DNA, 993 bp, Sorghum bicolor
  misc_feature: Ceres ANNOT ID no. 8734768
  misc_feature: Up-regulated in shoot tissues in response to methyl jasmonate treatment
  misc_feature: Encodes the peptide sequence at SEQ ID NO 21625
atggcgcgcgccggcgtctccaccgcgccgctctcccgcctccactcccttccaccacggccttccctcctccacaacccgcagccgaacgtcctcctcctccgtccccagcagcgcaaggcgcccgccaccaccgcggcggcgctaccgacggccgcggacctcccggagctatccctcccggccgcggccgccgcggcggccgcgctggctgcggcggtttctctctccgaccccgagcgccggcggcgcgcgcaggccgaggcggcgggcggcggggacaaggaggcggtccgcgcctacttcaactcgacggggttcgagcggtggcgcaagatctacgggtcggcgacggagggcgtgaaccgcgtgcagctggacatccgcgagggccacgcgcagacggtggcggcggcgctgtccatgctccgcgactccccgctggagctggcgggcaccacggtgtgcgacgccgggtgcgggacggggtcgctggccatcccgctcgcggccgagggcgccgacgtcctggcctccgacatctcggcggccatggtgtcggaggcgcagcggcaggcgtcgctggcgcaggcaacggcgccggggtcgacgacgttccggatgccccggttcgaggtccgcgacctggagagcctggaggggcggtacgacgtggtggtgtgcctggacgtgctcatccactacccgcgggaggaggcgaaagccatgatccgccacctcgcgtcgctggcggacaagcggctgctcatcagcttcgcgcccaggacgctctacttcgacttcctcaagcgcgtcggcgagctgttcccgggcccgtccaaggccacgcgcgcctacctgcacgccgaggccgacattgaggacgcgctccgacaggccggatggcgcgtcgccaaccgcggcttcatctccacgcagttctacttcgccaagctcttcgaagccgtgcccgtcgcctcctcgtcgtcgtag

SEQ ID NO: 21625 - protein, 330 aa, Sorghum bicolor
  misc_feature: Ceres ANNOT ID no. 8734768
  misc_feature: Up-regulated in shoot tissues in response to methyl jasmonate treatment
  misc_feature (94)..(323): SWISSPROT Homolog: EC 2.1.1.11 Magnesium protoporphyrin IX methyltransferase
  misc_feature (228)..(324): Pfam ID: Mg-por_mtran_C Pfam Description: Magnesium-protoporphyrin IX methyltransferase C-terminus
  misc_feature (156)..(257): Pfam ID: Methyltransf_12 Pfam Description: Methyltransferase domain
MARAGVSTAPLSRLHSLPPRPSLLHNPQPNVLLLRPQQRKAPATTAAALPTAADLPELSLPAAAAAAAALAAAVSLSDPERRRRAQAEAAGGGDKEAVRAYFNSTGFERWRKIYGSATEGVNRVQLDIREGHAQTVAAALSMLRDSPLELAGTTVCDAGCGTGSLAIPLAAEGADVLASDISAAMVSEAQRQASLAQATAPGSTTFRMPRFEVRDLESLEGRYDVVVCLDVLIHYPREEAKAMIRHLASLADKRLLISFAPRTLYFDFLKRVGELFPGPSKATRAYLHAEADIEDALRQAGWRVANRGFISTQFYFAKLFEAVPVASSSS

SEQ ID NO: 21626 - DNA, 1911 bp, Sorghum bicolor
  misc_feature: Ceres ANNOT ID no. 8734792
  misc_feature: Up-regulated in shoot tissues in response to salicylic acid treatment
  misc_feature: Down-regulated in root tissues in response to methyl jasmonate treatment
  misc_feature: Up-regulated in shoot tissues in response to methyl jasmonate treatment
  misc_feature: Encodes the peptide sequence at SEQ ID NO 21627
atgcagatcttccaagtgacgacgatgatcctgcagcctcggttactcacatggttcttctccacactcctgctcacacaactgatgatggcgtctactgcggcggcggagtcgacggtgaaagtgagcaccaccccgatcttccctcagatcccactgggccaggcgaggaaggacttccaagttctgctgcgcgtcgaggcaccgacagcggcggtgcgtcccgaggcgcgcgtccccatcgacgtcgtcgccgtgctcgatgtcagcggcagcatgaatgacccggccgcagtgccaccggagaggaggccgacgacgtcgaggctggacctgctgaagacggccgccaagttcatggtggccaaactcgaagacggagatcgcctctccatcgtagcgttcaatgatcgacccgtcaaagaacttagctccggcttgctgtacatgtccgccgacggccggagaaaagccatgaagagtgtggaccagctcgaggcccgtggcggcaccgcgctcgtgccggccttcgaggaggcggtgaaggtcctggatgggcgggtgggagacggtcgcaaccgcctgggtttcatcgtcctcctcaccgacggcgaggacacgagcgggttcacgctgagcgagcggcgccgtgaggtgatccgtggcgccctcggcaggtaccccgtccacaccttgggcctgggtagggcgcacgatcccgaggtcctgctgtaccttgcccaagagtctcacggcacctattccttcgtcgacgacgacaacatcggcgaggtcgccggcgccctcgccgtgtgcctcggcgggctgagcaccgtcgctgccgtcgacacgcgcgtcgtcctcaaggccgacgagctgaacggggtgcgcatagaccgcgtcgactccggtggccacgacaacagcgtcagctgcggcggagcctcctgcgagatctctgtgggcgtcctgtacgccggcgaggcaaagcatttcgtggtccacctccacgtgccagctgctgcgccatcatcgtcgtcgtcgtcaacggatagcggtcattactgcgacggcatcggcgcctgtgaccgctactaccatcaccgcgacgagcagcgcctgctcgccgtcggctactcgtacagggaccatcccagctcccgggtgatcactgtacaagcacacggcgtgttcgtgaagaggtccccgtcaccggcggtgttagatggcgggtggcaagctcctgttcctgttccctccccggtggtcctgcagcacatcgtccggttggagctgctggaagtggtggccggcgtcgtccacggcgagctgatcaccgacgacagagcgcgtgccgcggacgtgctgcagctcaagtgggaggagttcagagcgtgccaccagttctgggggggcggcctcgacctgatgagcggcctggagaaggaggtgggcggcatggtgagcagcctcagagcaggggtggcggcctacgtctacgcctgggtgtcgagccaccagatgcagcgcgccaccagcatcggctcgccggagaaggcggtcgtcgagttcctgacgccggcgatgcggctcgtcttggaggaggcgcggaagctgccgctgtggcaggctggaacgacggcggcgacgacgaacgtccagcacgtgggcagcggcgtcgacgaattcgagatggtagagtggaggctggaggtgtggtccaaggtaaagcagcagctcatgtcgttccaggagcagacggcggtggacgaggagcagcagcacctggccgccgtcttccaggaggcgtcgctggaggccatcgaccgcgccatgcaccgcgacatttacctggccgcggtttatgcgagcaagctgaggcgatgccactcgtcgggcgccacgaactga

SEQ ID NO: 21627 - protein, 636 aa, Sorghum bicolor
  misc_feature: Ceres ANNOT ID no. 8734792
  misc_feature: Up-regulated in shoot tissues in response to salicylic acid treatment
  misc_feature: Down-regulated in root tissues in response to methyl jasmonate treatment
  misc_feature: Up-regulated in shoot tissues in response to methyl jasmonate treatment
  misc_feature (82)..(269): Pfam ID: VWA Pfam Description: von Willebrand factor type A domain
MQIFQVTTMILQPRLLTWFFSTLLLTQLMMASTAAAESTVKVSTTPIFPQIPLGQARKDFQVLLRVEAPTAAVRPEARVPIDVVAVLDVSGSMNDPAAVPPERRPTTSRLDLLKTAAKFMVAKLEDGDRLSIVAFNDRPVKELSSGLLYMSADGRRKAMKSVDQLEARGGTALVPAFEEAVKVLDGRVGDGRNRLGFIVLLTDGEDTSGFTLSERRREVIRGALGRYPVHTLGLGRAHDPEVLLYLAQESHGTYSFVDDDNIGEVAGALAVCLGGLSTVAAVDTRVVLKADELNGVRIDRVDSGGHDNSVSCGGASCEISVGVLYAGEAKHFVVHLHVPAAAPSSSSSSTDSGHYCDGIGACDRYYHHRDEQRLLAVGYSYRDHPSSRVITVQAHGVFVKRSPSPAVLDGGWQAPVPVPSPVVLQHIVRLELLEVVAGVVHGELITDDRARAADVLQLKWEEFRACHQFWGGGLDLMSGLEKEVGGMVSSLRAGVAAYVYAWVSSHQMQRATSIGSPEKAVVEFLTPAMRLVLEEARKLPLWQAGTTAATTNVQHVGSGVDEFEMVEWRLEVWSKVKQQLMSFQEQTAVDEEQQHLAAVFQEASLEAIDRAMHRDIYLAAVYASKLRRCHSSGATN

SEQ ID NO: 21628 - DNA, 1299 bp, Sorghum bicolor
  misc_feature: Ceres ANNOT ID no. 8734804
  misc_feature: Up-regulated in root tissues in response to methyl jasmonate treatment
  misc_feature: Encodes the peptide sequence at SEQ ID NO 21629
atgccgcaaccgccaccctacctcgaggctacgggaactcggccctatggacagattaggattccgagcggcttagtgatcagtgtcttccgcgcccccgacgggagattgtacaccgatgatcctgatttgggcgctagaggtgacgcaggacggatccccgtcgccggcgttggcagaggatcccctgccgctgcctccacctccacctccaccgttttctatatgggtactctgttggaggctataggtattgtgttggagacccattttgggttggggttcccaaatgggtctcctattggagacagccttaaaaggacttttctcttcaggtctgacaagcttctggtaagtgttgctgagtctgcatcagcacttactctgcaagagcccgaagtttcatcatcagaggtgttgctcgattttgtatcatcagaagaatttgacagtgatgacagcactgacgaggaagaatctgttgatgatttatcacttgggcctaaaattttgatccgagatccaccaaaatggtaccaggtgtattttattaggacggacaggtcgggattgttccacatgtaccctgatctaggtgggccatttcaaagtttagatgaagttgattgtgctattagtcaccatcttgctgaactgcagagccgatcagtgttgaaggagccagaaacacattctactgtggataggctgatacatgagcgcaactattatcctgatggtacaccaaagagaggtcccaaatcacgaaacagaacaaatcctaatgaagagcagcactatttggttcaagctttattagaccagtataatgatagtaaaaatcttttcgggaatcttgcacttgagcttaaaagtctgttgaggcacaaattgatatatggaaagaagaagctgtattatcatttcaatttcacaacaaaggctgggaatctattctttgctgaagtgtcacaaatagaaggagaaggtgcctggaaggccacatgttgttgcatgattgattctaatgaaaatggccagtgcaatacttgtagaaacgatggatgccctgatatgaagcaccccaataatactggtgcatacactgctggtcgcttgaatggatattttcagtatggagaaggggagctaagtgaatccgatgatgatgatgttgaagctgagactgttaggttaagggttctgttaaaggatcttgatgatccagatgctatggagagaatctatcttcgagccgtgcaaaggctgcgtagtagtgggtcggatgcacaagtgtag

SEQ ID NO: 21629 - protein, 432 aa, Sorghum bicolor
  misc_feature: Ceres ANNOT ID no. 8734804
  misc_feature: Up-regulated in root tissues in response to methyl jasmonate treatment
MPQPPPYLEATGTRPYGQIRIPSGLVISVFRAPDGRLYTDDPDLGARGDAGRIPVAGVGRGSPAAASTSTSTVFYMGTLLEAIGIVLETHFGLGFPNGSPIGDSLKRTFLFRSDKLLVSVAESASALTLQEPEVSSSEVLLDFVSSEEFDSDDSTDEEESVDDLSLGPKILIRDPPKWYQVYFIRTDRSGLFHMYPDLGGPFQSLDEVDCAISHHLAELQSRSVLKEPETHSTVDRLIHERNYYPDGTPKRGPKSRNRTNPNEEQHYLVQALLDQYNDSKNLFGNLALELKSLLRHKLIYGKKKLYYHFNFTTKAGNLFFAEVSQIEGEGAWKATCCCMIDSNENGQCNTCRNDGCPDMKHPNNTGAYTAGRLNGYFQYGEGELSESDDDDVEAETVRLRVLLKDLDDPDAMERIYLRAVQRLRSSGSDAQV

SEQ ID NO: 21630 - DNA, 1512 bp, Sorghum bicolor
  misc_feature: Ceres ANNOT ID no. 8734799
  misc_feature: Up-regulated in root tissues in response to methyl jasmonate treatment
  misc_feature: Up-regulated in shoot tissues in response to methyl jasmonate treatment
  misc_feature: Up-regulated in shoot tissues in response to salicylic acid treatment
  misc_feature: Encodes the peptide sequence at SEQ ID NO 21631
atggcgaccaaggccaccgtgtcgctggacctcgccgcgggaccgcgccaccaccaccgcccgagctcggcggcgcgcccgtcagcccgccccgccgcttctgccgccgtccgcgggctgagggcgcgcgggctccgcgtggtccccttggcggcggcggcggcacccgcggtgcaggcgggcgccgaggagatcgtgctgcagcccatcaaggagatctccggcaccgtcaagctgcccgggtccaagtcgctgtccaaccggatcctcctgctcgccgccctgtccgaggggacaacagtggttgataacctgttgaacagtgaggatgttcactacatgcttggggccttgaacactcttgggctctctgtcgaagcagacaaagttgccaaaagagctgttgttgttggctgtggtggaaagttcccagttgaggacgctaaagaggaagtgcagctcttcttggggaatgctggaactgcaatgcggccattgacagcagctgttactgctgctggtggaaatgcaacttacgtgcttgatggagtaccaagaatgagggagagacccatcggcgacttggttgtcggattgaagcagcttggtgcggacgttgattgtttccttggcactgactgcccacccgttcgtatcaatggaattggagggctacctggcggcaaggttaagctctctggctccatcagcagtcagtacttgagtgccttgctgatggctgctcctttggctcttggggatgtggagattgaaatcattgataaattaatctccattccctatgtcgaaatgacattgagattgatggagcgttttggtgtgaaagcagagcattctgatagctgggacagattctacattaagggaggtcaaaaatacaagtcccccaaaaatgcctatgttgaaggtgatgcctcaagtgcaagctatttcttggctggtgctgcaattactggagggactgtgactgttgaaggttgtggcaccaccagtttgcagggtgatgtgaagtttgctgaggtactggagatgatgggagcaaaggttacatggaccgagactagcgtaactgttactggcccaccacggcagccatttgggaggaaacacctcaaggctattgatgttaacatgaacaaaatgcctgatgttgccatgactcttgctgtggttgccctctttgccaatggcccaacagctatcagagacgtggcgtcctggagagtaaaggagaccgagaggatggttgcgatccggacggagctaaccaagctgggagcatcagttgaggaagggccggactactgcatcatcacaccgccagagaagctgaacgtgacggcgatcgacacatacgacgaccacaggatggccatggccttctcccttgccgcctgtgcggaggtccccgtcacgatccgggaccctgggtgcacccggaagaccttccccgactacttcgatgtgctgagcacgttcgtcaagaactaa

SEQ ID NO: 21631 - protein, 503 aa, Sorghum bicolor
  misc_feature: Ceres ANNOT ID no. 8734799
  misc_feature: Up-regulated in root tissues in response to methyl jasmonate treatment
  misc_feature: Up-regulated in shoot tissues in response to methyl jasmonate treatment
  misc_feature: Up-regulated in shoot tissues in response to salicylic acid treatment
  misc_feature (64)..(503): SWISSPROT Homolog: EC 2.5.1.19 3-phosphoshikimate 1-carboxyvinyltransferase
  misc_feature (67)..(497): Pfam ID: EPSP_synthase Pfam Description: EPSP synthase (3-phosphoshikimate 1-carboxyvinyltransferase)
MATKATVSLDLAAGPRHHHRPSSAARPSARPAASAAVRGLRARGLRVVPLAAAAAPAVQAGAEEIVLQPIKEISGTVKLPGSKSLSNRILLLAALSEGTTVVDNLLNSEDVHYMLGALNTLGLSVEADKVAKRAVVVGCGGKFPVEDAKEEVQLFLGNAGTAMRPLTAAVTAAGGNATYVLDGVPRMRERPIGDLVVGLKQLGADVDCFLGTDCPPVRINGIGGLPGGKVKLSGSISSQYLSALLMAAPLALGDVEIEIIDKLISIPYVEMTLRLMERFGVKAEHSDSWDRFYIKGGQKYKSPKNAYVEGDASSASYFLAGAAITGGTVTVEGCGTTSLQGDVKFAEVLEMMGAKVTWTETSVTVTGPPRQPFGRKHLKAIDVNMNKMPDVAMTLAVVALFANGPTAIRDVASWRVKETERMVAIRTELTKLGASVEEGPDYCIITPPEKLNVTAIDTYDDHRMAMAFSLAACAEVPVTIRDPGCTRKTFPDYFDVLSTFVKN

SEQ ID NO: 21632 - DNA, 966 bp, Sorghum bicolor
  misc_feature: Ceres ANNOT ID no. 8734819
  misc_feature: Up-regulated in shoot tissues in response to salicylic acid treatment
  misc_feature: Encodes the peptide sequence at SEQ ID NO 21633
atggatagagggcagaacaggagggatgacgtcttcaggggcagggatccatttgctgggtttggttcccacaggagcttgatttctggcttctttggggggagggatccatttgatgatccattctttacccgtccgtttgggggtcagatgatgggtggcatgtttggacctagcccgtttgggggtcagatgatgggtgagcatgacatgtttggacctagcccttttgggccgatgggagggccttttggggacagggggaaccatgggttcatcgaccaagctccgcctaggggtaacagcagaaggcctgtgatcacagaggttgatgaagatgaaggagaaaacgcagagcacggtaacgagcagcccaaccaagattcttatgttcaggggccagatgatgggagtgatgggacagaaggtggccaagtccagctgcgcagggatctcaatagggctaatagtggagggcagccgcaggctcgtactttcacatatcagagctcttctgtgacgtatggtggtattaatggagcttactacactgcttcaaagactcggcggactggcagtgatgggatcactgtggaagaaagcaaggaagcagatacaacaactaaagaggccactcatcggatctcccgaggaatccatgataagggccattccctgacaaggaaactgaattcagatgggaaggttgacaccacacagacactgcacaacctgaatgaagatgaactagctggatttgaggaatcatggaaggggaatgctggacattacttgcctggctggaaccaaaatgctggtgtacctaatagtgataattctggtaaccgtagctccaatggacgtgaccggcggtcggcctggggctgggcgcttcctggcacggagcaaggccgtgatccaaggcgcaatggaaagccaaagtcacgggtcatcccaatctcctga

SEQ ID NO: 21633 - protein, 321 aa, Sorghum bicolor
  misc_feature: Ceres ANNOT ID no. 8734819
  misc_feature: Up-regulated in shoot tissues in response to salicylic acid treatment
MDRGQNRRDDVFRGRDPFAGFGSHRSLISGFFGGRDPFDDPFFTRPFGGQMMGGMFGPSPFGGQMMGEHDMFGPSPFGPMGGPFGDRGNHGFIDQAPPRGNSRRPVITEVDEDEGENAEHGNEQPNQDSYVQGPDDGSDGTEGGQVQLRRDLNRANSGGQPQARTFTYQSSSVTYGGINGAYYTASKTRRTGSDGITVEESKEADTTTKEATHRISRGIHDKGHSLTRKLNSDGKVDTTQTLHNLNEDELAGFEESWKGNAGHYLPGWNQNAGVPNSDNSGNRSSNGRDRRSAWGWALPGTEQGRDPRRNGKPKSRVIPIS

SEQ ID NO: 21634 - DNA, 1020 bp, Sorghum bicolor
  misc_feature: Ceres ANNOT ID no. 8734826
  misc_feature: Up-regulated in shoot tissues in response to salicylic acid treatment
  misc_feature: Encodes the peptide sequence at SEQ ID NO 21635
atggatagagggcagaacaggagggatgacgtcttcaggggcagggatccatttgctgggtttggttcccacaggagcttgatttctggcttctttggggggagggatcgatttgatgatccattctttacccgtccgtttgggggtcagatgatgggtgagcatggaatgtttggacctggcccgtttgggggtcagatgatgggtgagcatgacatgtttggacctagcccttttgggccgatgggagggccttttggggacatggggaaccatgggttcatcgagcaagctccgcctaggggtaacagcagaaggcctgtgatcacagaggttgatgaggatgaaggagaaaacgcagagcacggtaacaagcagcccaaccaagattcttatgttcaggagccagatgatgggagtgatgggacagaaggtggccaagtccagctgcgcagggatctcaatagtgctaacagtggagggcagccgcaggctcgtactttcacatatcagagctcttctgttacatatggcggtattaatggagcttactacactgcttcaacgactcggcggactggcagtgatgggatcactgtggaagaaagcaaggaagcagatacaacaactaaagaggccactcataggatctcccgaggaatccatgataagggccattccctgacaaggaaactgaattcagatgggaaggttgacaccacacagacaatgcacaacctgaatgaagatgaactagctggatttgaggaatcatggaaggggaatgctggacattacttgcctggctggaaccaaaatgctggtgcaccgaacagtgataattctgtacgggcccgcaccgtacagaaagtggcaaaggagaggagagtcctctgtgacattcagctggtgcctgggactatgcgagctactcctaaagtctcccaccttggactcttagtccctttcctgcgtgagctagtcatatacatctatgagtgtgtgacgatcctatggtag

SEQ ID NO: 21635 - protein, 339 aa, Sorghum bicolor
  misc_feature: Ceres ANNOT ID no. 8734826
  misc_feature: Up-regulated in shoot tissues in response to salicylic acid treatment
MDRGQNRRDDVFRGRDPFAGFGSHRSLISGFFGGRDRFDDPFFTRPFGGQMMGEHGMFGPGPFGGQMMGEHDMFGPSPFGPMGGPFGDMGNHGFIEQAPPRGNSRRPVITEVDEDEGENAEHGNKQPNQDSYVQEPDDGSDGTEGGQVQLRRDLNSANSGGQPQARTFTYQSSSVTYGGINGAYYTASTTRRTGSDGITVEESKEADTTTKEATHRISRGIHDKGHSLTRKLNSDGKVDTTQTMHNLNEDELAGFEESWKGNAGHYLPGWNQNAGAPNSDNSVRARTVQKVAKERRVLCDIQLVPGTMRATPKVSHLGLLVPFLRELVIYIYECVTILW

SEQ ID NO: 21636 - DNA, 786 bp, Sorghum bicolor
  misc_feature: Ceres ANNOT ID no. 8734926
  misc_feature: Down-regulated in shoot tissues in response to salicylic acid treatment
  misc_feature: Encodes the peptide sequence at SEQ ID NO 21637
atggcggcttccgcgctccaccttcgcctcctcccctcgccgccggcgagtgtgaagcttcagcagcgacagctgcgctcgttgagccccagaatacagagacagggtggactatctcgaagattttcgaaagttgtgtcctattacggtctcacaactccaccatataaactggatgctctggaaccttatatgagcaagagaacagttgaacttcactggggtaagcaccatcaagattacgtggatggcttgaataagcagctggctaccagccctctgtatggatacactctggaggatctgataaaagaagcctacaacaatggcaatccattaccagagtataacaatgcagcacaggtctggaaccatcacttcttctgggaatcaatgcaaccagaaggtggtggcgtacctgtgggaggtgtgctgcagcagattgaaaaggattttggctcgtttactaattttagggaagagtttatccgctcagctttacaactattgggatctggttgggtttggcttgtcttgaagagaaatgagagaaaactttcagtggttcatacacgaaatgctatctccccacttgcttttggcgatattccaatcatcagcctagacttatgggagcatgcttactacttagactacaaggatgataggctagcatatattacaaactttatggaccatctcatctcttgggatactgtcactctacgcatgatgcgtgcagagtcttttgtgaaccttggtgagccaactatcccggaggcatga

SEQ ID NO: 21637 - protein, 261 aa, Sorghum bicolor
  misc_feature: Ceres ANNOT ID no. 8734926
  misc_feature: Down-regulated in shoot tissues in response to salicylic acid treatment
  misc_feature (43)..(249): SWISSPROT Homolog: EC 1.15.1.1 Superoxide dismutase
  misc_feature (138)..(244): Pfam ID: Sod_Fe_C Pfam Description: Iron/manganese superoxide dismutases, C-terminal domain
  misc_feature (48)..(133): Pfam ID: Sod_Fe_N Pfam Description: Iron/manganese superoxide dismutases, alpha-hairpin domain
MAASALHLRLLPSPPASVKLQQRQLRSLSPRIQRQGGLSRRFSKVVSYYGLTTPPYKLDALEPYMSKRTVELHWGKHHQDYVDGLNKQLATSPLYGYTLEDLIKEAYNNGNPLPEYNNAAQVWNHHFFWESMQPEGGGVPVGGVLQQIEKDFGSFTNFREEFIRSALQLLGSGWVWLVLKRNERKLSVVHTRNAISPLAFGDIPIISLDLWEHAYYLDYKDDRLAYITNFMDHLISWDTVTLRMMRAESFVNLGEPTIPEA

SEQ ID NO: 21638 - DNA, 1038 bp, Sorghum bicolor
  misc_feature: Ceres ANNOT ID no. 8734997
  misc_feature: Up-regulated in shoot tissues in response to salicylic acid treatment
  misc_feature: Encodes the peptide sequence at SEQ ID NO 21639
atggcgacgccacggaagccaatcaagcttacgctgccgtcccaagagaccaccatcggcaaattcttgacgcatagcgggacgttcaaggacggggatctgcgcgtcaacaaggacggcctccgcatcgtctcgcagagcgagggaggcgaggctcctcctatagagccactggatagtcaactgagcttagatgatctagacgttataaaagtgatcgggaaaggtaacagcggaaatgtgcaattggtccgccacaaatttactggccagttttttgctctgaaggttattcaactaaatattgatgagagtatacgcaaacagattgccaaggagttgaaaataaacttatcaacacagtgccaatatgttgttgtgttctatcagtgcttttatgtcaatggcgccatttcaattgttttggagtacatggatggtggttctcttgccgatttcctaaagactgttaaaaccattccagaggaccaccttgctgcaatttgtaagcaggtattaaaaggactgatacacttgcatcatgagaggcacattatacacagagatctgaaaccatcaaatatattgataaatcataggggtgaagtaaaaatatcggacttcggtgtaagtgccattatttctagttcctctggacgagatacatttaccggcacatacaactacatggcgcctgaaagaatcagtggcaagaagcatggctacatgagtgatatctggagtttggggctagtgattctggaatgtgcaacaggaatttttccatttcctcctcgtgaaagcttttacgaacttcttgaagctgttgttgaacatccaccaccatctgcaccgtcagaagagttttctccgcaattctgctcgttcatttcttcatgtatccagaaggatgctaatgatagaaaatcagcacaagtcttattagatcatccgttcctcagcatgtacgatgacctgcatgttgatcttgcttcctactttactactgctggatctccactcgccaccttcaagtaa

SEQ ID NO: 21639 - protein, 345 aa, Sorghum bicolor
  misc_feature: Ceres ANNOT ID no. 8734997
  misc_feature: Up-regulated in shoot tissues in response to salicylic acid treatment
  misc_feature (8)..(343): SWISSPROT Homolog: EC 2.7.12.2 Mitogen-activated protein kinase kinase
  misc_feature (67)..(320): Pfam ID: Pkinase Pfam Description: Protein kinase domain
MATPRKPIKLTLPSQETTIGKFLTHSGTFKDGDLRVNKDGLRIVSQSEGGEAPPIEPLDSQLSLDDLDVIKVIGKGNSGNVQLVRHKFTGQFFALKVIQLNIDESIRKQIAKELKINLSTQCQYVVVFYQCFYVNGAISIVLEYMDGGSLADFLKTVKTIPEDHLAAICKQVLKGLIHLHHERHIIHRDLKPSNILINHRGEVKISDFGVSAIISSSSGRDTFTGTYNYMAPERISGKKHGYMSDIWSLGLVILECATGIFPFPPRESFYELLEAVVEHPPPSAPSEEFSPQFCSFISSCIQKDANDRKSAQVLLDHPFLSMYDDLHVDLASYFTTAGSPLATFK

SEQ ID NO: 21640 - DNA, 912 bp, Sorghum bicolor
  misc_feature: Ceres ANNOT ID no. 8735039
  misc_feature: Down-regulated in root tissues in response to salicylic acid treatment
  misc_feature: Encodes the peptide sequence at SEQ ID NO 21641
atggcgagtcgcgccgtcgccttgctcgtcgccgtcgcgctcgcggccttcctcctgcaccccgcggcggcagcggccggtcagaagaagccggcgacggccgcgaggcgggaggacatcccctacatccggtgccaggtgtgcgagcggatcgcgcgcgagatctccgcgcaggtagccaagaagcagcaggcgctcccgccctccaagaaggtgccggagatcgagatcatcgagatcgcggagaatgtgtgcaacctgaagaagcaggaggcggattggatgctccggatcgacatcgtcgagaaaggcgacaagctccagcttgttgaacaagatgaggaagggcattgcaatgcagaatgcaagaccattgagcgtgcatgtcaagaggtgataggatatgctgatactgatattgctgagtttgtatacaaaaataacccctcagctgatcagctgatgaaatttctctgcaaagatctttcaaaagcgtgtgccaaggacccgccgccggttccaaaagatcgagtccctggggaaccatttgcaaggaagccatcaaaagatgctgagatggaaaagatattgaaatcaatggagggtatgccgggagctccaagcatgaagatgtactccagggacgatctgatgaaaaataactttggtactgaagacgacgatgatgaagatgatgaagacgaggatgacaacttcccaaagaacttgggaaaagctctgaaagacaagggttctcaaaagaaagacttgaaacagcaagttgtgcaacagttcaaggataccagtaaaaagttgaaagggcatgtaaacaaggtgtccaatgtggtaaagaaatggtggaaaggggcaaagaagcctgccaaatccagcaaaagcaaaactgagctctga

SEQ ID NO: 21641 - protein, 303 aa, Sorghum bicolor
  misc_feature: Ceres ANNOT ID no. 8735039
  misc_feature: Down-regulated in root tissues in response to salicylic acid treatment
MASRAVALLVAVALAAFLLHPAAAAAGQKKPATAARREDIPYIRCQVCERIAREISAQVAKKQQALPPSKKVPEIEIIEIAENVCNLKKQEADWMLRIDIVEKGDKLQLVEQDEEGHCNAECKTIERACQEVIGYADTDIAEFVYKNNPSADQLMKFLCKDLSKACAKDPPPVPKDRVPGEPFARKPSKDAEMEKILKSMEGMPGAPSMKMYSRDDLMKNNFGTEDDDDEDDEDEDDNFPKNLGKALKDKGSQKKDLKQQVVQQFKDTSKKLKGHVNKVSNVVKKWWKGAKKPAKSSKSKTEL

SEQ ID NO: 21642 - DNA, 1923 bp, Sorghum bicolor
  misc_feature: Ceres ANNOT ID no. 8735059
  misc_feature: Up-regulated in root tissues in response to salicylic acid treatment
  misc_feature: Encodes the peptide sequence at SEQ ID NO 21643
atgtcatctttatcttaccggagtgagtacgtgcaccgtacaccacatcgagagcacgaatctcacggctcggccccaccacacctgaaagagaacgcccggccccaccaccaagtgtcaggccgcgtcgttccgcccgctcgccggcatcccattcgttcgtctcctccaccggtcgccgtcaccccgcgtcgccacgcgcccccggccgcccccgtcgccgtcaccgtcaccgttcccctcctaaagccatccggacgccagtcgcaatggatttctccactgcatctgcctcctctccccatggcgccgccgcccgcgtcgcctgctgactcggcacctgatccaaggcccatcgccagcgcgcccgtgcccatcaccgtgccgagcctgcgggaccacacgcaccaccacctggtcgatcgtcgggacacgccgcgggtccgcgcgtgggactgggagccggagcggaaccggcgcggaggggcgatggatggggctgcagcggccaagctggtgtccggcgaggccgggtacgtcttggaagacgtgccgcacgtctcggactacctccccgatctcccgacctacccaaatccattacaagataacccggcatactctgttgtgaagcagtactttgtaaacccagatgacactgtctgccagaagattgttgttcacaaggatggccccagagggaaccacttccgtcgtgccggacctcgccaaagggtatattttgaaccggatgaggtccatgcatgcattgtcacttgtggaggattgtgccctggacttaatactgtgatcagggaaattgtatgtggcttatctgacatgtatggtgtcaccaagatactcgggattcagggtgggtacagaggcttctatgctcgcaacaccatcaccttgactccaaagagtgtaaatgacattcacaaaaggggtggaactattctcggatcatctcgaggaggccatgacactgtgaagatagttgacagtatccaagatcgtggcataaatcaggtctatgtaattggtggtgatggtactcaaaggggtgccggagtgatattcgaagaagttagaagacgcggtctcaaagtttctgttgctgggattccaaagactattgacaatgacatccctgtaattgataagtcatttggtttcgacacagcagtcgaggaggctcaacgtgcaataaatgctgctcatgtggaagctgttagtgctgagaatggtataggccttgtcaagctaatgggccgtcacagtggttttatcgcacattatgctactctggctagcagggacgtggattgttgcttgatcccagaatcaccattctatttggaaggtgaaggtggactttttagatatatagaaaaacgtttgaaggacaatggtcatatggttattgttgttgctgagggtgctggacagaaacttattgctgaaaccatgcagtcaattgggaaagatgcttcaggcaatgagctgcttcttgatgttggtctttggttatctcagaagataaacgaatatttcaagaaaaacaagatgaccattaatctgaagtacatagatccaacgtacatgatacgtgccatccctagcaatgcttctgataatgtgtattgcacactgctggctcacagtgtggttcatggagccatggctggatatactggtttcaccattggtcaagtgaatggtcggcattgctatatccccttctataggataacagagaagcagaacagagtttcgataaccgacaggatgtgggcaaggctgctctcgtcgaccaaccagccaagctttctctgcaacaaagtcgtcgaagaggcaaagaaggaacaggaaagagcagctcaacttttagatggctcgccttcccatcggaaaggttga

SEQ ID NO: 21643 - protein, 640 aa, Sorghum bicolor
  misc_feature: Ceres ANNOT ID no. 8735059
  misc_feature: Up-regulated in root tissues in response to salicylic acid treatment
  misc_feature (257)..(573): SWISSPROT Homolog: EC 2.7.1.11 6-phosphofructokinase
  misc_feature (257)..(506): Pfam ID: PFK Pfam Description: Phosphofructokinase
MSSLSYRSEYVHRTPHREHESHGSAPPHLKENARPHHQVSGRVVPPARRHPIRSSPPPVAVTPRRHAPPAAPVAVTVTVPLLKPSGRQSQWISPLHLPPLPMAPPPASPADSAPDPRPIASAPVPITVPSLRDHTHHHLVDRRDTPRVRAWDWEPERNRRGGAMDGAAAAKLVSGEAGYVLEDVPHVSDYLPDLPTYPNPLQDNPAYSVVKQYFVNPDDTVCQKIVVHKDGPRGNHFRRAGPRQRVYFEPDEVHACIVTCGGLCPGLNTVIREIVCGLSDMYGVTKILGIQGGYRGFYARNTITLTPKSVNDIHKRGGTILGSSRGGHDTVKIVDSIQDRGINQVYVIGGDGTQRGAGVIFEEVRRRGLKVSVAGIPKTIDNDIPVIDKSFGFDTAVEEAQRAINAAHVEAVSAENGIGLVKLMGRHSGFIAHYATLASRDVDCCLIPESPFYLEGEGGLFRYIEKRLKDNGHMVIVVAEGAGQKLIAETMQSIGKDASGNELLLDVGLWLSQKINEYFKKNKMTINLKYIDPTYMIRAIPSNASDNVYCTLLAHSVVHGAMAGYTGFTIGQVNGRHCYIPFYRITEKQNRVSITDRMWARLLSSTNQPSFLCNKVVEEAKKEQERAAQLLDGSPSHRKG

SEQ ID NO: 21644 - DNA, 1002 bp, Sorghum bicolor
  misc_feature: Ceres ANNOT ID no. 8735090
  misc_feature: Up-regulated in shoot tissues in response to methyl jasmonate treatment
  misc_feature: Encodes the peptide sequence at SEQ ID NO 21645
atggggtctggggactggttcaagacgatcatcagcaagaaaaaatcgaaacgggcaaagtcaaagcacgcaaagctctctggtcaagtaacaaatggaagcaaccagacaaatcagaagttaaatggcccttcttccagtagtgacgaccatgaagacaatgcagcactagaggaatgggctgctactcgcattcagaatgcattccggaaatacagggcaaggaagaccctgcgttgtctcaggggagtcaaaagattgcgtgttgtcggtcaggcgaatccggttaagaagcagactgctgccacactgagttacatacagtcttggaacaagttgcagtcagagataagaaaccggcgtgctttcatggtcaccgaagggcgcaacaggaagaagaagcaggagaaccaaatgaaacttgaggcaaaactccataatttgcaggttgaatggaatggaggttcggatactatggatgaaatacttgctaggatacaacaacgagaagaagcagcagtgaagcgtgagcgagccatggcgtacgcgttcaaccatcagtggagagcaaggtctgccacaagtctaggaaacttcagctacgaagtcggcaaaggtggctggggctggagctggatggaccgctggatcgcagcacgaccatgggagccgcgatccttggtccaccctgagaacccaaagaaagcacaggcaaagaaagagaacagcgcaaacccatcagctctcaagctgcaaggctctattaccctaagcaacaatatcaatgaccggaaaacgcctaaaaagaagccattgccttcaccttctcctactgatcagaagaagccatcaccatcgccttcttctgatcagaagaaaccggtaccgaaggagcagagagcaaaggcagctggcactcctccaaaaccaaaggccaaggatatgaagggtagccaagagaaaaagccgcagcagaaagtggctccttcggtcagcgcatga

SEQ ID NO: 21645 - protein, 333 aa, Sorghum bicolor
  misc_feature: Ceres ANNOT ID no. 8735090
  misc_feature: Up-regulated in shoot tissues in response to methyl jasmonate treatment
MGSGDWFKTIISKKKSKRAKSKHAKLSGQVTNGSNQTNQKLNGPSSSSDDHEDNAALEEWAATRIQNAFRKYRARKTLRCLRGVKRLRVVGQANPVKKQTAATLSYIQSWNKLQSEIRNRRAFMVTEGRNRKKKQENQMKLEAKLHNLQVEWNGGSDTMDEILARIQQREEAAVKRERAMAYAFNHQWRARSATSLGNFSYEVGKGGWGWSWMDRWIAARPWEPRSLVHPENPKKAQAKKENSANPSALKLQGSITLSNNINDRKTPKKKPLPSPSPTDQKKPSPSPSSDQKKPVPKEQRAKAAGTPPKPKAKDMKGSQEKKPQQKVAPSVSA

SEQ ID NO: 21646 - DNA, 1191 bp, Sorghum bicolor
  misc_feature: Ceres ANNOT ID no. 8735231
  misc_feature: Down-regulated in root tissues in response to methyl jasmonate treatment
  misc_feature: Down-regulated in shoot tissues in response to methyl jasmonate treatment
  misc_feature: Encodes the peptide sequence at SEQ ID NO 21647
atgccccttgccctctccttcctccacctcccgcccaacactgcccctttccattccttccaagtccatcgcacccaccactcgcaccttcacctctccctccgcactcggcgcgcctcagcgacggtggcagcggccgaagcagagaacccgtccgcatcggcggacgtcgagatggtccgcgggcgggacggcgtttggacggcgcggtccccaactgtggtggtgctgtgggacctcgacaacaagcccccgcgcgggccgccgttcccggccgccaccgccctcatcggcgctgcctccctcctcggccgcgttgtctcggtctccgccttcgccaaccgccacgccttctcccatctccctgtctgggtaaccgccgagcgccgcgaccgccgcgccctcgaccgcgccgagcgcgcgggggtcgtcgccccttccgtgccttactcctgcgccgtctgcggccgccgtttccccacccgccccgatctcacccgccacttccgccagcttcacgagcgcgagcgcaacaagaagctctcccgcctccgctccctcaagggcaagaagcggcagaagttccgcgagcggttcatctccggcaacaccaagtacgaggacgccgcgcgggagctcctcacccccaaggtaggctatgggctcgcctccgagctccgacgcgcgggcgtccacgtccgcaccgtctccgacaagccgcaggccgcggaccacgcgctcaagcgtcaggtgaagcactccgtcgcctgtggtgtcgattgggtggtgctcgtttctgacgactcggatttcaccgatactgtgcggaatgctcgcgctgccgacctgaggacggtcgtggtgggtgacggttgccgcgctcttggcaaggttgctgacatttggttgccatgggaccgagttgagaatggggaggttgatgaggagatgctgaggagttgcacatttgcagagtaccgggaagatcaggaagatgagcggggtgagcagttcataggcgattgggatgcaagtgcctttgatgacgttgttgacgatattgttggaatgagaaccaacttgcttggagctacgacaatatctgccttcgctgatgaggacattacagatggcatatttgatagcatgttttggagtagtgatgacgaggaagaggatggttacttgtga

SEQ ID NO: 21647 - protein, 396 aa, Sorghum bicolor
  misc_feature: Ceres ANNOT ID no. 8735231
  misc_feature: Down-regulated in root tissues in response to methyl jasmonate treatment
  misc_feature: Down-regulated in shoot tissues in response to methyl jasmonate treatment
  misc_feature (150)..(173): Pfam ID: zf-C2H2 Pfam Description: Zinc finger, C2H2 type
MPLALSFLHLPPNTAPFHSFQVHRTHHSHLHLSLRTRRASATVAAAEAENPSASADVEMVRGRDGVWTARSPTVVVLWDLDNKPPRGPPFPAATALIGAASLLGRVVSVSAFANRHAFSHLPVWVTAERRDRRALDRAERAGVVAPSVPYSCAVCGRRFPTRPDLTRHFRQLHERERNKKLSRLRSLKGKKRQKFRERFISGNTKYEDAARELLTPKVGYGLASELRRAGVHVRTVSDKPQAADHALKRQVKHSVACGVDWVVLVSDDSDFTDTVRNARAADLRTVVVGDGCRALGKVADIWLPWDRVENGEVDEEMLRSCTFAEYREDQEDERGEQFIGDWDASAFDDVVDDIVGMRTNLLGATTISAFADEDITDGIFDSMFWSSDDEEEDGYL

SEQ ID NO: 21648 - DNA, 1674 bp, Sorghum bicolor
  misc_feature: Ceres ANNOT ID no. 8735334
  misc_feature: Down-regulated in shoot tissues in response to methyl jasmonate treatment
  misc_feature: Down-regulated in shoot tissues in response to aminocyclopropane carboxylic treatment
  misc_feature: Down-regulated in shoot tissues in response to salicylic acid treatment
  misc_feature: Encodes the peptide sequence at SEQ ID NO 21649
atggctgttggtggaactcaaccggtcctcaggaagtacctaggtgccctcaaggacacaacgactgtgagcttggcaaaagtgaacagtgattataaggaattggacattgcaattgtcaaggccacaaaccatgttgagcgtccatcaaaggagaagtacataagagaaatttttcattccatttctgctgctaggccacgagcagatgtagcttattgcattcatgcccttgctagacgtctttcaaagacacgcaattgggcggttgcgctaaagacattgattgtcattcatcgtgcccttcgggaagttgatcccacttttcgtgaagagcttatcaattatggcagatctaggtcccatatgttgaacatggcctactttaaagatgactctagtgcagaagcttgggattattctgcatgggtgcgcatttatgctttatatttagaggagaggctcgaatgtttccgagtgttgaaatatgatgtagaaactgatcctccgaggactaaggatcttgatactgttgctttgcttgatcatctgccaccattgcagcaactcctttttcggcttcttgcttgccagccacaaggagcatcgtcttacaatgttataatccagcatgcactctcgatggttgctttagagagtgttaagatctacactgcgattagtgatggaacaatcaatctggttgacaagttctttgagatgcaaagaaatgatgctgttagggcacttgatgtatacaaaagagcaactaaccaggctgaacgactttcagaattttatgaagtgtgtaaaactatacacattgggcgtggtgagaaattccagaagattgagcagactatggaggagtatgtaagagatgctccgacaggtcaaaaagaaaaggctgtactagcgatagaatataaaaaagagccagaggaggaagaaaaaccggcttcacctcctccggctccggagccagaaccggaacaagaacctgagccagaacccgaaccagtgaaagaggaagcacctgaagctgaaccagatttgctgggtctaaatgaaccaaaccctgctgcgactgcgatagaagagcagaatgctttggcactagcaattgttccgatagatgatgttccgaaagctgctcctacctttgaaaatggagtcacaggctgggaactagcccttgtgactgcaccaagttcaaatgagaccgccgttgccccaagcaagaaactggccggtggtctggacttgctgaccctggacagcctctacgacgaggcgaaccggagagcgagccagccggcggcaagctacaacccctgggatgcgaccccggccaccgccgcgcctgtcccgatgctgaccatggcgccggccatgcacgacccgttctacgcctcgaacgggtacgcggcgcctcacggcgtgcagatggcggcgatggcgcagcagcagcaggccttcatgttgcagcagcagatgatgacaatggccccggcgccggcaccggtggtccaccacccgatgcagatgcagcagaaccccgcgaacccgttcggcaaccccttcgcggccgccggcgcgcacccttacggcgccgccgccgccggcatgccgctccacgctggccccggcaacgtctacacggggctgatctag

SEQ ID NO: 21649 - protein, 557 aa, Sorghum bicolor
  misc_feature: Ceres ANNOT ID no. 8735334
  misc_feature: Down-regulated in shoot tissues in response to methyl jasmonate treatment
  misc_feature: Down-regulated in shoot tissues in response to aminocyclopropane carboxylic treatment
  misc_feature: Down-regulated in shoot tissues in response to salicylic acid treatment
  misc_feature (32)..(295): Pfam ID: ANTH Pfam Description: ANTH domain
MAVGGTQPVLRKYLGALKDTTTVSLAKVNSDYKELDIAIVKATNHVERPSKEKYIREIFHSISAARPRADVAYCIHALARRLSKTRNWAVALKTLIVIHRALREVDPTFREELINYGRSRSHMLNMAYFKDDSSAEAWDYSAWVRIYALYLEERLECFRVLKYDVETDPPRTKDLDTVALLDHLPPLQQLLFRLLACQPQGASSYNVIIQHALSMVALESVKIYTAISDGTINLVDKFFEMQRNDAVRALDVYKRATNQAERLSEFYEVCKTIHIGRGEKFQKIEQTMEEYVRDAPTGQKEKAVLAIEYKKEPEEEEKPASPPPAPEPEPEQEPEPEPEPVKEEAPEAEPDLLGLNEPNPAATAIEEQNALALAIVPIDDVPKAAPTFENGVTGWELALVTAPSSNETAVAPSKKLAGGLDLLTLDSLYDEANRRASQPAASYNPWDATPATAAPVPMLTMAPAMHDPFYASNGYAAPHGVQMAAMAQQQQAFMLQQQMMTMAPAPAPVVHHPMQMQQNPANPFGNPFAAAGAHPYGAAAAGMPLHAGPGNVYTGLI

SEQ ID NO: 21650 - DNA, 1443 bp, Sorghum bicolor
  misc_feature: Ceres ANNOT ID no. 8735490
  misc_feature: Down-regulated in root tissues in response to salicylic acid treatment
  misc_feature: Encodes the peptide sequence at SEQ ID NO 21651
atggcctcccgatccgccgggcagctcttcctcgccctcctactcctggccgtcgtcgtcgcggcctccgcttccgacgccgacgccgccgccgggggcgccaagtggcgggaggagcaggcgcgggaccgggtgccgcgggtgcccgggcaggccttcaacaccagcttcgcgcagtacgccgggtacgtgaccgtcagcgagcagcgcggcgccgcgctcttctactggttcttcgaggccgacaaggacccggcgtccaagcccctcgtgctctggctcaacggagggcctggatgctcgtccattgcttttggactcggagaagaagtaggacctttccatgttaatgcagatgggaagggggtgcatgtcaatccttattcttggaacaaagttgcaaatttgctgttccttgattcacctgttggtgttggttactcctattcaaacacctctgatgatgctttaaaaaatggggatgcgagaactgccacggattcattggcattcttactgaagtggcttgaacggtttcctcagtacaaggaacgtgaattttatttgacaggagagagttatgctggtcactatgttcctcaactggctcaagccataaaaaggcaccatgaggctactggtgacaaatcaattaatctaaagggctacatggtaggaaatgctctcactgatgatttccatgaccactatggaatatttcaattcatgtggactactggcctgatctctgatcaaacatacaagctgctgaatgttttctgtgactacgagtcctttgtgcattcatctccacagtgtgataagattcttgatattgctagcactgaagctggaaacattgattcatatagcatcttcacacctacatgccatgcatcttttgcctcctcgaagaacaaagtgatgaaaaggctacgttctgctggaaaaatgggagagcagtatgatccatgcactgagaagcattcaattgtatacttcaatctagctgaggttcagaaggcacttcatgttaatccagtcattggaaaatcaaaatgggagacctgcagtgaagctgttaatactcattggggggactgtgaaagatctgtgctgcatatatatcatgagcttatacagtatggccttcgtatatgggtgttcagtggagatacagatgcagtgattccagtgacttcaactagatacagcatcgatgctctcaagcttccaacaataactccatggcatgcttggtacgacgatgacggtgaggtcggtggatggactcaagggtataagggactcaattttgtgaccgtgaggggagcaggtcatgaagttcctcttcatcgacccaaacaggctctcacactaatcaaatcattcttggctgggagcccaatgcctgtgcaatccagtacacatagcgacatgtaa

SEQ ID NO: 21651 - protein, 480 aa, Sorghum bicolor
  misc_feature: Ceres ANNOT ID no. 8735490
  misc_feature: Down-regulated in root tissues in response to salicylic acid treatment
  misc_feature (41)..(474): SWISSPROT Homolog: EC 3.4.16.6 Carboxypeptidase D
  misc_feature (49)..(467): Pfam ID: Peptidase_S10 Pfam Description: Serine carboxypeptidase
MASRSAGQLFLALLLLAVVVAASASDADAAAGGAKWREEQARDRVPRVPGQAFNTSFAQYAGYVTVSEQRGAALFYWFFEADKDPASKPLVLWLNGGPGCSSIAFGLGEEVGPFHVNADGKGVHVNPYSWNKVANLLFLDSPVGVGYSYSNTSDDALKNGDARTATDSLAFLLKWLERFPQYKEREFYLTGESYAGHYVPQLAQAIKRHHEATGDKSINLKGYMVGNALTDDFHDHYGIFQFMWTTGLISDQTYKLLNVFCDYESFVHSSPQCDKILDIASTEAGNIDSYSIFTPTCHASFASSKNKVMKRLRSAGKMGEQYDPCTEKHSIVYFNLAEVQKALHVNPVIGKSKWETCSEAVNTHWGDCERSVLHIYHELIQYGLRIWVFSGDTDAVIPVTSTRYSIDALKLPTITPWHAWYDDDGEVGGWTQGYKGLNFVTVRGAGHEVPLHRPKQALTLIKSFLAGSPMPVQSSTHSDM

SEQ ID NO: 21652 - DNA, 1578 bp, Sorghum bicolor
  misc_feature: Ceres ANNOT ID no. 8735529
  misc_feature: Down-regulated in shoot tissues in response to methyl jasmonate treatment
  misc_feature: Down-regulated in root tissues in response to methyl jasmonate treatment
  misc_feature: Encodes the peptide sequence at SEQ ID NO 21653
atgggcacgggaggtgtcgcgctggtcgccgccgccctcgccgtggtggtggtcaccaggctatggacggctctgctccacctggtgtggcgcccctacgccgtggcgagggcgttcgcgcggcagggcgtccgcgggccgccgtaccgtgtcttggtgggcaacagcaaggaggttcaggcgatgcgcgcggcgacgagcggcgacacgctggagctcacctcccacgactacatcccgcgcgtgatgccgcagtaccgcgcgtggatgtcgctctacggcaaggtgttcctgacgtggtccagctcgactcctgcgctgttcgcgggcagctacgacatggtgaagcggatcctctccgacaagtcggggctgtacggcaagacggacccgggccccaccatactgtccctgatgggcatgggcctcgccttcacaaacggcgacgactggtcgcgccaccgccgcgtcgtgcaccctgcgttcgccatggacaagctcaaggcgatgacgggggcgatggcggcgtgcgcggcggaggtgatacggacgtgggaggcgcgcgccgccgcgagcagggagaaggcggtgacggtggaggtagggcagcagttcacggagctcaccgccgacgtgatctcgcacacggcgttcggcagcagctaccggcaggggaaagaggtgttcctggcgcagcgggagctccagttcatcgccttcgcctccatcaacagcgtgcgcgtgccgggcatgcagtacgtgcccaccaaggccaacatgcgccgctggaagctcgagcgcacggtgcggggcacgctcatggccatcatcggcgagcgcctcgccgctgcaaagcaggcgaggggctacggcagcgacctgctcggcctcatgttggaggccaacgccgccggcgacggcggcggcaagaggcagcagcaggccatgagcatggacgaaatcatcgacgagtgcaagaccttcttcttcgccggccacgacacgaccgcgcacctcctcacttgggccctgttcctcctcgggacgcacccggagtggcagcagcggctcagggaggaggtgatccgggagtgcggcggcggcgaggtgcccctccgcggcgacgccctcaacaagctcaagctcgtgaccatggtgctttacgagacgctccggctgtacggcgcggtgccgatgatcgcgagacaggtgaccgcggacgcggacctctgcggcgtggatgtgcccaagggcaccatcctgttgatcccgatcgcgatgcttcaccgcgacgaggaggtgtggggcgcgaacgccggcgctttcaacccgctccggttccgggatggcatgggcagggcggcggcgcacccgaacgcgctactgtccttctccttgggcccgcggtcgtgcatcgggcaggacttcgcgatgctggaggccaaggcgacgctggcactcatcctccggcggttcgccttcgaggtggcgccggagtacgtgcacgcgccggtcgacctcctgactctgcaaccgtcgaaagggctcccgatcgtgctcaagctcttggatgtgtag

SEQ ID NO: 21653 - protein, 525 aa, Sorghum bicolor
  misc_feature: Ceres ANNOT ID no. 8735529
  misc_feature: Down-regulated in shoot tissues in response to methyl jasmonate treatment
  misc_feature: Down-regulated in root tissues in response to methyl jasmonate treatment
  misc_feature (30)..(524): SWISSPROT Homolog: EC 1.3.3.9 Secologanin synthase
  misc_feature (44)..(519): Pfam ID: p450 Pfam Description: Cytochrome P450
MGTGGVALVAAALAVVVVTRLWTALLHLVWRPYAVARAFARQGVRGPPYRVLVGNSKEVQAMRAATSGDTLELTSHDYIPRVMPQYRAWMSLYGKVFLTWSSSTPALFAGSYDMVKRILSDKSGLYGKTDPGPTILSLMGMGLAFTNGDDWSRHRRVVHPAFAMDKLKAMTGAMAACAAEVIRTWEARAAASREKAVTVEVGQQFTELTADVISHTAFGSSYRQGKEVFLAQRELQFIAFASINSVRVPGMQYVPTKANMRRWKLERTVRGTLMAIIGERLAAAKQARGYGSDLLGLMLEANAAGDGGGKRQQQAMSMDEIIDECKTFFFAGHDTTAHLLTWALFLLGTHPEWQQRLREEVIRECGGGEVPLRGDALNKLKLVTMVLYETLRLYGAVPMIARQVTADADLCGVDVPKGTILLIPIAMLHRDEEVWGANAGAFNPLRFRDGMGRAAAHPNALLSFSLGPRSCIGQDFAMLEAKATLALILRRFAFEVAPEYVHAPVDLLTLQPSKGLPIVLKLLDV

SEQ ID NO: 21654 - DNA, 4596 bp, Sorghum bicolor
  misc_feature: Ceres ANNOT ID no. 8735608
  misc_feature: Down-regulated in root tissues in response to methyl jasmonate treatment
  misc_feature: Down-regulated in root tissues in response to aminocyclopropane carboxylic treatment
  misc_feature: Down-regulated in shoot tissues in response to aminocyclopropane carboxylic treatment
  misc_feature: Down-regulated in shoot tissues in response to methyl jasmonate treatment
  misc_feature: Down-regulated in shoot tissues in response to salicylic acid treatment
  misc_feature: Encodes the peptide sequence at SEQ ID NO 21655
atggcagtctcctcctcaccattacccttcctctcctcttcttcctccttcacgtgccatctccgccgagcgggcaccgccaccgctacggcagcgtcatctgcttccgaagacttcgactaccctctcgccgacccttccgttcgatggcctcacctccgcttcccgcacctccccgcgccgcgcttccccgccaccgtcaccgcggcacctccggtccccgccagaccaccaccccaggaagtggaggaccccgcggcgacctccgcctccgcctccgcaccttcactcgtggagccactggacgcgcgtgctcatcgcgggagggtgaagaagctgagcaagctcgcgctgcggcgggcgcaggactggcgcgcgcgcgtggccgggctcgcggacgccgtcctcgcgctgcctcccggggcgcccgtcgacgacgtgctcgacggcgctcgggcaacgccggacgaggtcgccttcgtcgtgcgcgccgtcggggagagctcctggcggcgcgcgctggatgccttcgagtggctcgcccggagcaccgccccggcttcacgcgccgtcgccgtcgtccttggcgtcctcggccgcgcgcgccaggattcgatcgcggaggaggtcttcctccgcttcgctggagagggcgccactgttcaggtgttcaatgccatgatgggcgtttatgcacgctctggccgattcgatgacgcacggcagctgcttgacacaatgcacgaccgggggatcgatcctgacctcgtcagcttcaatactctaatcaatgccaggtctaagtctgggtgtttggctgctggcgtcgcccttgacctcctatttgaagtccgacaatctgggctaaggccagatgttatcacttataacacgctcatcagtgcttgctcacagagttctaatctggaagatgctgtgacggtgtttgaggagatgatagcttcagagtgccggccagatttgtggacatacaatgcaatggtgtcggtgcatggccggtgtgggaaggctgaagaggctgagcggctgtttggggagctggtggagaagggttttatgcctgacgcggtcacttacaattctcttctctatgcttttgcaaaggaagggaatgttgacaaggtggagcacacatgtgaggaattggttaaggctgggttcaagaagaatgaaataacatacaacaccatgattcatatgtatgggaaaatgggcaggcttgacttagcagtgggtctgtatgatgagatgagggctgtgggctgtactccagatgctgtgacgtatacggtcatgattgattctttggggaagatggataagattgctgaggcagggaaggtactggaggacatggcagatgcgggattgaagccaactttagtagcttttagtgctctgatttgtgcatatgccaaaggtgggaggcgggctgacgcggagaagacatttgattgcatgattgcatcaggtgtcaaacctgatcgtttagcatacttggttatgctggatgtttttgcaaggtcaggtgagacggaaaaaatgttgcgtctgtatcgaacaatgatgaatgataattataggccagatgatgacatgtaccaggtcttgcttgttgcacttgcaaaggaagataagtgtgaggagattgaagaaattatccaagacatggaattactttgtcaaatgagtctgggagtaatatcaacaatacttatcaaggcgaggtgtgtttcccagggtggtaaactattaaaaaaggcatgtctccagggatacaagcctgatgctaagagcttatggtccattatgaatgcatatgtaatgacagaaaagcatgaggaaggtctctctttgcttgaatgcatccgtgaccatgtttccagttcccaggatttgatatcagaatgttccatcatacttttatgcagaaaacagacgagcatttctgcctatgaacagtacagtcaaaggttaatgttaaaataccctggtcaaaactgtaacctgtatgagcacttgattacatgcctcgtggaagctgagttattttctgaagcttgtcaagtgttctgcgacatgcagtttattggcatagaagcttctaaaaatatttacgagagtataatttccacctactgtaaactgggatttccagaaacagcacatgggttgatggatgatgctttgcaatctggtattccattaaacattctctcgtgtagggtaattataattgaagcatatgggaatataaaactctggcagcaagcagaaatcttggtgaaagggctgaggcaagcatcaggtatcgatagaaggatttggaatgctttgatacatgcatatgcagagagtggactttatgagaaagcaagggcagtctttgataatatgattaaaacaggtcctctgccaactgttgattcagttaatggaatgatgagggcattgattgttgatggcagattggatgagttgtatgtagttgtaggagagcttcaagatatggacttcaagatcagcaaaagtacagtgctccttatgcttgatgcttttgcaaaagctggggatgtattcgaggtaatgaaaatctataatggaatgaaggctgcaggatacctgccaaatatgcacctctacagaagtatgacttccttgctctgccatcacaaccggttcagggatgttgagttgatgattgcagagatggagggagcagggttcaagccagatctttctatatttaattctcttcttaatatgtacaccgctgctgggaactttgataggacaacacaagtatatcaaagtattctcgaagctggcttagagcctgatgaagatacatacaatacattgatagtcatgtactgtagaagcttgaggccagaagaaggttttacactattgaatgaaatgggcaaacgaggcctgacaccaaagttgcagtcctacaaaagcttgcttgctgcatctgcaaaagcagagctgagggagcaagctgaccagctttttgaggaaatgcgatctaagagttatcaattgaatagatctatctatcatatgatgatgaaaatttacaggaatgctggcaaccactccaaagctgagaacttgctggcagtaatgaaagaggatggcatagagccaacaattgccactatgcatatcctcatgacttcttacgggactgctgggcaacctcacgaagctgagaatgtactgaacagtttgaaatcttccagtttggaagtcagcacgttaccatacagtactgtctttgatgcctacctgaaaaacggtgactacgatcttggaataaaaaaactgctggaaatgaaaagagatggtgtagaaccagatcatcaagtttggacatgtttcattagggcagctagtttgtgtgagcaaactgctgatgctattcttcttctaaagtctctacaggattgtggatttgacctccccattaggctcctgactgaaaggacaccatcactgttaagtgagatcgccaattatctggaagagcttgaagcattagaagattctgctgctttgaactttgtaaatgcagtagaagatttgttgtgggcatttgaatgccgagcaacagcttcacggattttccaattggcagtagagagaagcatataccgcgataatgtctttcgtgtggcacaaaaggactggggcgctgacttccggaagctgtctgctggggctgcacttgttggtcttacattgtggcttgatcacatgcaaggttcaccagaatctcccaaatctgttgtactggtcacaggggagggggaatataacatggtatccctgcgtaaaacaatcagagcctaccttttggaaatgggctccccgttcttaccatgtagagctcggtcaggtcgctttgtggtaaaggcctactctcttaagatgtggctgaaagattctcctttctgcatggaccttgagttaaaagatgctccagctcttcctaaattaaactcaatgaagctgattgaaggatatttcatgagagctggtcttgtatcggcatttaaagatatacatgagaaacttggggaagtatggccaaaaaagttttccaggttagctcttttgtcagaagaatgtagggacgaggttatcaaggctgatataaaaggaaggaaagaaaaactggagagaatgaaaaagaagggtattgttacagcaagaaaatctaaaagaagagcacaaagaggaaagtttgttagggaacaggaacaaaacatgaaagtgcgcacctacgcagtgtgccttgggctgcgctcgaatgctttcatgtggagcgcactgtgtggccttgccatggaagctgggagcttctacaaacaaatggtgagggtcggtgagaaggaaaatgactcctgcttcactaatgtgctcagattcggtggccttgtgattctcgagcatggcaagatggttcgttgtcgcatcatgaagtctaggttttgttttcagatgatgtacttcaagtgtggcaggctgacagctcagttaatactcagattgtcgaggacacaatga

SEQ ID NO: 21655 - protein, 1531 aa, Sorghum bicolor
  misc_feature: Ceres ANNOT ID no. 8735608
  misc_feature: Down-regulated in root tissues in response to methyl jasmonate treatment
  misc_feature: Down-regulated in root tissues in response to aminocyclopropane carboxylic treatment
  misc_feature: Down-regulated in shoot tissues in response to aminocyclopropane carboxylic treatment
  misc_feature: Down-regulated in shoot tissues in response to methyl jasmonate treatment
  misc_feature: Down-regulated in shoot tissues in response to salicylic acid treatment
  misc_feature (294)..(328): Pfam ID: PPR Pfam Description: PPR repeat
  misc_feature (222)..(256): Pfam ID: PPR Pfam Description: PPR repeat
  misc_feature (399)..(433): Pfam ID: PPR Pfam Description: PPR repeat
  misc_feature (329)..(363): Pfam ID: PPR Pfam Description: PPR repeat
  misc_feature (434)..(468): Pfam ID: PPR Pfam Description: PPR repeat
  misc_feature (469)..(503): Pfam ID: PPR Pfam Description: PPR repeat
  misc_feature (364)..(398): Pfam ID: PPR Pfam Description: PPR repeat
  misc_feature (504)..(538): Pfam ID: PPR Pfam Description: PPR repeat
  misc_feature (781)..(815): Pfam ID: PPR Pfam Description: PPR repeat
  misc_feature (956)..(990): Pfam ID: PPR Pfam Description: PPR repeat
  misc_feature (1026)..(1060): Pfam ID: PPR Pfam Description: PPR repeat
  misc_feature (851)..(885): Pfam ID: PPR Pfam Description: PPR repeat
  misc_feature (921)..(955): Pfam ID: PPR Pfam Description: PPR repeat
  misc_feature (1096)..(1130): Pfam ID: PPR Pfam Description: PPR repeat
MAVSSSPLPFLSSSSSFTCHLRRAGTATATAASSASEDFDYPLADPSVRWPHLRFPHLPAPRFPATVTAAPPVPARPPPQEVEDPAATSASASAPSLVEPLDARAHRGRVKKLSKLALRRAQDWRARVAGLADAVLALPPGAPVDDVLDGARATPDEVAFVVRAVGESSWRRALDAFEWLARSTAPASRAVAVVLGVLGRARQDSIAEEVFLRFAGEGATVQVFNAMMGVYARSGRFDDARQLLDTMHDRGIDPDLVSFNTLINARSKSGCLAAGVALDLLFEVRQSGLRPDVITYNTLISACSQSSNLEDAVTVFEEMIASECRPDLWTYNAMVSVHGRCGKAEEAERLFGELVEKGFMPDAVTYNSLLYAFAKEGNVDKVEHTCEELVKAGFKKNEITYNTMIHMYGKMGRLDLAVGLYDEMRAVGCTPDAVTYTVMIDSLGKMDKIAEAGKVLEDMADAGLKPTLVAFSALICAYAKGGRRADAEKTFDCMIASGVKPDRLAYLVMLDVFARSGETEKMLRLYRTMMNDNYRPDDDMYQVLLVALAKEDKCEEIEEIIQDMELLCQMSLGVISTILIKARCVSQGGKLLKKACLQGYKPDAKSLWSIMNAYVMTEKHEEGLSLLECIRDHVSSSQDLISECSIILLCRKQTSISAYEQYSQRLMLKYPGQNCNLYEHLITCLVEAELFSEACQVFCDMQFIGIEASKNIYESIISTYCKLGFPETAHGLMDDALQSGIPLNILSCRVIIIEAYGNIKLWQQAEILVKGLRQASGIDRRIWNALIHAYAESGLYEKARAVFDNMIKTGPLPTVDSVNGMMRALIVDGRLDELYVVVGELQDMDFKISKSTVLLMLDAFAKAGDVFEVMKIYNGMKAAGYLPNMHLYRSMTSLLCHHNRFRDVELMIAEMEGAGFKPDLSIFNSLLNMYTAAGNFDRTTQVYQSILEAGLEPDEDTYNTLIVMYCRSLRPEEGFTLLNEMGKRGLTPKLQSYKSLLAASAKAELREQADQLFEEMRSKSYQLNRSIYHMMMKIYRNAGNHSKAENLLAVMKEDGIEPTIATMHILMTSYGTAGQPHEAENVLNSLKSSSLEVSTLPYSTVFDAYLKNGDYDLGIKKLLEMKRDGVEPDHQVWTCFIRAASLCEQTADAILLLKSLQDCGFDLPIRLLTERTPSLLSEIANYLEELEALEDSAALNFVNAVEDLLWAFECRATASRIFQLAVERSIYRDNVFRVAQKDWGADFRKLSAGAALVGLTLWLDHMQGSPESPKSVVLVTGEGEYNMVSLRKTIRAYLLEMGSPFLPCRARSGRFVVKAYSLKMWLKDSPFCMDLELKDAPALPKLNSMKLIEGYFMRAGLVSAFKDIHEKLGEVWPKKFSRLALLSEECRDEVIKADIKGRKEKLERMKKKGIVTARKSKRRAQRGKFVREQEQNMKVRTYAVCLGLRSNAFMWSALCGLAMEAGSFYKQMVRVGEKENDSCFTNVLRFGGLVILEHGKMVRCRIMKSRFCFQMMYFKCGRLTAQLILRLSRTQ

SEQ ID NO: 21656 - DNA, 2211 bp, Sorghum bicolor
  misc_feature: Ceres ANNOT ID no. 8736026
  misc_feature: Up-regulated in root tissues in response to salicylic acid treatment
  misc_feature: Encodes the peptide sequence at SEQ ID NO 21657
atgtcgtcggcggccgtgtcgtccgcttcctccaccttcttcctcgcgctcgcctcctcggcctccccggggggacgcaggcgggcaagggtcggctcgccgccgttccacaccggcgccggtccgaatttcgcgttctggcgggcgccgccgcgcgtgccccgtgacgcggcgctggtgcgcgcggaggccgaaggcgggggcaaggacgcgccgccggagaggagtggcgacgccgccgccgccgccgccagcaggttgccccgcgccgctcggcgcaaggcggtctccaaacggagggatcctcttcagccggtcggccgttacggctcatccggaacggggaacacggccaggagcggcgccgcgaccgcgtccacccagaacgccgcgttggcggccgttgagatcaagtccatcgtcgccgcgccgccgacgagcatagtgaagttcccagccccgggatacagggtgatccttccctctggggacatagcgccggagactgtcgtcccagccccgaagccactgccactgcatggatcgcctggggttgatggagattattcaaatggggttgcacctcctccagctgagccagtagtacaggaggccacttgggatttcaagaaatacatcggttttgaggagcctgtggaagccaaggatgattccggggttgctgcagatggtgctgattcttttgaacactacgagaacaatgattctgggcctttggccggggagaatgtcatgaacgtcatcgtggtggctgctgaatgtggccttggagatgttgtgggagctttacccaaggctttagcgagaagaggacatcgtgttatggttgtggttccaaggtatggggactatgtggaagccttcgatatgggaatccggaaatactacaaagctgcaggacaggacttggaagtgaactatttccatgcatttatcgatggagtagattttgtgttcattgatgcacctctcttccggcaccgtcaaaatgacatatacgggggaagtagacaggaaattttgaagcgcatgattttgttctgcaaggttgctgttgaggttccttggcatgttccatgtggcggtgtgtgctacggagatggaaatttggtgttcattgccaatgattggcacactgcactcctgcctgtttatctgaaggcatattacagagaccatgggttaatgcagtacactcgctccattcttgtcatacataacatcgctcaccagggtcgtggtcctgtagctgaattcccgtacatggacttgcctgaacactacctccaacatttcgagctgtacgaccccgtcggtggtgagcacgccaacatctttgccgcgggtctgaagatggcagaccgggtggtgacggtcagccggggctacctgtgggagctgaagacagtggaaggtggctggggcctccacgacatcatccgttccaacgactggaagatcaatggcatcgtgaacggcatcgaccaccaggagtggaaccccaaggtggacgtgcacctgcggtcggacgggtacaccaactactccctcgagacactggacgccggaaagcggcagtgcaaggcggccctgcagcgggagctgggcctggaagtgcgcgacgacgtgccgctgctcggcttcatcgggcgcctggacgggcagaagggcgtggacatcatcggggacgcgatgccgtggatcgcggggcaggacgtgcagctggtgatgctgggcaccgggcgcgccgacctggagcggatgctgcagcacctggagcgggagcacccaagcaaggtgcgcgggtgggtggggttctcggtgcccatggcgcaccgcatcaccgcgggcgccgacgtgctggtgatgccctcccggttcgagccatgcgggctgaaccagctctacgccatggcgtacggcaccgtccccgtggtgcacgccgtcggcgggctcagggacaccgtggcgccgttcgacccgttcggcgacgccgggctcggctggactttcgaccgcgccgaggtcaacaagctgatcgaggcgctcaggcactgcctcgacacgtaccggaactacggggagagctggaagagcatccaggcgcgcggcatggcacaggacctcagctgggaccacgcggcggagctctacgaggacgtcctagtcaaggccaagtaccagtggtga

SEQ ID NO: 21657 - protein, 736 aa, Sorghum bicolor
  misc_feature: Ceres ANNOT ID no. 8736026
  misc_feature: Up-regulated in root tissues in response to salicylic acid treatment
  misc_feature (206)..(736): SWISSPROT Homolog: EC 2.4.1.21 Starch synthase
  misc_feature (253)..(489): Pfam ID: Glyco_transf_5 Pfam Description: Starch synthase catalytic domain
  misc_feature (537)..(707): Pfam ID: Glycos_transf_1 Pfam Description: Glycosyl transferases group 1
MSSAAVSSASSTFFLALASSASPGGRRRARVGSPPFHTGAGPNFAFWRAPPRVPRDAALVRAEAEGGGKDAPPERSGDAAAAAASRLPRAARRKAVSKRRDPLQPVGRYGSSGTGNTARSGAATASTQNAALAAVEIKSIVAAPPTSIVKFPAPGYRVILPSGDIAPETVVPAPKPLPLHGSPGVDGDYSNGVAPPPAEPVVQEATWDFKKYIGFEEPVEAKDDSGVAADGADSFEHYENNDSGPLAGENVMNVIVVAAECGLGDVVGALPKALARRGHRVMVVVPRYGDYVEAFDMGIRKYYKAAGQDLEVNYFHAFIDGVDFVFIDAPLFRHRQNDIYGGSRQEILKRMILFCKVAVEVPWHVPCGGVCYGDGNLVFIANDWHTALLPVYLKAYYRDHGLMQYTRSILVIHNIAHQGRGPVAEFPYMDLPEHYLQHFELYDPVGGEHANIFAAGLKMADRVVTVSRGYLWELKTVEGGWGLHDIIRSNDWKINGIVNGIDHQEWNPKVDVHLRSDGYTNYSLETLDAGKRQCKAALQRELGLEVRDDVPLLGFIGRLDGQKGVDIIGDAMPWIAGQDVQLVMLGTGRADLERMLQHLEREHPSKVRGWVGFSVPMAHRITAGADVLVMPSRFEPCGLNQLYAMAYGTVPVVHAVGGLRDTVAPFDPFGDAGLGWTFDRAEVNKLIEALRHCLDTYRNYGESWKSIQARGMAQDLSWDHAAELYEDVLVKAKYQW

SEQ ID NO: 21658 - DNA, 1467 bp, Sorghum bicolor
  misc_feature: Ceres ANNOT ID no. 8736083
  misc_feature: Up-regulated in shoot tissues in response to methyl jasmonate treatment
  misc_feature: Up-regulated in root tissues in response to methyl jasmonate treatment
  misc_feature: Encodes the peptide sequence at SEQ ID NO 21659
atgccacttcctacctctccttcctcgagcccaaggctgctgcgcagcagcagcagcgagtggcacgccgtggtgcagaggaacgtcagatcctcgctgctgctgctcctggtgctctccaccatcttcgtcttctccgtcctctactcgtcgcacggcttcggcgtcggaacgacggctgaccaggcgctcacgcagaggcagagcacccatcatggagccatcgatcgttttgtgcccgggcaggaggaagccgatgaaccgatagcagtccctgccgagaacaatgaggcgtcagaacagaacctagcttcagacatctcgttgccatcagcaaacacgtcaacagctcccgcagttcctgcatcaagcagatcagatcaaagttcggcaggagcggcgcatgttgagcagaaatgcgacatgtctatggggaaatgggtgagggagccacggggtccagtctacacaaacctgacgtgcccgacgctgccggacttcaagaactgccagaagtacggcaaggacccggggcacctcttctggcggtggcagccggacggctgcgacctgccgcggttcgcgccggagcggttcctcgacgtcgcccgcgggaagacgctcgcgttcatcggcgactccctggcgcgcaaccagatggagtcgctgctctgcctggtctcgcaggccgagacgccgacggacgtgtaccgcgacgcgttcgacaagttccggacgtggcacttcccggagcacaacttcacgctcatggcgatgtggacggagttctacgcgcacgccgtgccggtgctcggcgccgacggcaagccgacgccctccttcgacatccaccttgacaggctcaacgccaactggacggctcgcctgccggggctggactacgccgtcatctccggcggcaactggttcttccgcgtcaactacctctgggaggacggtcgccggatcggctgcgtcaactgccgggagcccggactcacggacctcggcatcgtctacgccgtccgccgcgtcgtcagggcggcgctcgaggctgtcgccgggtgccgggactgcaaggacggactcgtcacgttcctgcgcacctacacgcccgaccacttcgagcacggctcctggttcagcggcggctactgcaacaggacgcggccgctggaggaaagcgagatcagcttggcgagcatcgggtgggagctgaggagggtgcagagccaggaggtgacgagggtgagggagacgaccgggaagacgacgagctttgagctgctggacgtgaccaaggcgatgatgctgcgcgccgacggccaccccggcgggcactacgacaagcggtgggtcaggaacgccagcgactgcctgcactggtgcctgcccggccctgtcgacatgtggaacggcatgctgctccagaggctcgcacacatctcgccgcagccgctgctgtaa

SEQ ID NO: 21659 - protein, 488 aa, Sorghum bicolor
  misc_feature: Ceres ANNOT ID no. 8736083
  misc_feature: Up-regulated in shoot tissues in response to methyl jasmonate treatment
  misc_feature: Up-regulated in root tissues in response to methyl jasmonate treatment
MPLPTSPSSSPRLLRSSSSEWHAVVQRNVRSSLLLLLVLSTIFVFSVLYSSHGFGVGTTADQALTQRQSTHHGAIDRFVPGQEEADEPIAVPAENNEASEQNLASDISLPSANTSTAPAVPASSRSDQSSAGAAHVEQKCDMSMGKWVREPRGPVYTNLTCPTLPDFKNCQKYGKDPGHLFWRWQPDGCDLPRFAPERFLDVARGKTLAFIGDSLARNQMESLLCLVSQAETPTDVYRDAFDKFRTWHFPEHNFTLMAMWTEFYAHAVPVLGADGKPTPSFDIHLDRLNANWTARLPGLDYAVISGGNWFFRVNYLWEDGRRIGCVNCREPGLTDLGIVYAVRRVVRAALEAVAGCRDCKDGLVTFLRTYTPDHFEHGSWFSGGYCNRTRPLEESEISLASIGWELRRVQSQEVTRVRETTGKTTSFELLDVTKAMMLRADGHPGGHYDKRWVRNASDCLHWCLPGPVDMWNGMLLQRLAHISPQPLL

SEQ ID NO: 21660 - DNA, 1767 bp, Sorghum bicolor
  misc_feature: Ceres ANNOT ID no. 8736162
  misc_feature: Up-regulated in root tissues in response to salicylic acid treatment
  misc_feature: Encodes the peptide sequence at SEQ ID NO 21661
atgcccgaggcggcggtgcccccgccgctgccgctcctggcggcggcgagctccccggtggccgccgcgctgccgcgggcgaggcggcggcagcagcagcagcggagggggtggcggcgcccgcgcgggttgctggtctggggcgccctcgtggccttcttcttcgtcatgaactggtggatgttctcccgacttcaggacccctcggcgcgcccgcacttccggctgaggcgccacccgccccgcgcgcccgctactgtcaattcgtcgctcttgactctggaagaggtgtctggtgctgctaaggggaagagggcacatagggttatgctcacccggttgcttgctttggcaggccatgctttggcagaggcagagaccaggcctgaacctaaggatttgtgggaagagccgataaatgctactatgtggagaccgtgttctgaccaaagggattggaaagcctcagagggaaccaatggctacatcatgatcagtgctaatggtggcataaaccagcaaagagttgcgatttgtaatgcagttacaatctcgcggttgctcaatgcaactcttgtcatcccaaaattcttgtacagtaatgtgtggctggacaaaagtcagtttggcgatatatatcaggaggattattttatcaaatatctgaaatctgatattcagattgtaaaggatcttccagtagagctgcagtcattagacttggaggcgattggtagccttgttaatgatacagatgtcatgaaagaggcaaagcccagtttatatgtgaaaaaaatactaccaattttactgagaaacagagttgttcactttataggatttggcaatcgcttatcttttgacccaataccttctgaccttcagagattgcgatgcagatgtaattttcatgctcttcgctttgtacacaaaattcaagaaactggtgcagttcttgtagagaggttgcatggccgtagggcctcttcgtcgcctttgaaggataatcttttaggccagtttgccatcaagtctgaccccagtgcgaacaagagtgatgcatccaaatatctggctgttcatctccggtttgagattgatatggttgcatactcattgtgttactttggtggtggcaaagatgaggaagacgaactagaagcttatcgccaaattcactttcctgttctgtcagaactcaagaagacaacaaagttgccctctgctgctttcttacggtctgaaggcaaatgtccccttgcacctgaagaggctgtgcttatgcttgctgctattggtttcaagcgcagcacaaagatatacattgcaggcgctgaaatttatggagggaaggataggatggctgccataagtcgtctttatcctgctttagtaactaaagaaacccttctgtctccatcagagcttgaaccatttaggaacttctcatctcagttggcagccctggacttcattgcatgtgcagctgccgatgcatttgctatgactgacccaggaagtcaattctcttctcttgttcaaggttaccgcatgtactatggtggtggggaccttcccacaataaggccaaacaagcgccggctagccagcatacttgtgaagaatgccacgattgagtggaatgaatttgaaagtagagtaagaaaactcatacatcaaactaagcaagttcatgagaggcctgttgcaagaagcatatttagacatccacgatgttcagaatgcatgtgcagaacagagcaatag

SEQ ID NO: 21661 - protein, 588 aa, Sorghum bicolor
  misc_feature: Ceres ANNOT ID no. 8736162
  misc_feature: Up-regulated in root tissues in response to salicylic acid treatment
MPEAAVPPPLPLLAAASSPVAAALPRARRRQQQQRRGWRRPRGLLVWGALVAFFFVMNWWMFSRLQDPSARPHFRLRRHPPRAPATVNSSLLTLEEVSGAAKGKRAHRVMLTRLLALAGHALAEAETRPEPKDLWEEPINATMWRPCSDQRDWKASEGTNGYIMISANGGINQQRVAICNAVTISRLLNATLVIPKFLYSNVWLDKSQFGDIYQEDYFIKYLKSDIQIVKDLPVELQSLDLEAIGSLVNDTDVMKEAKPSLYVKKILPILLRNRVVHFIGFGNRLSFDPIPSDLQRLRCRCNFHALRFVHKIQETGAVLVERLHGRRASSSPLKDNLLGQFAIKSDPSANKSDASKYLAVHLRFEIDMVAYSLCYFGGGKDEEDELEAYRQIHFPVLSELKKTTKLPSAAFLRSEGKCPLAPEEAVLMLAAIGFKRSTKIYIAGAEIYGGKDRMAAISRLYPALVTKETLLSPSELEPFRNFSSQLAALDFIACAAADAFAMTDPGSQFSSLVQGYRMYYGGGDLPTIRPNKRRLASILVKNATIEWNEFESRVRKLIHQTKQVHERPVARSIFRHPRCSECMCRTEQ

SEQ ID NO: 21662 - DNA, 1698 bp, Sorghum bicolor
  misc_feature: Ceres ANNOT ID no. 8736206
  misc_feature: Down-regulated in shoot tissues in response to salicylic acid treatment
  misc_feature: Encodes the peptide sequence at SEQ ID NO 21663
atggcggcggcggcggtgacgtccaacggcggcgcggtggcggcgaacggcgggccggcgcccggccggctggcctccgtgtacagcgaggtgcagacgaaccggctcctgcacgcgctgccgctcccctccgtcctccgctccaacttctccgtcgtcgacggccccgccagctccgccgcgggcaaccccgatgagatcgccaagctcttccccaacctcttcggccagccctcggcgtcgctggtgccggcggccgagcccgccgcgaccaggccgctcaaggtcggtgtcgtgctctccggtggacaggcgccgggcggccacaatgtcatctgcggcatctttgattacctgcaggagcgtgcaaaaggcagcaccatgtatggattcaagggaggcccagctggggttatgaagtgcaagtatgtggagctcactgcagactttgtgtatccctacagaaaccagggcggatttgatatgatctgcagtggaagggacaagattgaaacaccggagcagttcaagcaagctgaagacacagccaacaagcttgatttggatggtcttgttgtcattggtggtgatgattcaaacaccaatgcctgcctccttggtgaatactttaggtcaaggaatttgaaaacccgtgttattggttgcccaaagactattgatggagacctgaaatgtaaggaggttccaacaagctttgggtttgatactgcttgcaagatatactctgaaatgattggcaatgttatgactgatgcgagatcaacaggaaaatactatcactttgtgaggcttatgggtcgtgctgcttctcacattacattggaatgcgctttgcaaactcaccccaatgctgcactcattggggaagaggttgctgaaaagaagcaaacccttaagaatgtcacaaactacatcactgatatcatctgcaagcgtgcagatctcggttacaactacggtgttatccttataccagaaggcctaattgatttcatcccagaggttcaaaaactcatcgcagaattgaatgaaattttggcacatgatgttgttgatgaggcaggggcctggaaaagcaagcttcagcctgaatcaaaggagctgtttgagtttctgcccaaaactattcaggagcaacttatgcttgaaagggatccccatggcaatgttcaggttgcaaaaattgaaactgagaaaatgcttattagcatggtggaaactgaactggagaagagaaaagctgaggggagatactctgcacatttcagaggacaagctcatttctttgggtatgaaggaagatgtggccttcctactaattttgattctaactattgctatgcattaggctatggtgctggtgcccttctccaaagtgggaagacaggacttatttcatcggttggcaaccttgcggctccagtacaagaatggactgttggtggaacagcattgacatcactgatggatgttgagaggaggcacggcaagttcaagccagtgatcaagaaggctatggtggaacttgatgctgcacctttcaagaaatatgcatcaatgcgggatgagtgggccatcaagaacagatacatcagccctggccccatccagttcagtggccctggaagtgatgactcgaaccacactttgatgctggaactcggtgctgagttatag

SEQ ID NO: 21663 - protein, 565 aa, Sorghum bicolor
  misc_feature: Ceres ANNOT ID no. 8736206
  misc_feature: Down-regulated in shoot tissues in response to salicylic acid treatment
  misc_feature (23)..(563): SWISSPROT Homolog: EC 2.7.1.90 Diphosphate--fructose-6-phosphate 1-phosphotransferase
  misc_feature (95)..(377): Pfam ID: PFK Pfam Description: Phosphofructokinase
MAAAAVTSNGGAVAANGGPAPGRLASVYSEVQTNRLLHALPLPSVLRSNFSVVDGPASSAAGNPDEIAKLFPNLFGQPSASLVPAAEPAATRPLKVGVVLSGGQAPGGHNVICGIFDYLQERAKGSTMYGFKGGPAGVMKCKYVELTADFVYPYRNQGGFDMICSGRDKIETPEQFKQAEDTANKLDLDGLVVIGGDDSNTNACLLGEYFRSRNLKTRVIGCPKTIDGDLKCKEVPTSFGFDTACKIYSEMIGNVMTDARSTGKYYHFVRLMGRAASHITLECALQTHPNAALIGEEVAEKKQTLKNVTNYITDIICKRADLGYNYGVILIPEGLIDFIPEVQKLIAELNEILAHDVVDEAGAWKSKLQPESKELFEFLPKTIQEQLMLERDPHGNVQVAKIETEKMLISMVETELEKRKAEGRYSAHFRGQAHFFGYEGRCGLPTNFDSNYCYALGYGAGALLQSGKTGLISSVGNLAAPVQEWTVGGTALTSLMDVERRHGKFKPVIKKAMVELDAAPFKKYASMRDEWAIKNRYISPGPIQFSGPGSDDSNHTLMLELGAEL

SEQ ID NO: 21664 - DNA, 4737 bp, Sorghum bicolor
  misc_feature: Ceres ANNOT ID no. 8736348
  misc_feature: Up-regulated in shoot tissues in response to methyl jasmonate treatment
  misc_feature: Up-regulated in root tissues in response to methyl jasmonate treatment
  misc_feature: Up-regulated in shoot tissues in response to salicylic acid treatment
  misc_feature: Encodes the peptide sequence at SEQ ID NO 21665
atgacggacaacggcggccttggcgttcggcctattaacggaggccgagggggtgccgtggagcagcgcgggctcggcgacaacgggcctccagtgtccccaccagagcgtgtttgtacgccgcctgcgccgaggctggctgcttggcggcgcatgtcgtcgcctggtcctctccggtgctcaaccccaaggagcattgggtgtgaagatggtgaggatatggatcggtacttttccccacagagtgagttttctcaagacacttctgatacggattcaatgagcacaagtattagtaggatgtataccttccggttggggacttcgagcccattagatagtcctctcaaacaattgggagtaggagacatgagtcctccctcaaggaggggttgccattctcctagctatccttggaattcttgccggggatcagatgatgttgattctagttttatgagttcacctcagcatcatgatgaacagaggaaagatgatgtgcaaccaattgatttggagagtagacacatctggtatcctccaccacctcaggatgaaaatggtacttttcaatatgatgaggacgatgacaatgatgtttgtgttgggaaggtctttggacatgttcaccatgattattgcgacggcgatgatgatgttgatgataatgatgattatgattcgttagggatcaaagggaaacatagtatatctcacaaagagttcttgaggagtgctttacatgggcatttcagggctctcgtgtcccaattgctcctaggacatggcattgatcctgtggatggctggccagacatagtggcctcattagcttggcaagcagctacctttgtcaggccagacacgagcaagggtggtagcatggatcccacagactatgtcaaagtcaaatgcgtagcatcaggaaatccaaatgatagtgctttcattaaaggtgttgtctgttctaagaatgtaaaacataaacgcatggtgtcaaaacatgagaaccctaggttgcttcttttgggaggagcactggaataccagaaagtcacgaacaaactagcttcaataaacagcattcttgaacaggagaaggagtatcttaagaatgctgttgcaaagatagaggctcaacgcccacatgtcttgctagtcgagaaaagtgtgccattgcatgcacaacagcttcttgcaaaagatatctctttagtattgaacgtcaagagatcacttctggaaagaatatctcgctgcacaggtgctcaaattgcatcttctgttgaaaatatcacttctacaggagtcggacaatgccaaacattctggattgagaaagttacagaatgttcatcaccaaaggtctcaaacaaaaaaacggtcaagacactgatgttttttgatggttgtccaagacgcttggggtgcacggttcttctaagaggaaagtcatatgaagagttaaagaaagtcaaacttgctgtgcagtatgctttatttgcagcataccacctgtcacttgagacctcatatcttgctgatgagggtgcaacacttccaaaagtcccctcagatcttcaatttgagaagcagaattcttcctcaagatactatcagcagaatttgaatgaatttcaaaccattgaaggggaaacttttggaagtgggtgcatcatgccttgccttaatggttctacaaatcaatctcattcaagagatgacataattcacgaggaacatgcacactgtcattcaagagccgacttaagtcaagaagaatatactcgtggaaccattaaggtatacccttattccacagaagcttcaatgtatggcaactgtataccacctgttcagacacctaaaaattcacttgccagtgtgagaaaaaggacaccaggaaatttatattttccccataatggtcacatagatgaagcaggtggtggaatgtcaaaggttgatagtgacttccttgacttggataatggttggaatcatatctcagatgaagattctgtagcaatacgtgatcacaatgggaaccacaacgaatattttccaacatctgacagtccacagagcattttggtttccttgtcagttgcatgccctctgagaggaattgtatgcaagcaatctcagctatttcgaataaagttctacggtacttttgataagccacttggaaggtattttcgtgaagatttatttgttcagacttcatgctgcgaatcttgcaaggagcctgcagaatctcatgtgcgatgttacactcatcaacaaggcagtctcacaatcagtgtcagaactcttccatctgtcaagctacctggggagcttgatgggaaggtatggatgtggcacaggtgtctcaggtgcaaaccaaaagatggaattcccccagccacacaaaggatagtcatgtcggatgcagcacgcggattatcttttgggaagtttctggaacttagcttttcaaatcacacaacagccaatcgaattgcctgctgtggacactccctccagagggactgccttcgtttttatgggcttgggagcatggttgctgtcttccgttattcaccagtagacattctttctgtcaacttgccatcctcagtactggactttgcttatccaaaagctcaagattgggttatcaaagaagctgttgatgtatgcgctaggaaggaacatctgtataaggaaattgttgttaaacttgactgcatcgaaaagatagttaaagaccagaacattggtatgaagtcaggcttgcataaacatgttgccgatcttaaagagttggttaaagttgagtggaagaagtatgacgtcgtatcagggttttctatcatagatgacttgcagacatttgaaccatatatagatgttctagagctcaatcgcctgaggagagagcttgtacttgatattcacgtatgggatcgcagactgtacatgatgcactccctcacaaaagaaaactgtcgtactgtgccaaatgatgcagaatgttctgagaagcttactgaaagcttattagaacagtcaaaggatgtgacatctggtaaacatttgaatgttgagaattctctagaacagaatcaaccaagtatgttggaagtggctgcagtttcagtgaaatcatcatcccctatgatggaacaaaccaacacttgtgtttcacgtttggaaaccaacattatgggtgatctatccatgcattctggctcaactgttatcagctttgccccaggcccatgtgaaatgcagagtgaaggagtgctggctgaactagaagctggaaaatttttgcagaaatcacaatcttctgcctccaatctttctgacagaattgacttagcatggactggttctggtcagtttgttaaggattcatcaagtagcgtggaggcagtttcatttgtacctgctagtctgaaggatgatcctgcataccagaaggttatagcaccaattagaatcaaatcattcgattctgctgtcagttccagaaatgttgatgattcaaatgctagtataagaagatcttattctcaaaggcccccaaaagctattgagagaactggtaagggcctgtcaccaacattcttgaacaagctgtcactttctggtatgattgatggcgagagtcggttgctactgtcacaaaatgattcaaatgttattgttccaatttatgatgatgaaccatctagcatgatagcccatgccatgactatcccagaataccgcagcttcttgttgccacttctggatcagaataatgaatctagtttattgaattatggttctgatcagcctcaacctacaactggaaatgactctaaggataaccatttaactgtttcttttgaggatgaagactcatattctgttgataaagcaaaattttctgtgacatgttattttgcaaagcagtttgatgcaatcaggagaaagtgctgtccagatgagctagactatatccgctccttaagtcgctgcaagagatggagtgctcaaggtggcaagagtaatgtctactttgccaaaacactggatgacagatttgtgataaagcaagtgacccggacagaattagattcatttgaggattatgctgttgattacttcaaatatttgacagactctgtatcgtctgggagcccaacttgcctcactaaagtccttggtctttaccagatcactgccaagaatttgagagatggaaaggagctgaagatggatgtaatggtcatggaaaacctatttttcaagaggaaggtatcaagaatatatgacctaaagggctctttgcgttcgcgctacaaccctgatacttcagggaacaacaaggttctcttggatcttaatctgttagagacacttcacacaaagcccatttttcttggaagcaaagcaaaaagaaggctggaacgagctgtctggaatgatacttcttttctggcatcggtggatgtgatggactactctctcctagtcggcattgatgaggaaagaaaagagcttgtgatggggattatcgactatcttcggcaatacacttgggacaaacaactagagacttgggtgaaggcgacaggatttctaggtggctccaaggatgttctgccaaccatcatatctccggatcagtacaagaagaggttcaggaaggccatgtcgaagtacttcttggctctccctgaccaatggtcaccgtaa

SEQ ID NO: 21665 - protein, 1578 aa, Sorghum bicolor
  misc_feature: Ceres ANNOT ID no. 8736348
  misc_feature: Up-regulated in shoot tissues in response to methyl jasmonate treatment
  misc_feature: Up-regulated in root tissues in response to methyl jasmonate treatment
  misc_feature: Up-regulated in shoot tissues in response to salicylic acid treatment
  misc_feature (1264)..(1577): SWISSPROT Homolog: EC 2.7.1.68 1-phosphatidylinositol-4-phosphate 5-kinase
  misc_feature (1334)..(1569): Pfam ID: PIP5K Pfam Description: Phosphatidylinositol-4-phosphate 5-Kinase
  misc_feature (228)..(632): Pfam ID: Cpn60_TCP1 Pfam Description: TCP-1/cpn60 chaperonin family
MTDNGGLGVRPINGGRGGAVEQRGLGDNGPPVSPPERVCTPPAPRLAAWRRMSSPGPLRCSTPRSIGCEDGEDMDRYFSPQSEFSQDTSDTDSMSTSISRMYTFRLGTSSPLDSPLKQLGVGDMSPPSRRGCHSPSYPWNSCRGSDDVDSSFMSSPQHHDEQRKDDVQPIDLESRHIWYPPPPQDENGTFQYDEDDDNDVCVGKVFGHVHHDYCDGDDDVDDNDDYDSLGIKGKHSISHKEFLRSALHGHFRALVSQLLLGHGIDPVDGWPDIVASLAWQAATFVRPDTSKGGSMDPTDYVKVKCVASGNPNDSAFIKGVVCSKNVKHKRMVSKHENPRLLLLGGALEYQKVTNKLASINSILEQEKEYLKNAVAKIEAQRPHVLLVEKSVPLHAQQLLAKDISLVLNVKRSLLERISRCTGAQIASSVENITSTGVGQCQTFWIEKVTECSSPKVSNKKTVKTLMFFDGCPRRLGCTVLLRGKSYEELKKVKLAVQYALFAAYHLSLETSYLADEGATLPKVPSDLQFEKQNSSSRYYQQNLNEFQTIEGETFGSGCIMPCLNGSTNQSHSRDDIIHEEHAHCHSRADLSQEEYTRGTIKVYPYSTEASMYGNCIPPVQTPKNSLASVRKRTPGNLYFPHNGHIDEAGGGMSKVDSDFLDLDNGWNHISDEDSVAIRDHNGNHNEYFPTSDSPQSILVSLSVACPLRGIVCKQSQLFRIKFYGTFDKPLGRYFREDLFVQTSCCESCKEPAESHVRCYTHQQGSLTISVRTLPSVKLPGELDGKVWMWHRCLRCKPKDGIPPATQRIVMSDAARGLSFGKFLELSFSNHTTANRIACCGHSLQRDCLRFYGLGSMVAVFRYSPVDILSVNLPSSVLDFAYPKAQDWVIKEAVDVCARKEHLYKEIVVKLDCIEKIVKDQNIGMKSGLHKHVADLKELVKVEWKKYDVVSGFSIIDDLQTFEPYIDVLELNRLRRELVLDIHVWDRRLYMMHSLTKENCRTVPNDAECSEKLTESLLEQSKDVTSGKHLNVENSLEQNQPSMLEVAAVSVKSSSPMMEQTNTCVSRLETNIMGDLSMHSGSTVISFAPGPCEMQSEGVLAELEAGKFLQKSQSSASNLSDRIDLAWTGSGQFVKDSSSSVEAVSFVPASLKDDPAYQKVIAPIRIKSFDSAVSSRNVDDSNASIRRSYSQRPPKAIERTGKGLSPTFLNKLSLSGMIDGESRLLLSQNDSNVIVPIYDDEPSSMIAHAMTIPEYRSFLLPLLDQNNESSLLNYGSDQPQPTTGNDSKDNHLTVSFEDEDSYSVDKAKFSVTCYFAKQFDAIRRKCCPDELDYIRSLSRCKRWSAQGGKSNVYFAKTLDDRFVIKQVTRTELDSFEDYAVDYFKYLTDSVSSGSPTCLTKVLGLYQITAKNLRDGKELKMDVMVMENLFFKRKVSRIYDLKGSLRSRYNPDTSGNNKVLLDLNLLETLHTKPIFLGSKAKRRLERAVWNDTSFLASVDVMDYSLLVGIDEERKELVMGIIDYLRQYTWDKQLETWVKATGFLGGSKDVLPTIISPDQYKKRFRKAMSKYFLALPDQWSP

SEQ ID NO: 21666 - DNA, 1227 bp, Sorghum bicolor
  misc_feature: Ceres ANNOT ID no. 8736438
  misc_feature: Up-regulated in shoot tissues in response to salicylic acid treatment
  misc_feature: Encodes the peptide sequence at SEQ ID NO 21667
atgaagcttaacgtcaagaccctcaagggcaccaacttcgagatcgaggcgagcccggatgcgtcggttgctgaggtgaagaggatcatcgagaccactcagggtcagagtacctacccggcagaccagcaaatgctcatataccaagggaaaattctcaaggatgagaccactttggaaggcaacggagttgctgagaacagcttccttgttataatgttgtccaaggctaaggcatcgtcgagtggagcttctaccgctactgctgcaaaagctcctgcaactccggcccaacctgctgcacctgtagcccctgtggcccctgctacatcagttgcaagagcacctacacaagctcctgttgccacagctgaaacgacacctccaagtgcacagcctcaggctgctcctgctgctacggttgctgcatctggtgatgctgatgtgtacagtcaggcagcttcaaaccttgtatctggcaacaatctagaacagactatccaacaaattcttgacatgggtggtggtacttgggaacgtgatacagttgtccgtgctctacgtgctgcatataataaccctgagagagctatagactacctatattctggaattcctgagaatgtggaggctcctcctgttgcccgagcacctgctgctggccaacaaacaaatcagcaggctccatcgcctgctcagccagcagttgcacctccagtgcagccatccgctgcctctgcagggcctaatgcaaatcctctgaacctttttcctcagggtgttccaagtggtggggccaatccaggtgttgttccaggtgcaggatctggtgcccttgatgccttgcgacagcttccacagtttcaagcactgcttcagttggtccaggctaatcctcaaatcttacagccaatgcttcaagagctaggcaaacaaaacccacaaatactgcggttgattcaggaaaatcaagctgagttcctccgcttggtgaatgaaactcctgagggtggtcctggaggaaacatactaggtcaactggcagctgctatgcctcaaacgctgacggttacaccagaggaacgggaggcaatccagcggcttgaggggatggggttcaaccgtgagcttgtgctagaagttttctttgcatgcaacaaggacgaagagcttgcggccaactaccttctggatcatggccatgagtttgacgagcagcagcaatag

SEQ ID NO: 21667 - protein, 408 aa, Sorghum bicolor
  misc_feature: Ceres ANNOT ID no. 8736438
  misc_feature: Up-regulated in shoot tissues in response to salicylic acid treatment
  misc_feature (279)..(337): Pfam ID: XPC-binding Pfam Description: XPC-binding domain
  misc_feature (162)..(201): Pfam ID: UBA Pfam Description: UBA/TS-N domain
  misc_feature (360)..(396): Pfam ID: UBA Pfam Description: UBA/TS-N domain
  misc_feature (6)..(78): Pfam ID: ubiquitin Pfam Description: Ubiquitin family
MKLNVKTLKGTNFEIEASPDASVAEVKRIIETTQGQSTYPADQQMLIYQGKILKDETTLEGNGVAENSFLVIMLSKAKASSSGASTATAAKAPATPAQPAAPVAPVAPATSVARAPTQAPVATAETTPPSAQPQAAPAATVAASGDADVYSQAASNLVSGNNLEQTIQQILDMGGGTWERDTVVRALRAAYNNPERAIDYLYSGIPENVEAPPVARAPAAGQQTNQQAPSPAQPAVAPPVQPSAASAGPNANPLNLFPQGVPSGGANPGVVPGAGSGALDALRQLPQFQALLQLVQANPQILQPMLQELGKQNPQILRLIQENQAEFLRLVNETPEGGPGGNILGQLAAAMPQTLTVTPEEREAIQRLEGMGFNRELVLEVFFACNKDEELAANYLLDHGHEFDEQQQ

SEQ ID NO: 21668 - DNA, 1788 bp, Sorghum bicolor
  misc_feature: Ceres ANNOT ID no. 8736447
  misc_feature: Down-regulated in shoot tissues in response to methyl jasmonate treatment
  misc_feature: Encodes the peptide sequence at SEQ ID NO 21669
atggccatggaggaaacgagcaagataacgggcaggaagaagggtggtcttagaacaatgcccttcatcttcgccaacgaggtggcggagaagctcgccgtggtgggcttctcgaccaacatgctgacgtacctcaccacgcagctgcacatgccgctggcgaaggccgccaccacgctcaccaacttcggcggcacctccgccgcgacgcccctcatcggcgccttcctcgccgacgcctgcatcggccgcttctggaccatcgctgccgcctccgtcgtctaccaagtcggcatggcgctcctgacggtgtcagcggcgctgccgcagttccgccctccgccgtgcaagcccggcggcgcggtgacgtgccaggaggcggcgccgtggcagctggcggtgctgtacgtgtccctgctcctcaacgcggtgggcgccggcgggtaccgcccctgcatcgtggcgttcggggcggaccagttcgacgagtcgcgggcggcggagcgcgcccggagctggggcttcttcaactggtactacttctgcaacggcgcgtccatgctgctggccgtcacggcggtggtgtacgtgcaggacaacgtgggctggggctggggcctcggcgtgccggccttctgcatgggcgtctccgtcgccgccttcgtggccgggtaccccatgtaccggaggctggagcccgcggggagcccgttcacgcggctcgcgcaggtggtcgtcgccgccgtcaagaagcgccggctgccggcggcggacgtcgtccccgcgaggctgtacgagaacgacgacctcgacgcgcccatctccatgtacggcaagcttgtgcacacggatcagctcagcttctttgaccgcgcggcgatcgtcaccgacggcgacatggtcacgcagacggacgccgactccggcaagccgtcggcggcccccgtcccgaacccgtggcgcctgagcacggtgcaccgcgtggaggagctcaagtccgtgatccgcatggggcctatctgggcggcgggcatcctggtgatcacgggttcatcgacgcagcacaccttctccctgcagcaggcgagcaccatggaccgccgcctggcgccgggcctgtccacgttccagatcccggcggggtccatgaccgtcttcgcgctgctcgccatgctcctcaccctgttcctctacgaccgcgtgctcgtccgcgtggcgcgccgcttcacggggctggaccgcggcatctccttcctgcaccgcatgggcgtcggcttcgccatcagcgtggtcgccaccctggtggccggcttcgtggagcggcaccgcagggacgccgcggcggcggtggccggcgccacggacgccggcacgtccccgctgtcggcctactggctggtgccgcagtacgcgctgcacggcgtggccgaggccttcacctccgtggggcacctcgagttcatgtacgaccaggcgcccgagagcatgcgcagcacggcgacggcgctcttctggctctccatctcgctgggaagctacgccagcacgctgctggtggacgccgtgcaccactggagcgcaggccccggcggcgccaactggctgccggacaacatcaatcacggcaggctggactacttttactgggtcgtcaccatgctgcaggtcatgaacttgatatactacgccatttgtgccaagcggttcaggtacaagccagtgcagctccataagaaagaggaggaagaaagcggcaaggcacttgtggagctgcaagagaaggtttga

SEQ ID NO: 21669 - protein, 595 aa, Sorghum bicolor
  misc_feature: Ceres ANNOT ID no. 8736447
  misc_feature: Down-regulated in shoot tissues in response to methyl jasmonate treatment
  misc_feature (85)..(508): Pfam ID: PTR2 Pfam Description: POT family
MAMEETSKITGRKKGGLRTMPFIFANEVAEKLAVVGFSTNMLTYLTTQLHMPLAKAATTLTNFGGTSAATPLIGAFLADACIGRFWTIAAASVVYQVGMALLTVSAALPQFRPPPCKPGGAVTCQEAAPWQLAVLYVSLLLNAVGAGGYRPCIVAFGADQFDESRAAERARSWGFFNWYYFCNGASMLLAVTAVVYVQDNVGWGWGLGVPAFCMGVSVAAFVAGYPMYRRLEPAGSPFTRLAQVVVAAVKKRRLPAADVVPARLYENDDLDAPISMYGKLVHTDQLSFFDRAAIVTDGDMVTQTDADSGKPSAAPVPNPWRLSTVHRVEELKSVIRMGPIWAAGILVITGSSTQHTFSLQQASTMDRRLAPGLSTFQIPAGSMTVFALLAMLLTLFLYDRVLVRVARRFTGLDRGISFLHRMGVGFAISVVATLVAGFVERHRRDAAAAVAGATDAGTSPLSAYWLVPQYALHGVAEAFTSVGHLEFMYDQAPESMRSTATALFWLSISLGSYASTLLVDAVHHWSAGPGGANWLPDNINHGRLDYFYWVVTMLQVMNLIYYAICAKRFRYKPVQLHKKEEEESGKALVELQEKV

SEQ ID NO: 21670 - DNA, 2655 bp, Sorghum bicolor
  misc_feature: Ceres ANNOT ID no. 8737091
  misc_feature: Up-regulated in root tissues in response to aminocyclopropane carboxylic treatment
  misc_feature: Up-regulated in shoot tissues in response to salicylic acid treatment
  misc_feature: Encodes the peptide sequence at SEQ ID NO 21671
atggagtctcaacagcagcctaccattggccatatggctagcaaatctcctgaagaacaacacgagctgcaggaaggccaggctgtccagaatcctagcgcacttcaggttcaggctgacctcctatggaaactgaggaagtacttgatgctgctggctatcctagctgcagccatcacctaccaagcagggttagctccgccgggtgggttctggcaagacagcctgaatggtcacatccctggtgatattgtgctaagagttagctaccccaagcgttactatgtgttcttctactgcaacacaacagcgtttggggcatcactcattgtccttatactgctcctggtcagggaattgagccgcaatgtggtttggcttggggcactacaatttgcaatggtactgggcctgcttgggctcatgggtgcctatgctgcagggagctgcagggaggtgaggacctcagtttacatttgggtattacttgttggcatatttgcatatatcacagtccatgtcatattcttccggaaaacacagagcaatgagccagaaactccaatgaatgatcgggaggctcatgatgagggggaagaattggagcggaatcgcagtttcttgctggttcttgccacattagcagcgacagtgacatatgttgcagggctaagcccaccaggtggcttctggcctgatgatgacaagcctaaccaccttgccggtgatccagttctgcgagatcattacccccgtcgattcaaggcttttatggtctgcaatgcaacttcttttgctggatcccttgtgatcatcattatgctcctcagcaacacagcagtggatcatgttgtcaagtcaaatgctctgcggttgtgtgtgctggtgagcctctttgggcttatgggggcctatgctgctgggagttgtagggatgtccgtacatctatctatgtcttctccctcgttggtgcagttttgctctaccttgctcttcagtggattgaacctattgggagtgggaatccagatgatggcaagcgtacaaccctgtcagggcccaatacacaacatacatcaaacaattttagtgatgctaaagatgacatccaaaaactgcgcacatatctcctattgcttggtatccttgctgccactgtcacatatcaagctggactaaatccaccaggtggattttggacagacagtgttgatgggcatattgccggggatccaatcttggagaccatgcaaccaaggcgttacaaggtgttcttctactgcaatgccacagcatttgtagcatctttggtgatcattaccttactccagagccaactgattactgttagtgccatgaagcgtcacatactgcaaacagccatgatactggatctctttggacttatgggagcctatgctgctggaagcagcagaaagttctcgacatccctttatgtgtttgtcttggtccttcttgttttcatctatgttgtaattcatgttctgctatctttggctcttatgacacgacccagaagagatgatgctatggagaatgaagatgaagatttggagaaacggcgtaagtttctaatgttgcttgcaattctggctgcttccatcacatatcaagctggcataagcccaccaggtggattctgggatgacaataatggccaccaagcaggtgatccagtcttccatgatgaattccgaacccgctacagggttttcttctacttcaatgcaacagctttcatggcatccttggttgtgattatgttgcttgttagtaaaaggttatgtcacaagggtcttgaggtctatgcgctgcacacatgtgttttggttgatctgatcagccttatgggtgcttttgctgctggaagctgcaggaaagtttcaacatctgtgtacgtcatccttgtcgttgttgcggtgtctgcttatgtgatgattcaagttgtggttctgacatttgcaaaagacaaggtgaacaatttgttggaaagtttcaacatctgtgcacaatttgttgcagtgtcttctgtgcgccaacagccatccatgaatcacaaaagaagcatccggactagaaagaaacctgaacacaaatggcgcaaagatttgatgctgatcgggactctcgcagtcactgtcacataccaagctgggctgctcccgccaggtgggttttggcctgatgatcaggtaggccattttgcaggtgacccaatcctccatgatacccatccatcacggtttaaagtgttcttctattgtaatgccacagcattcatggcatcaatggtcatggtcatcctcttgctgaacaacacaataagcaagtacaggagatctcttcttgctatgaagacagcaatggtattggacttgtttggtctccttggagcatatgccgcaggcagctgcagaaagttcaagacatctgcatacgtttttgcacttgtcattgctgtgttcatttacattgtgattcatgtgttgctgtcattcgatgaggtggctttattggtcagaaagaagggagaaaagtggattccttgcctgaaaaaaatgtgggcacctatcgaaactgatcctttaagccttcagccatatgctgggcaactgggggagatgcctgtgtaa

SEQ ID NO: 21671 - protein, 884 aa, Sorghum bicolor
  misc_feature: Ceres ANNOT ID no. 8737091
  misc_feature: Up-regulated in root tissues in response to aminocyclopropane carboxylic treatment
  misc_feature: Up-regulated in shoot tissues in response to salicylic acid treatment
MESQQQPTIGHMASKSPEEQHELQEGQAVQNPSALQVQADLLWKLRKYLMLLAILAAAITYQAGLAPPGGFWQDSLNGHIPGDIVLRVSYPKRYYVFFYCNTTAFGASLIVLILLLVRELSRNVVWLGALQFAMVLGLLGLMGAYAAGSCREVRTSVYIWVLLVGIFAYITVHVIFFRKTQSNEPETPMNDREAHDEGEELERNRSFLLVLATLAATVTYVAGLSPPGGFWPDDDKPNHLAGDPVLRDHYPRRFKAFMVCNATSFAGSLVIIIMLLSNTAVDHVVKSNALRLCVLVSLFGLMGAYAAGSCRDVRTSIYVFSLVGAVLLYLALQWIEPIGSGNPDDGKRTTLSGPNTQHTSNNFSDAKDDIQKLRTYLLLLGILAATVTYQAGLNPPGGFWTDSVDGHIAGDPILETMQPRRYKVFFYCNATAFVASLVIITLLQSQLITVSAMKRHILQTAMILDLFGLMGAYAAGSSRKFSTSLYVFVLVLLVFIYVVIHVLLSLALMTRPRRDDAMENEDEDLEKRRKFLMLLAILAASITYQAGISPPGGFWDDNNGHQAGDPVFHDEFRTRYRVFFYFNATAFMASLVVIMLLVSKRLCHKGLEVYALHTCVLVDLISLMGAFAAGSCRKVSTSVYVILVVVAVSAYVMIQVVVLTFAKDKVNNLLESFNICAQFVAVSSVRQQPSMNHKRSIRTRKKPEHKWRKDLMLIGTLAVTVTYQAGLLPPGGFWPDDQVGHFAGDPILHDTHPSRFKVFFYCNATAFMASMVMVILLLNNTISKYRRSLLAMKTAMVLDLFGLLGAYAAGSCRKFKTSAYVFALVIAVFIYIVIHVLLSFDEVALLVRKKGEKWIPCLKKMWAPIETDPLSLQPYAGQLGEMPV

SEQ ID NO: 21672 - DNA, 741 bp, Sorghum bicolor
  misc_feature: Ceres ANNOT ID no. 8737240
  misc_feature: Down-regulated in shoot tissues in response to salicylic acid treatment
  misc_feature: Encodes the peptide sequence at SEQ ID NO 21673
atgttgtcccgattgccggcgacggtgagccttcttcgccgttctctccgggaaccgcgcggcttcagctcctccgcctcctctgtggcttcatctaaggcaacggccgacgggaagcttgtggcgtcggtgctgttcgagcgactccccgtcgttatccccaagatccaccctgttgtctacgcttttcaagaattctcatttcggtggaggcagcagtacagacggcaataccccgaggaggtcctcggcaaggccgacgcaaggggtaagggtgattatcatattgattatgtgcctgctccaagaattaccgaggctgacaaaacaaatgaccggaagtctttacaacgagctcttgataataaactttatctcctgctgtatggcaatgcttacggggctcctgatggaaagcctgtatggcattttccggaaaaagtatatgaaaatgaagaaactatgcgactgtgtgctgaggctgcattaaaatctgttcttgggggacttgaccatacatactttgttggcaatgctccaatggctcatatggcggttgaacaaacggattcaagtgtttcaccattcaagcgtttcttcttcaagtcacaagtggttggcacaacgaaataccatattggaaaatgcaaggacttcgcgtgggtgaccaaagatgagctgctggagtattttcctgagaacaaggatttcttcaacaagatgatcatccacattagatag

SEQ ID NO: 21673 - protein, 246 aa, Sorghum bicolor
  misc_feature: Ceres ANNOT ID no. 8737240
  misc_feature: Down-regulated in shoot tissues in response to salicylic acid treatment
MLSRLPATVSLLRRSLREPRGFSSSASSVASSKATADGKLVASVLFERLPVVIPKIHPVVYAFQEFSFRWRQQYRRQYPEEVLGKADARGKGDYHIDYVPAPRITEADKTNDRKSLQRALDNKLYLLLYGNAYGAPDGKPVWHFPEKVYENEETMRLCAEAALKSVLGGLDHTYFVGNAPMAHMAVEQTDSSVSPFKRFFFKSQVVGTTKYHIGKCKDFAWVTKDELLEYFPENKDFFNKMIIHIR

SEQ ID NO: 21674 - DNA, 1779 bp, Sorghum bicolor
  misc_feature: Ceres ANNOT ID no. 8737660
  misc_feature: Up-regulated in shoot tissues in response to methyl jasmonate treatment
  misc_feature: Up-regulated in root tissues in response to methyl jasmonate treatment
  misc_feature: Encodes the peptide sequence at SEQ ID NO 21675
atggccggtgacattacatgcggatccttgctgcaaaagttgcagttcatatgggatgaagttggcgagagtgaggaggaccgtgacaaggtcctttatcagctggatcaggaatgccttgatgtttacaagaggaaagttgaccaagcaactaactctagggatctcctgatccaggcgctggatgactcaaagatagaacttgctaggcttctttctgctcttggagaaaaagctattgcaagaacccctgagaagacaacaggaacgatcaagcagcagctagctgctatagcaccaacacttgagcagttgactaaacagaaaaatgaaagaaaaagagagtttgttaatgtacaatcacaaattgatcaaatatgtggtgaaatcgctggcaccatagaggtgggtgagcaggtgacaaccccccaagtcaatgaggatgatttgacacttgagaggcttgaagattttcggtctcagctccaggagcttgagaaagagaagagtaataggttggagaaggttcttgagtatgtaagcatggtacatgatctttgtactgtcttggggatggattttctcagcacagtgactgaagttcatcccagtttagatgactccgttggggacaactgtaagagcattagtaatgatacgttgtcaaatcttgacaagacagtagctacacttaatgaagataagaagttgcgtctaagcaagcttcaagaactcgctggtcagctctatgatctttgggatctcatggatgcccccaaggaagaaaggcgcatgtttgatcatgttacctgcaacagatcagcatctgtggatgaagtgacagcacctggatctcttgctctagatttaattgaacaagctgaggttgaggttcaaaggttagaccagctgaaatacagtaagatgaaagaaatagctttcaagaagcaaactgagctggaagatatctacgctggtgctcatatagtaatagacacagctgctgctcatgagaaaatcttggcgctgattgaggcaggtaacatagaaccatcagaactaattgcagatatggatgcccagatagcaaaagcaaaggaagaagcattgagtagaaaagacatccttgataaagtagaaagatggatgtctgcatgtgaagaagagagctggcttgaagattataaccgggatgacaacaggtataactctagccgaggtgcccacctcaatctgaagcgtgcagaaaaagctcgtattcttgttaacaagattccagcacttgttgaaactctggtggcaaagaccagggcatgggaggagaaccgtggtctgtcctttatgtatgatggtgtacctcttctagctatgttggatgagtatgttatgctcaggcaggaaagggaagaagagaagaaaagaatgcgggaacaaaagcgctacattgagcagcaactgaacactgatcatgaagggccatttggatcacgagtgagtccaaaccggcctgccagttcgaagaaggccattggcccaaagttgaatggcagcgtctcaaatggcactcctccaaacagaaggctctcaatcagtggccaacagaacggcggtggccatggtgtcaggtctggagggaaggatagcaagaaagacacggtgaagacagcatctcctgggaacaatgcagctgcagctgcacctgtgggtgtggcagcaacagccaaagaagacgcggcctcccaaatttctgtcagcgatccggttccgagcacaccatga

SEQ ID NO: 21675 - protein, 592 aa, Sorghum bicolor
  misc_feature: Ceres ANNOT ID no. 8737660
  misc_feature: Up-regulated in shoot tissues in response to methyl jasmonate treatment
  misc_feature: Up-regulated in root tissues in response to methyl jasmonate treatment
  misc_feature (27)..(585): Pfam ID: MAP65_ASE1 Pfam Description: Microtubule associated protein (MAP65/ASE1 family)
MAGDITCGSLLQKLQFIWDEVGESEEDRDKVLYQLDQECLDVYKRKVDQATNSRDLLIQALDDSKIELARLLSALGEKAIARTPEKTTGTIKQQLAAIAPTLEQLTKQKNERKREFVNVQSQIDQICGEIAGTIEVGEQVTTPQVNEDDLTLERLEDFRSQLQELEKEKSNRLEKVLEYVSMVHDLCTVLGMDFLSTVTEVHPSLDDSVGDNCKSISNDTLSNLDKTVATLNEDKKLRLSKLQELAGQLYDLWDLMDAPKEERRMFDHVTCNRSASVDEVTAPGSLALDLIEQAEVEVQRLDQLKYSKMKEIAFKKQTELEDIYAGAHIVIDTAAAHEKILALIEAGNIEPSELIADMDAQIAKAKEEALSRKDILDKVERWMSACEEESWLEDYNRDDNRYNSSRGAHLNLKRAEKARILVNKIPALVETLVAKTRAWEENRGLSFMYDGVPLLAMLDEYVMLRQEREEEKKRMREQKRYIEQQLNTDHEGPFGSRVSPNRPASSKKAIGPKLNGSVSNGTPPNRRLSISGQQNGGGHGVRSGGKDSKKDTVKTASPGNNAAAAAPVGVAATAKEDAASQISVSDPVPSTP

SEQ ID NO: 21676 - DNA, 3594 bp, Sorghum bicolor
  misc_feature: Ceres ANNOT ID no. 8738850
  misc_feature: Up-regulated in shoot tissues in response to methyl jasmonate treatment
  misc_feature: Up-regulated in root tissues in response to methyl jasmonate treatment
  misc_feature: Encodes the peptide sequence at SEQ ID NO 21677
atggcgccgagcaagaggctggagaagctcaagctcagcacattgttgactttcatgcgttgtcacaggagctctagtgatgatcactcacggattgggacagtcgggttctcccgagtcgtgtacgtcaacgagcctgataggcttcaagaggagggattcagttacccgacgaatgaagtgtcgacgacaaagtacactctggccaccttcctgcccaagtccctcttcgagcagttcaggagggtggccaatttctacttccttgtctctggtatccttgccttgactccactcgcaccttacactgcagtgagcgcacttgcaccgctctgtgtcgtgattgtagccaccatggcaaaagaaggggttgaggactggcggaggaaacaacaggatcacgagctcaataatcggatagtcaaagtgcataggggaaatggtcattttgaagagacaaaatggaagaatatcaaagttggagatgtaataaaggtggagaaggataatttctttcccgctgatatgattctactttcatctaactatccagatggaatctgttatgtagagaccatgaacctcgatggtgaaacaaatttgaaaattaaacaagctctcgaggtgacattggatttacaggaggacataaagttcagggaaatcagacaaacaattaaatgtgaagacccaaatgcgaacctctactcctttgtcggttcaatggaatggagaggccagcagtatcccctgtcacccctacagcttcttcttcgggactcaaaactacggaacacagactacatatatggggctgtcatcttcacaggtcatgatacaaaagtgatgcaaaatgcaaccgaaccaccatctaaaagaagtaaggttgagaagaaaatggataaaattatttaccttctgatgtcttctctactcatgattgcattacttggttctgtcttctttgggatctggaccaaagaggacctaagagatggtgagctcaaacggtggtatcttcggccagatgctactactgtattctatgatccaaagagagcagctctggcatctttctttcatttgttgacggccttgatgctgtacagctacttcatccccatttctttgtatatatccattgagatggtcaagatcttgcaagctgtattcatcaaccaggatattgaaatgtatcatgaagaatcagataagccaactcatgctcgtacttcgaatctgaatgaagaactagggatggttgatacaatactatccgataagactggaacattgacgtgcaacatgatggagttcatcaagtgttcaattgctggcactgcctatggtcagggtgtcactgaagttgagagagctatggctatgaggaaaggtgccaggttagatgatgacattgaaaaaggggaccacaaagacaaaaatttcaacaacagtccccatgttaaagggttcaatttcaaggatccacgaataatggatgggaattggattcatgagcctaacacagatatgataagagattttttccggctcctagccatctgccacacttgcattgctgaaatagacgaaaatgagaaggtttcatatgaagctgagtcccctgatgaagctgcatttgttattgcagcaagagaactagggtttgagttttacaagaggtcgctggcaactataattgttcgtgaacgggatccaagtcaaaatgttgttgagaaacgaaagtatgaactcctaaatatattggagttcagtagttcaaggaaacggatgtctgtgattgtcaaggaaccagagggaaggatattacttctcagcaagggcgcagacagtgtgatgttcagaaggctttcaccaaatggaagaaaatttgaagatgaaacaagaagacacataaatgagtattctgactctggtctaagaaccttggttctagcatatcgtgtcttagatgagagagagtacaaggaattcaatgaaaaattgaacgctgccaaagcatctttaagtgctgatagagatgaaaaaattgagcaggctgctgatagcattgaacgggacttgattcttcttggtgctactgcagttgaagataagctccagcaaggggtgcctgaatgcatagacaagcttgcacaagctggaattaagatatgggtcctgacaggtgacaagatggagacggctatcaatattggcctgcttagacaaggcatgacacagataattgtcacactggaacaacctgacatcatcgcgttagagaaagatggtgacaaacaaaaaatttctaaggcatcaaagcaaaaggttatgggtcagatagaggatggaatcaaacaaattccaccttcaactcaaatcagcactgcatcattcgcactaatcattgatggtaaatcactaacttatgctttggaagatgatgtcaagttgaagttcttggatcttgctatcaagtgtgcatcagtaatatgttgccgatcttcaccaaaacagaaggcactggttacaagacttgttaaagaagtaacacataaagtgactttagcaataggtgatggggcaaatgatgttggcatgcttcaagaagctgacataggggttggcatcagtggtgctgaaggaatgcaggctgtcatggctagtgatgttgctgttgcgcaattccgcttcttggaacggctacttctggtgcatggacattggtgttaccggcgtatttcagtgatgatatgctatttcttctacaagaatgttacttttggtgtcactatctttctgtatgaagcatttgcatctttctccgggaagccagcttataatgattggttcttgtcactctataatgttttcttcacctcccttcctgtcattgctttgggggtatttgaccaggatgtgtctgccaggctgtgcatacagtatccacagctataccaagaaggagtgcagaatatattattcagttggcgtcggatacttggctggatgcttaatggtgttatgaatgctgtgttaatctttttcttctgcatcacttcctttgaggaccaggcgttccgtcaggatggtcaagttgcgggcttggatgctctaggtgtcgtcatgtacacttgtgttgtatgggttgtcaactgtcaaatggctctctctgtgaactacttcaccataatccagcacatattcatatggggcagcattgcagtatggtacctcttcctcttggtttatggtgccataaacccgaggttctcaactacagcctacatggtcttcatcgaacagctggccccagccctctcattttggttggtgacactttttgttgtgatggcaacacttgtcccctacttcagctatgccgcgatccagatccgttttttcccaatgttccacaacaagattcagtggaaacggtacttggggaaggctgaagatccagaagtggcaaggcagttgtcatcacgacaccggacgtcgtcgcagcagaggatggttggtatctctgctcgccgtgatggcaaggctatgcaaataacaaaggagacagagctagaagttcaggagtag

SEQ ID NO: 21677 - protein, 1197 aa, Sorghum bicolor
  misc_feature: Ceres ANNOT ID no. 8738850
  misc_feature: Up-regulated in shoot tissues in response to methyl jasmonate treatment
  misc_feature: Up-regulated in root tissues in response to methyl jasmonate treatment
  misc_feature (38)..(789): SWISSPROT Homolog: EC 3.6.3.1 Phospholipid-translocating ATPase
  misc_feature (788)..(935): SWISSPROT Homolog: EC 3.6.3.9 Sodium/potassium-exchanging ATPase
  misc_feature (421)..(882): Pfam ID: Hydrolase Pfam Description: haloacid dehalogenase-like hydrolase
MAPSKRLEKLKLSTLLTFMRCHRSSSDDHSRIGTVGFSRVVYVNEPDRLQEEGFSYPTNEVSTTKYTLATFLPKSLFEQFRRVANFYFLVSGILALTPLAPYTAVSALAPLCVVIVATMAKEGVEDWRRKQQDHELNNRIVKVHRGNGHFEETKWKNIKVGDVIKVEKDNFFPADMILLSSNYPDGICYVETMNLDGETNLKIKQALEVTLDLQEDIKFREIRQTIKCEDPNANLYSFVGSMEWRGQQYPLSPLQLLLRDSKLRNTDYIYGAVIFTGHDTKVMQNATEPPSKRSKVEKKMDKIIYLLMSSLLMIALLGSVFFGIWTKEDLRDGELKRWYLRPDATTVFYDPKRAALASFFHLLTALMLYSYFIPISLYISIEMVKILQAVFINQDIEMYHEESDKPTHARTSNLNEELGMVDTILSDKTGTLTCNMMEFIKCSIAGTAYGQGVTEVERAMAMRKGARLDDDIEKGDHKDKNFNNSPHVKGFNFKDPRIMDGNWIHEPNTDMIRDFFRLLAICHTCIAEIDENEKVSYEAESPDEAAFVIAARELGFEFYKRSLATIIVRERDPSQNVVEKRKYELLNILEFSSSRKRMSVIVKEPEGRILLLSKGADSVMFRRLSPNGRKFEDETRRHINEYSDSGLRTLVLAYRVLDEREYKEFNEKLNAAKASLSADRDEKIEQAADSIERDLILLGATAVEDKLQQGVPECIDKLAQAGIKIWVLTGDKMETAINIGLLRQGMTQIIVTLEQPDIIALEKDGDKQKISKASKQKVMGQIEDGIKQIPPSTQISTASFALIIDGKSLTYALEDDVKLKFLDLAIKCASVICCRSSPKQKALVTRLVKEVTHKVTLAIGDGANDVGMLQEADIGVGISGAEGMQAVMASDVAVAQFRFLERLLLVHGHWCYRRISVMICYFFYKNVTFGVTIFLYEAFASFSGKPAYNDWFLSLYNVFFTSLPVIALGVFDQDVSARLCIQYPQLYQEGVQNILFSWRRILGWMLNGVMNAVLIFFFCITSFEDQAFRQDGQVAGLDALGVVMYTCVVWVVNCQMALSVNYFTIIQHIFIWGSIAVWYLFLLVYGAINPRFSTTAYMVFIEQLAPALSFWLVTLFVVMATLVPYFSYAAIQIRFFPMFHNKIQWKRYLGKAEDPEVARQLSSRHRTSSQQRMVGISARRDGKAMQITKETELEVQE

SEQ ID NO: 21678 - DNA, 1221 bp, Sorghum bicolor
  misc_feature: Ceres ANNOT ID no. 8739750
  misc_feature: Up-regulated in shoot tissues in response to aminocyclopropane carboxylic treatment
  misc_feature: Up-regulated in shoot tissues in response to salicylic acid treatment
  misc_feature: Encodes the peptide sequence at SEQ ID NO 21679
atgtcgcagcacacgttgctgttcctttttggcttgttggcgtcggcgacccagctgtgtgccgtcgatgcgttgatcgtcaacggcctgcgggtggggttctatggcaagacgtgcccggtggccgagagcgtcatcagcgatatcgtcaacaacgaaatcgctatggaccgcggcatctccccaggcctcattcgcctcttcttccacgactgtttcatcacgggttgcgacgcttctattctcctggacgtgtcgcccgctggcgatgtcccagagaaggagtcgtctgccaacggcttcaccctcgtcggccttagaaccatcgacctcgccaagtccactctagagggcatgtgccccggcacggtctcatgcgcagatatcctcgccttcgcggcgcgggacgccgccgtggccgcgggcctcccaagatacgacgtcgtggcaggacgccgagacggcatgcgctcaaacatggacgacctcccgggcaacttccctgtgccgggccatcacgtcccgcgcctcaccgagctcttcaaccagcgaggcctctcccaggaggatcttgtcttgctctccggcgcgcactccatcgggggcgcacattgctttatgttcgccaaccgcatctacaacttctccaaaaacgccgacatcgacccaacgctggacccgaactatgccaagtggctacgccagaggtgcccgccgcggaagcccgacgacgaccccgagcaagcgcccaaggtgaagttcgatgcgcaaacaggagagaagctcgacgtcgcctactactccgagctgctcgcccggcgcggcctgctcacctctgacaacgctctcatcgaggacccacagacaaaggcgatggttgaggccttcgcccggaacgaagcactgtggcagcagaagttcgcccaggcgatgcagaaggtcggaatgcttgacgtgctcatcggcgagggcaagggccaggtaaggaagcagtgccgcctggtgaacgagcaggagaaggctatcgagcagcagcagccacaacaggaggagcagcagcccccacaggaggaggaggagcagcagcagcagcagccacagccacaccttccgtggttcctgcagaggcgccggccccggccgcagcatcggccacgtgtaccgtttcgccgtcatcctgtggccgacctggtcaacggatttttccgtggttttcactga

SEQ ID NO: 21679 - protein, 406 aa, Sorghum bicolor
  misc_feature: Ceres ANNOT ID no. 8739750
  misc_feature: Up-regulated in shoot tissues in response to aminocyclopropane carboxylic treatment
  misc_feature: Up-regulated in shoot tissues in response to salicylic acid treatment
  misc_feature (30)..(336): SWISSPROT Homolog: EC 1.11.1.7 Peroxidase
  misc_feature (46)..(299): Pfam ID: peroxidase Pfam Description: Peroxidase
MSQHTLLFLFGLLASATQLCAVDALIVNGLRVGFYGKTCPVAESVISDIVNNEIAMDRGISPGLIRLFFHDCFITGCDASILLDVSPAGDVPEKESSANGFTLVGLRTIDLAKSTLEGMCPGTVSCADILAFAARDAAVAAGLPRYDVVAGRRDGMRSNMDDLPGNFPVPGHHVPRLTELFNQRGLSQEDLVLLSGAHSIGGAHCFMFANRIYNFSKNADIDPTLDPNYAKWLRQRCPPRKPDDDPEQAPKVKFDAQTGEKLDVAYYSELLARRGLLTSDNALIEDPQTKAMVEAFARNEALWQQKFAQAMQKVGMLDVLIGEGKGQVRKQCRLVNEQEKAIEQQQPQQEEQQPPQEEEEQQQQQPQPHLPWFLQRRRPRPQHRPRVPFRRHPVADLVNGFFRGFH

SEQ ID NO: 21680 - DNA, 1590 bp, Sorghum bicolor
  misc_feature: Ceres ANNOT ID no. 8740870
  misc_feature: Up-regulated in root tissues in response to methyl jasmonate treatment
  misc_feature: Up-regulated in shoot tissues in response to salicylic acid treatment
  misc_feature: Encodes the peptide sequence at SEQ ID NO 21681
atggcgtcaacggcatactcgcggccatcgaagccgcctgggccggcggccggcgagaggaaaggaccacggctggccaaggagctcggcaggatcgagcccaagaagctgggcatcgggctggtggccggctgctgcctcgcgctgctcacctatctctcctttgcccggctatttgccatctactcgccggtattagacagctcgtccctgttgttgaagaacacgccgccggcaacgacgacggtgccggctacagaggcgctgccggtgcagcaaaagacccaagtggaggaccagaaagatgctcctgaccctgagctggacccgaacatgccaaacttaccagaggtcacacaaaaggatcaacaggaggcggccacggcgacaaagccagccggtgccgtcacagaggccaagatcacctgcgacgagaacggcgttgacgagggcttcccgtacgcgcgccctcccgtgtgcgagctcgccggcgacatccgtatcagccccaaggagaaagccatgtacttggttaacccgtccggcgccggcccgttcgactccaacggggagaagaagattcgcccgttcgcccgcaacgacggcttcctcctcccaggcgtcgtggaggtcaccatcaagtccgtgtcctcggccgcagccgcgccgcagtgcacgcgccggcacgacgtcccggtggtggtcttctccgtggccgggtacacggacaacttcttccacgacaacacggacgtgctgatcccgctgttcctcaccacggcgcacctgaaaggggaggtgcagttcctcatcaccaacttcaagccttggtgggtcaacaagttcacgcccctgctgaagaagctctccaactacgatgtcatcaacttcgacgaggacaaggaggtgcactgcttccgggcaggacacctcgggatgtaccgggaccgcgacctcatcatctcccctcacccgacgcgcaacccgcacaactactccatggtcgactacaaccggttcctccgccgcgccttcagcctgccgcgcgacgcgccggcggtgctcggggcggagaccagcgccaagcctaagatgctcatcatcgagcggaagggcacgcggaagctgctcaacctgcgggaggtggccgcgatgtgcgaggcgctcggcttcgcggtgaccgtggcggaggccggcgctgacgtgcgtggcttcgccgagagggtgaacgcggccgacgtgctcctcgcggtgcacggcgccgggctcacgaaccagatcttcctgccgacgggtgccgtgcttgtgcagatcgtgccctgggggaagatggactggatggcgaccaacttctatgggcagccggcccgcgacatgcggctccggtacgtggagtactacgtctcggaggaggagacgacgctcaaggacaagtaccccagggaccactacgtgttcaaggacccaatgcgcatccacgcgcaggggtggcccgccattgccgagatcatcatgaagcaggatgtcatggtaaacatgacaaggttcaagccgttcctgctcaaggcgctcgacgagttgcaggagtag

SEQ ID NO: 21681 - protein, 529 aa, Sorghum bicolor
  misc_feature: Ceres ANNOT ID no. 8740870
  misc_feature: Up-regulated in root tissues in response to methyl jasmonate treatment
  misc_feature: Up-regulated in shoot tissues in response to salicylic acid treatment
MASTAYSRPSKPPGPAAGERKGPRLAKELGRIEPKKLGIGLVAGCCLALLTYLSFARLFAIYSPVLDSSSLLLKNTPPATTTVPATEALPVQQKTQVEDQKDAPDPELDPNMPNLPEVTQKDQQEAATATKPAGAVTEAKITCDENGVDEGFPYARPPVCELAGDIRISPKEKAMYLVNPSGAGPFDSNGEKKIRPFARNDGFLLPGVVEVTIKSVSSAAAAPQCTRRHDVPVVVFSVAGYTDNFFHDNTDVLIPLFLTTAHLKGEVQFLITNFKPWWVNKFTPLLKKLSNYDVINFDEDKEVHCFRAGHLGMYRDRDLIISPHPTRNPHNYSMVDYNRFLRRAFSLPRDAPAVLGAETSAKPKMLIIERKGTRKLLNLREVAAMCEALGFAVTVAEAGADVRGFAERVNAADVLLAVHGAGLTNQIFLPTGAVLVQIVPWGKMDWMATNFYGQPARDMRLRYVEYYVSEEETTLKDKYPRDHYVFKDPMRIHAQGWPAIAEIIMKQDVMVNMTRFKPFLLKALDELQE

SEQ ID NO: 21682 - DNA, 1707 bp, Sorghum bicolor
  misc_feature: Ceres ANNOT ID no. 8741347
  misc_feature: Up-regulated in root tissues in response to salicylic acid treatment
  misc_feature: Up-regulated in shoot tissues in response to salicylic acid treatment
  misc_feature: Encodes the peptide sequence at SEQ ID NO 21683
atgtcgtcagcaggtgtgatcgtcctggggccaatcccagaagaccctgccttcctgcccatcagcttcactggcagccggtcgccacactgctcgtctgggtcacagctgcaggattccattcttattttccttgctgtgcctggtatgccacccatgcccatgagcgtgctaggatctgagtccattgcctcggtcaagctgcgcatccagcggttcaagggctttgtggtgacgaagcagcggcttgtgctggatgggcatgagctggcaagaaacaactgcccagtcaaggattatgggctggccgagggaaatgttctgcaccttgttattcggctttctgatctccgtgtgatcaacattgagactgccactggaaagaagtttcaatttcaggtggatcagagccgcaatgttaagtttctcaagaacaagcttgcagcagagggtgatgaggatattggtaatcttgaggatcacaaacttgaatatgatggtgaggagcttgaggaccaccagcttgtagctgatattagcaagagggatgatgctgtgattcatttgttcatccgcaaaccagcaaaggtgcggacacaacaagttgacagagatactttggttacagttatcaatccacaggagaaaggcaacctgcaaaatgaagctcgtgcaatgaactccgcaagatcagttggggttaggcctgctcctgttgaaccaatagttaaccgaaaagtgaagctatcacctgaagtgatgaagatgataaattcaaccatagctggactggagaaagggcacctgcctgtgatgtcagctgaaggttcaggaggtgtttatttcatgcgagatgcagcaggtcagaagaatgttgctgtgtttaagcctattgatgaggaacccatggccaaaaacaacccaaggggccttcctttgtccacagatggggaggggatgaagaggggaacaattgtaggggaaggtgcattcagggaggttgcggcttatattcttgaccatcccgttagtgatagtaaatctggtcacagtgtagggttttctggtgtgcctcccaccacattggtccgaaccttacatagggggaagagcttcaagattggttcactgcagatgttcatggagaacaatggaagcactgaagatatgggtcctcgaccttttcctgtcaaggaggttcacaaaatagcagtactagatattaggttagctaatgctgatcgtcatgctgggaatattctagtgtgcaaggagggagaacttggcaactacaagctgattccaattgatcatggttattgcttgccagagaagtttgaagattgtacatttgagtggctctactggccccaagcccgtgagccattcaatgatgaaaccattgaatacatcaaatcacttgatgctgaagaagacatcaagcttctcaagttccatgggtgggagctgcctccacgatgtgctcgtgtcctgcgcatcagcacaatgcttttgaagaaaggtgcagctcgtggcctcacaccacatgacatagggcgcatactatgcagggaaactgtgaataggggctctgagattgaggatatcattcaggaagcagaggatgctgttctcccagggtccagtgaaaacatgtttgtagaaactgtatctgaaatcatagaccatcaccttgacaaggagtga

SEQ ID NO: 21683 - protein, 568 aa, Sorghum bicolor
  misc_feature: Ceres ANNOT ID no. 8741347
  misc_feature: Up-regulated in root tissues in response to salicylic acid treatment
  misc_feature: Up-regulated in shoot tissues in response to salicylic acid treatment
  misc_feature (251)..(340): SWISSPROT Homolog: EC 2.7.1.67 1-phosphatidylinositol 4-kinase
  misc_feature (276)..(525): Pfam ID: PI3_PI4_kinase Pfam Description: Phosphatidylinositol 3- and 4-kinase
  misc_feature (46)..(115): Pfam ID: ubiquitin Pfam Description: Ubiquitin family
  misc_feature (123)..(194): Pfam ID: ubiquitin Pfam Description: Ubiquitin family
MSSAGVIVLGPIPEDPAFLPISFTGSRSPHCSSGSQLQDSILIFLAVPGMPPMPMSVLGSESIASVKLRIQRFKGFVVTKQRLVLDGHELARNNCPVKDYGLAEGNVLHLVIRLSDLRVINIETATGKKFQFQVDQSRNVKFLKNKLAAEGDEDIGNLEDHKLEYDGEELEDHQLVADISKRDDAVIHLFIRKPAKVRTQQVDRDTLVTVINPQEKGNLQNEARAMNSARSVGVRPAPVEPIVNRKVKLSPEVMKMINSTIAGLEKGHLPVMSAEGSGGVYFMRDAAGQKNVAVFKPIDEEPMAKNNPRGLPLSTDGEGMKRGTIVGEGAFREVAAYILDHPVSDSKSGHSVGFSGVPPTTLVRTLHRGKSFKIGSLQMFMENNGSTEDMGPRPFPVKEVHKIAVLDIRLANADRHAGNILVCKEGELGNYKLIPIDHGYCLPEKFEDCTFEWLYWPQAREPFNDETIEYIKSLDAEEDIKLLKFHGWELPPRCARVLRISTMLLKKGAARGLTPHDIGRILCRETVNRGSEIEDIIQEAEDAVLPGSSENMFVETVSEIIDHHLDKE

SEQ ID NO: 21684 - DNA, 1611 bp, Sorghum bicolor
  misc_feature: Ceres ANNOT ID no. 8741655
  misc_feature: Down-regulated in shoot tissues in response to salicylic acid treatment
  misc_feature: Encodes the peptide sequence at SEQ ID NO 21685
atggacccggacttctcgcgggcgagtggggggccgagctttgagttcgccttcaactcggtcaacttctccgaccgggtgttgcggatcgagatcgtcgctggggatgacgccctcggggccaagggcgccgccggcgaggggtgctcgtcgcttgccgactgggcgcgccaccgcaagcggcgacgggaggagctccgacgcggcaaagaatctggaaaatacatgccagacccaggaaactgcaaagttgaagctgaagaatgtgatgcctacgaggaaggcaatgagcctgtagctatgatagaagaatctccacctgatattgagccagatggtgaggatggagaaagcagcgactcatcctggagtatggagtgtactcaggttttgagagtaaagtctatctacatcagctctgcaattctagctgcaaagagccctttcttttacaagcttttttcaaatggaatgaaagaatccgatcagaggcatgcaactcttagaataactgcttcagaggaaaatgcgctgatggagcttctaagctttatgtatagtggcaagttgacgacaaaccagccaactgccctgctggatatattgatggtcgctgacaaatttgaggttgtttcctgtatgcggcactgcagtcaattgcttagaagtttgcctatgaccacagagtctgcactgctctatctggatctaccctcaagcatttcaatggctgctgcagttcagccactgacagacaccgccaaggaattccttgccaataaatacaaggatttgacgaagttccaagatgaagcaatgaacattcctcttgctggaattgaagccatcctatggagtaacgaccttcaggttgcatcagaggatgctatctacgactttgtgataaagtgggcacgtgctcaatacccaaaattggaggaaagacgtgagatcttgggcacacgcttgctgccccttgttcggttctgccatatgacctgcaggaagttgcggaaggttcttgcttgcagtgatctggatcatgagcaggcgactaaatgtgtcacagaggcacttctttacaaagctgatgcaccacataggcagcgtgcccttgcagcagatgtgatgacatgtaggaaatatgctgagcgagcttacaaatatcgtccgcttaaggttgtagagtttgatagaccatatccgcagtgcatagcatacttggacctgaagcgtgaggagtgcagccgactttttccatccggacggatatactcacaagctttccatctagctggacagggtttcttcctctcagcacactgcaacatggaccagcaaagtgcattctattgttttggtctcttcctaggaatgcaagagaaagggtcgacaagtgttacggtggattatgagtttgctgcaaggacaaggccgtcaggtgagtttgtcagcaaatataagggctactataccttcactggtggcaaggcggttgggtaccggaatctctttgcgatcccgtggccatcattcatggccgatgacagtctcttcttcatcgacggggtattgcatctcagagctgagctgaccataaaacagccctag

SEQ ID NO: 21685 - protein, 536 aa, Sorghum bicolor
  misc_feature: Ceres ANNOT ID no. 8741655
  misc_feature: Down-regulated in shoot tissues in response to salicylic acid treatment
  misc_feature (124)..(225): Pfam ID: BTB Pfam Description: BTB/POZ domain
  misc_feature (234)..(342): Pfam ID: BACK Pfam Description: BTB And C-terminal Kelch
MDPDFSRASGGPSFEFAFNSVNFSDRVLRIEIVAGDDALGAKGAAGEGCSSLADWARHRKRRREELRRGKESGKYMPDPGNCKVEAEECDAYEEGNEPVAMIEESPPDIEPDGEDGESSDSSWSMECTQVLRVKSIYISSAILAAKSPFFYKLFSNGMKESDQRHATLRITASEENALMELLSFMYSGKLTTNQPTALLDILMVADKFEVVSCMRHCSQLLRSLPMTTESALLYLDLPSSISMAAAVQPLTDTAKEFLANKYKDLTKFQDEAMNIPLAGIEAILWSNDLQVASEDAIYDFVIKWARAQYPKLEERREILGTRLLPLVRFCHMTCRKLRKVLACSDLDHEQATKCVTEALLYKADAPHRQRALAADVMTCRKYAERAYKYRPLKVVEFDRPYPQCIAYLDLKREECSRLFPSGRIYSQAFHLAGQGFFLSAHCNMDQQSAFYCFGLFLGMQEKGSTSVTVDYEFAARTRPSGEFVSKYKGYYTFTGGKAVGYRNLFAIPWPSFMADDSLFFIDGVLHLRAELTIKQP

SEQ ID NO: 21686 - DNA, 2391 bp, Sorghum bicolor
  misc_feature: Ceres ANNOT ID no. 8741837
  misc_feature: Up-regulated in shoot tissues in response to salicylic acid treatment
  misc_feature: Encodes the peptide sequence at SEQ ID NO 21687
atggaaggcgaggcggcggcggcggcggccgaggcggtggcgcggatacggctggtgcggtgccccaagtgcgacaagttcttaccggaactgcctgcctactccgtctacgtctgcggcggatgcggcgccaccctccaagcaaagaagaagaattcagcccaatcgtcacatgacgctgacaatggaaatgtgaaataccttgaagtactggagcgtgttccagaggcatctgcaagaaaacatggagctagtactactgataggtcagaaaccagtaaaatggcagatgtacatatcaaacaagtttattatggccatcacgatagcattcagactgggccaagtccctcaaatctgaacgcttctattagagatgatggcaaggaggcaaagtaccgacacattcgttattgggagaatggtgaaatggggcaatcattgagagtaagagacatgtccccaaagtcaccagccaatgcttatcagggtgagtgccattcgaagctgaggtacaactattctgctaaggaatgcccaggtgaaagaaatttggatggtccaagcagagtgagggggcttgagaaagaccgcactgagatcttaaggatgcttgatgagttgagagaccaggtacagcaatcttgcgatgcaactaatgggccaagtggaagtgccccaactactacagcagcagattcccacatttcatatggtacttctgaccgattgaatcaattgaggcatattccaccacaattgcatcggaatgattcacatcacaccccatcattgaatgtacaaagtcctagtgtttctcgtgtttatgctcccctgcctgcacaacaagattgtgtcggatatgcagagctcatttcacatgctagacgctctagctatcctgccagcctctatccatggagaaattttgataattatttctttggacagcatgatcctgattctcttctctcttgccgccatgatggcttctatcaccaagctgcctgttcttgcttgcattgttgccaccaagaattcttgcctgtacagggaaatcacatgggcttcaatgatcaaagggcaccatatcttctgaacggttatggggcttatcctgtggacagtcccttacttggtcagcaaagatacagtagaagagccatcaatactaccttgcagcagaatcacatgagggtcaacgttagcaagaagcctgcacagacttgtgagccggtcgcaggtggtgcccctttcaccatatgctgcaattgctatgaagttctgcagataccaaggaaacagtccctgtcaggaaatgagtacaaattgcgttgtggatcatgctcacatgcaattctagtcaagcttgatggaaacaggctcaatgtatcagaaattgcactaggtacacatttatctgatggacaggaaaatgacatgggaaccgatgggcaaactccggacaataggtccattccagcttatcgtttttctgttggaagtcctgcatctcaagaaaaagacctgcactcaaatttgagtgagtcagagaacaaccatacccctctagcaactgactcagagggcacttcccagtccagggatcttcctcctgaagacagtgcagtttcccatgtaccaaacttaccacatcgtagtcattctggatcatctccatcagaacattctggagtgggaagtagaagtacacattctgaacctgaaaaagttataccattaactgaaacttccaagcagaattcagttaaaggtatatgtgtatcaaacaagatgcaatctccaaacaatgagtttgatgttactgaatacacagatgatacattaaatgcgcagcaagatactgagcaccctaaagcaacaaaggacaacaattcttttctcactaatctgataaaaaagagcttcaaaattaataatggaatgcgcaacggaagagcaaggatttatgtaaatggctttcctatctctgatcgtgcggtcaggaaggctgagaagctagctggatcaatctgccctggaaactattggtatgactaccatgctgggttctggggtgttatgggacgtccctgccttggcatgataccaccttatattccagaatttaatttccccatgcccaagaactgtgctggcggaaacacaggcgtatttgttaatggaagagaacttcaccagaaggatttggatttacttgtcactagaggactctctgattcccctggtagatcttatgtagttgaaaattctggaaaggtttcagatgaagtatctggtgaagaactttatggccttggaaaacttgcaccaacagttgagaaaatggggcgtggatttggcatgcgcgtcccaaggttcatccagtga

SEQ ID NO: 21687 - protein, 796 aa, Sorghum bicolor
  misc_feature: Ceres ANNOT ID no. 8741837
  misc_feature: Up-regulated in shoot tissues in response to salicylic acid treatment
MEGEAAAAAAEAVARIRLVRCPKCDKFLPELPAYSVYVCGGCGATLQAKKKNSAQSSHDADNGNVKYLEVLERVPEASARKHGASTTDRSETSKMADVHIKQVYYGHHDSIQTGPSPSNLNASIRDDGKEAKYRHIRYWENGEMGQSLRVRDMSPKSPANAYQGECHSKLRYNYSAKECPGERNLDGPSRVRGLEKDRTEILRMLDELRDQVQQSCDATNGPSGSAPTTTAADSHISYGTSDRLNQLRHIPPQLHRNDSHHTPSLNVQSPSVSRVYAPLPAQQDCVGYAELISHARRSSYPASLYPWRNFDNYFFGQHDPDSLLSCRHDGFYHQAACSCLHCCHQEFLPVQGNHMGFNDQRAPYLLNGYGAYPVDSPLLGQQRYSRRAINTTLQQNHMRVNVSKKPAQTCEPVAGGAPFTICCNCYEVLQIPRKQSLSGNEYKLRCGSCSHAILVKLDGNRLNVSEIALGTHLSDGQENDMGTDGQTPDNRSIPAYRFSVGSPASQEKDLHSNLSESENNHTPLATDSEGTSQSRDLPPEDSAVSHVPNLPHRSHSGSSPSEHSGVGSRSTHSEPEKVIPLTETSKQNSVKGICVSNKMQSPNNEFDVTEYTDDTLNAQQDTEHPKATKDNNSFLTNLIKKSFKINNGMRNGRARIYVNGFPISDRAVRKAEKLAGSICPGNYWYDYHAGFWGVMGRPCLGMIPPYIPEFNFPMPKNCAGGNTGVFVNGRELHQKDLDLLVTRGLSDSPGRSYVVENSGKVSDEVSGEELYGLGKLAPTVEKMGRGFGMRVPRFIQ

SEQ ID NO: 21688 - DNA, 2886 bp, Sorghum bicolor
  misc_feature: Ceres ANNOT ID no. 8742456
  misc_feature: Down-regulated in shoot tissues in response to methyl jasmonate treatment
  misc_feature: Up-regulated in root tissues in response to methyl jasmonate treatment
  misc_feature: Down-regulated in shoot tissues in response to aminocyclopropane carboxylic treatment
  misc_feature: Down-regulated in shoot tissues in response to salicylic acid treatment
  misc_feature: Encodes the peptide sequence at SEQ ID NO 21689
atggcgtccgagcggcaccactccatcgacgcgcagctccgtgccctcgcacccggcaaggtctccgaggagctcatccagtatgacgccctgctcgtcgaccgcttcctcgacatcctccaggacctccatggccccagccttcgcgaatttgtccaggagtgctacgaggtgtcggccgactacgagggcaagaaagacacgtccaagctgggggagctgggagccaagctgacggggctggcccccgccgacgccatcctggtggcgagctccatcctgcacatgctcaacctcgccaacctggcggaggaagtggagctggcgcaccgccgccggaacagcaagctcaagcacggggacttctccgacgagggctccgccaccaccgagtccgacatcgaggagacgctcaagcgcctcgtgtcgctcggcaagacccccgcggaggtgttcgaggcgctcaagaaccagagcgtcgacctcgtcttcaccgcgcatcccacgcagtccgccaggaggtcgctcctgcagaaaaacgccaggatccggaattgtctgacgcagctgagtgccaaggacgtcacggtcgaagacaagaaggagctcgacgaggctctgcacagagagatccaagcagctttcagaactgatgaaatcaggagagcacaacccaccccacaggatgaaatgcgctatgggatgagctacatccatgaaactgtatggaacggtgtgcctaagtttttgcgccgtgtggatacagccctgaagaatatcggcatcaatgagcgccttccctacgatgttcctctcattaagttctgttcttggatgggtggtgaccgtgatggaaatccaagagttactccggaggtgacaagagatgtgtgcttgctgtctagaatgatggctgcaaacttgtacatcaatcaggtcgaagacctgatgtttgagctctctatgtggcgctgcaatgatgagcttcgtgctcgagccgaagaagtccagagtactccagcttcaaagaaagttaccaagtattacatagaattctggaagcaaattcccccaaacgagccctaccgggtgatccttggtgctgtaagggacaagttatacaacacacgcgagcgtgcacgccatctgctggcaactggattttctgaaatttctgaggacgcggtatttaccaagatcgaagagttccttgagccccttgagctgtgctacaaatccctgtgtgagtgcggcgacaaggccatcgccgacgggagcctcctggacctccttcgccaggtgttcgcgttcggtctctccctggtgaagctggacatccggcaggagtcggagcggcacaccgacgtgatcgacgccatcaccacgcacctcggcatcgggtcgtaccgctcgtggcccgaggacaagcggatggagtggctggtgtcggagctgaaaggcaagcgcccactgctgcccccggaccttcccatgaccgaggagatcgccgacgtcatcggcgccatgcgcgtcctggccgagctcccgatcgacagcttcggcccctacatcatctccatgtgcacggcgccctcggacgtgctcgccgtcgagctcctgcagcgcgagtgtggcattcgccagacgctccccgtggtgccgctgttcgagaggctggccgacctgcaggcggcgccggcgtccgtggagaagctcttctccactgactggtacatcaaccacatcaacggcaagcagcaggtgatggtcggctactccgactccggcaaggacgccggccgcctgtccgcggcgtggcagctgtacgtggcgcaggaggagatggccaaggtggccaagaagtacggcgtgaagctgaccttgttccacggccgcggtggcaccgtcggcaggggcggtggcccgacgcacctcgccatcctgtcccagccgccggacaccatcaacgggtccatccgtgtgacggtgcagggcgaggtcatcgagttcatgttcggggaggagaacctgtgcttccagtctctgcagcggttcacggccgccacgctggagcacggcatgcacccgccggtgtctcccaagcccgagtggcgcaagctcatggaggagatggccgtcgtcgccacggaggagtaccgctccgtcgtcgtcaaggagccgcgattcgtcgagtacttcagatcggctacccctgagactgagtacgggaagatgaacatcggcagcaggccagccaagaggaagccgggcggcggcatcaccaccctgcgtgccatcccctggatcttctcgtggacacagacgaggttccacctccccgtgtggctgggagtcggcgccgccttcaagtgggccatcgacaaggacatcaagaacttccagaagctcaaggagatgtacaacgagtggccattcttcagggtcaccctggacctgctggagatggttttcgccaagggagaccctggcattgccggcttgtacgacgagctgcttgtcgccgaggaactcaagccctttgggaagcagctcagggacaaatacgtggagacacagcagcttctcctacagatcgctgggcacaaggacattcttgaaggcgatccttacctgaagcaggggctgcgtctgcgcaatccctacatcaccaccctgaacgtgttccaggcctacacgctgaagcggataagggaccccagcttcaaggtgacgccgcagccgccgctgtccaaggagttcgccgacgagaacaagcccgccggactggtgaagctgaacccggcgagcgagtacccgccggggctggaagacacgctcatcctcaccatgaagggtatcgccgccggcatgcagaacaccggctag

SEQ ID NO: 21689 - protein, 961 aa, Sorghum bicolor
  misc_feature: Ceres ANNOT ID no. 8742456
  misc_feature: Down-regulated in shoot tissues in response to methyl jasmonate treatment
  misc_feature: Up-regulated in root tissues in response to methyl jasmonate treatment
  misc_feature: Down-regulated in shoot tissues in response to aminocyclopropane carboxylic treatment
  misc_feature: Down-regulated in shoot tissues in response to salicylic acid treatment
  misc_feature (1)..(961): SWISSPROT Homolog: EC 4.1.1.31 Phosphoenolpyruvate carboxylase
  misc_feature (8)..(961): Pfam ID: PEPcase Pfam Description: Phosphoenolpyruvate carboxylase
MASERHHSIDAQLRALAPGKVSEELIQYDALLVDRFLDILQDLHGPSLREFVQECYEVSADYEGKKDTSKLGELGAKLTGLAPADAILVASSILHMLNLANLAEEVELAHRRRNSKLKHGDFSDEGSATTESDIEETLKRLVSLGKTPAEVFEALKNQSVDLVFTAHPTQSARRSLLQKNARIRNCLTQLSAKDVTVEDKKELDEALHREIQAAFRTDEIRRAQPTPQDEMRYGMSYIHETVWNGVPKFLRRVDTALKNIGINERLPYDVPLIKFCSWMGGDRDGNPRVTPEVTRDVCLLSRMMAANLYINQVEDLMFELSMWRCNDELRARAEEVQSTPASKKVTKYYIEFWKQIPPNEPYRVILGAVRDKLYNTRERARHLLATGFSEISEDAVFTKIEEFLEPLELCYKSLCECGDKAIADGSLLDLLRQVFAFGLSLVKLDIRQESERHTDVIDAITTHLGIGSYRSWPEDKRMEWLVSELKGKRPLLPPDLPMTEEIADVIGAMRVLAELPIDSFGPYIISMCTAPSDVLAVELLQRECGIRQTLPVVPLFERLADLQAAPASVEKLFSTDWYINHINGKQQVMVGYSDSGKDAGRLSAAWQLYVAQEEMAKVAKKYGVKLTLFHGRGGTVGRGGGPTHLAILSQPPDTINGSIRVTVQGEVIEFMFGEENLCFQSLQRFTAATLEHGMHPPVSPKPEWRKLMEEMAVVATEEYRSVVVKEPRFVEYFRSATPETEYGKMNIGSRPAKRKPGGGITTLRAIPWIFSWTQTRFHLPVWLGVGAAFKWAIDKDIKNFQKLKEMYNEWPFFRVTLDLLEMVFAKGDPGIAGLYDELLVAEELKPFGKQLRDKYVETQQLLLQIAGHKDILEGDPYLKQGLRLRNPYITTLNVFQAYTLKRIRDPSFKVTPQPPLSKEFADENKPAGLVKLNPASEYPPGLEDTLILTMKGIAAGMQNTG

SEQ ID NO: 21690 - DNA, 1590 bp, Sorghum bicolor
  misc_feature: Ceres ANNOT ID no. 8742611
  misc_feature: Up-regulated in shoot tissues in response to methyl jasmonate treatment
  misc_feature: Down-regulated in shoot tissues in response to aminocyclopropane carboxylic treatment
  misc_feature: Up-regulated in root tissues in response to methyl jasmonate treatment
  misc_feature: Up-regulated in root tissues in response to salicylic acid treatment
  misc_feature: Encodes the peptide sequence at SEQ ID NO 21691
atggccatggccaagagcttatcgccgccggcggtgctcatatttgccttgctcttcagctacgccgcctccatcgcgtcctcccaagctacatcgtcgtccgatggcttcctccaatgcctctcggcgagcatccccagccagctcgtcttcacacagagctcgccttcgttcacgccgctgctcaagtcctccatcaagaaccccaagttcttcacgcccagcatcgtgcggccgctctacatcgtcacgccgacgaacgcctcccacgttcaggccgccgtgctctgcggccgccggaacgggatgcgcatccgcgtgcgcagcggcggccacgactacgagggcctgtcgtaccggtccgagcgccccgaggtgttcgcggtgctcgacctgtcaaacctccgcgccgtgcgcgtcgaccggcagacctccaccgcgtgggtcgactccggcgcgacgctcggcgagctctactacgccgtcgggaaggccagcaaccttctagggttcccggccggcctgtgcccgaccgtcggcgtcgggggacatttcagcggcggcggcttcggcatgctgctgcgcaagtacggcctcgccatcgacaacgtcgtcgacgcggtcctggtggacgccaaggggaggctcctgaacaagaacaccatgggcagcgacgtcttctgggccatccgaggcggcggcggcgagagcttcggcgtcgtgctgtcgtggcaggtgaagctcgtccccgtcccggcgaccgtcacggtgttcaacgtcccggtgtccgccagccagggcgccgtggacgtggtcaccaggtggcagcaggtggcgccatccctgccggacgacctcttcatcagggtgctcgtccagcagcagacggccaccttccagtccctgttcctcggcacctgcgacgcgctcctgccggtgatgagcagccggttcccggagctgcggttcaaccggacctcctgcaaggagatgacgtggatccagtccgtgccctacatctacctcggcagcggctccacggtggaggacctcctgaaccggaccaccgccgcctccgtcttcagcagcggctacaaggcgacgtccgactacgtccggcaggccatcccgcggggcgtgtgggcgaacatcttcagcaagctcgcgcagcccaacgcggggctgatgatcctggacccctacggcggcgcgcggatcggcggcgtgccggagtcggcgacgccgttcccgcaccgcgccggcgtgctgtacaacatccagtacatgaacttctggtccatggcggggggagacggcgccgtgcagaccaagtggatcagggacttctacgcgttcatggcgccgtacgtgagctccaacccgagggaggcctacttcaactacagggacctggaccttggcgagaacgtcgttgtcggcaacgtgagcagctaccaggcaggtatggtgtggggacacaagtacttcaaggacaactacaggaggctcgccatggccaagagtcagatagaccccgacgactacttcaggaacgagcagagcatcccgccacttgcgaacagcaactag

SEQ ID NO: 21691 - protein, 529 aa, Sorghum bicolor
  misc_feature: Ceres ANNOT ID no. 8742611
  misc_feature: Up-regulated in shoot tissues in response to methyl jasmonate treatment
  misc_feature: Down-regulated in shoot tissues in response to aminocyclopropane carboxylic treatment
  misc_feature: Up-regulated in root tissues in response to methyl jasmonate treatment
  misc_feature: Up-regulated in root tissues in response to salicylic acid treatment
  misc_feature (52)..(525): SWISSPROT Homolog: EC 1.21.3.3 Reticuline oxidase
  misc_feature (79)..(220): Pfam ID: FAD_binding_4 Pfam Description: FAD binding domain
  misc_feature (464)..(523): Pfam ID: BBE Pfam Description: Berberine and berberine like
MAMAKSLSPPAVLIFALLFSYAASIASSQATSSSDGFLQCLSASIPSQLVFTQSSPSFTPLLKSSIKNPKFFTPSIVRPLYIVTPTNASHVQAAVLCGRRNGMRIRVRSGGHDYEGLSYRSERPEVFAVLDLSNLRAVRVDRQTSTAWVDSGATLGELYYAVGKASNLLGFPAGLCPTVGVGGHFSGGGFGMLLRKYGLAIDNVVDAVLVDAKGRLLNKNTMGSDVFWAIRGGGGESFGVVLSWQVKLVPVPATVTVFNVPVSASQGAVDVVTRWQQVAPSLPDDLFIRVLVQQQTATFQSLFLGTCDALLPVMSSRFPELRFNRTSCKEMTWIQSVPYIYLGSGSTVEDLLNRTTAASVFSSGYKATSDYVRQAIPRGVWANIFSKLAQPNAGLMILDPYGGARIGGVPESATPFPHRAGVLYNIQYMNFWSMAGGDGAVQTKWIRDFYAFMAPYVSSNPREAYFNYRDLDLGENVVVGNVSSYQAGMVWGHKYFKDNYRRLAMAKSQIDPDDYFRNEQSIPPLANSN

SEQ ID NO: 21692 - DNA, 4479 bp, Sorghum bicolor
  misc_feature: Ceres ANNOT ID no. 8742906
  misc_feature: Up-regulated in root tissues in response to methyl jasmonate treatment
  misc_feature: Up-regulated in shoot tissues in response to salicylic acid treatment
  misc_feature: Up-regulated in root tissues in response to salicylic acid treatment
  misc_feature: Encodes the peptide sequence at SEQ ID NO 21693
atggccgacaacggcgatccggccatggcccttcttggctggtcgtcatcttggatctgcgggggagaggacgacgacggcgggcggctcaccgtcgcgtccccgtgcgtgcagaggaccctcatagactgcgtcaatgtggtcctgctcgtcgcctacgtctccacgctggcggtggcggctgcctgcgtcaggcggaggcagcgcgctgcaactgcaacagcggcaagccggaggagcggtgctcctgggtctgggtgggttctgctcgtcgtctcctcgtgctgcgtggcggctgccgtggcgtacggtgtcaccggtctccaggacgcctccgacgtcagggcggcggttccttacttcgtcagggccctggtctggatcgcgctggcggcgtcgctgcacgtccggccgacgaggccggcgagggccgtggccgtgctctggtgggtgctcttctcgctgctggtcaccgcgtacaatgtggagatccttgccgggggccacggcctcgacctcgccgagacgatctcgtggccggtgagcctcctcctcctgctctgcgccctcggctccctgctgcggcggggccacggggacgcctccaacgacagcggcggcttgtcagagcctctgatcggcggcaaagacgacagagccgccgtgccaacctcggagctgtaccgtgctggcctgttcggccagctcgccttctcgtggctgaaccctctgctccgtgtcggccgctccaaggcgctggacctcggcgacatcccgctcatcgccgacgaggacaccgcgcaccacacgtcgcagaagttcgccgaggactggagccgccacgtgggtgacaaggccaggagccgccggagagtagtaggcagcaacagcctcgccctcgtcctgctcaagtgcttcctcggcgagatcctgctcaccggcttctacgccttgctgagaacgctgtccatagcggttgctccattgctgctcttcgcgttcgtgtggtacagcaaccaggaggagcgagacctccgggtcggcctggtccttgtcggctgcctgctgatcaccaagctcatcgagtcgctctcgcagcggcattggttctttacctcgaggaggaccgggatgcgtatccggtcagcgctgatggcggtcatcttccagaagcagctcaggctgtccagtcaagggaggaagaaccactccactggcgagatcgtcaactacattgcggtcgatgcgtaccggctgggcgacgccatcagctggctgcacatggggtggagctcgccacttcagctggtcttctcagtcgccacgctcttctgggcactcaagcttggggctcttccaggtctggtcccccttgtcatctttggcttcctcaacgtgccattcgcgaaaatgctgcaggggtaccaggccaagttcatggttgcccaggacgagaggctccggtccacgtcggagatacttaacagcatgaagatcatcaagctgcagtcatgggaagacaagtttcgccaaatgatcgagtcactcagggacggggagttcaaatggctcaaggagactcagatgaagaaggcctacggtgcagtcatgtactggatgtccccgacggtcgtctctgctgtgatgtacacagcgacggccatcatggggagtgctcccctgaatgctagcacactcttcaccgtcttggccaccctgagggtaatggctgagccagtgaggtttcttccagagatcctaacaatgatgatccagtacaaggtgtcattagatcgaatagagaagtttcttctcgaagacgagatcagagaggaggatgtgaaaagagtgccttcagataactctgatgtcagagttcaagtccaagatggaaatttcagctggaaggcaaccggagctgatttgtcactgaggaatgttaaccttcgcataaatagaggagagaaggtggccgtatgcggcccagttggctcagggaaatcttcgctcctgtatgcattacttggggagataccaagaatatcaggatcggttgcggtgtttggttcagtggcatatgtttcacagagctcgtggatacagagtgggactgttcgtgacaatatactctttgggaagcctttccacaaggaactgtatgataaggcaatcaaatcttgtgctctggacaaggatatcgaaaattttgatcatggagacctcacagagattggtcagagaggactgaacatgagtggtggtcagaagcaaaggattcagctggctcgagccgtctacaatgacgcagatgtttatctactggatgacccattcagtgcagttgatgcgcacaccgctgctgttcttttttatgaatgtgtaatgacagcacttgcagagaagaccgttgttcttgtgacccaccaggttgaatttctgaccgaaaccaatagaattctggtaatggaaggtggtcaagttagtcaacaagggaaatattcagaacttctaggatctgggacagcatttgagaagctggtttctgctcatgaggcttcgatcacagcattggatactagtgccagccaacagaaccaagatcaagggcaacaagcgtttgatgaatacatagtgccaagtgcactgcaggttataaggcaggccagcgacattgaagtcaccgcaaagggaccttcagcagcaatacagcttacagaggaggaagagaagggcattggcgacctgggatggaagccatacaaagactacataaatgtacccaaggcggctttccaattctctggcatgtgtacttctcaggtgctcttcacgtgcttccagatcgcatccacatattggttggcggtggctgttcagatggatagtgtcagtgctgcacttcttgttggggcatattctggactctctatcttcagctgctgcttcgcctactttagaagcctttttgcggctaatctgggtctcaaggcctccaaagcattctttggcgggctaatggattccgtattcaaggctcccatgtcattttttgactcaacaccagtaggaagaattttaacaagggcatcttcagatttaagcattctagacttcgacataccttactccatggcttttgtggcgacgggcgctattgaggttgttaccacagtcctggtcatgggtactgtaacttggcaagtcttggttgtagctatccctgttgcgatcaccatgatatatgttcagaggtactacgtttcctcagctagggagctagtaagaatcaatggaacgacaaaggcacctgtaatgaactatgcatcagaatcaattcttggtgtggtgacgatcagggcatttgcagcaactgagaggtttatccacagcaacatgcagctcatcgacactgatgcgacactgttcttccatactgttgcagcacaagagtgggtgctcataagagtagaggcactgcagtccttgacaataattacagcagcattgttccttgttctggttcctccaggagcaatttcaccaggctttgcaggactttgtctctcctatgctttgacgttgactgcagcacaagttttcttgacaaggttctattcctacttggaaaactacatcatctctgttgaacgaatcaaacagtatatgcacctcccagtggagccaccagccattataccagaaaatagacctccaacttcatggccacaggagggaaggatagacctgcaagatttaaagataagataccgtccaaacgcaccgctcgtcctcaaaggaatcacttgcaccttttctgctgggaacaagattggggttgtagggaggacaggaagtgggaaatcaacacttatcagctcattgttccgtctcgttgatccggcgggtgggaagatacttattgacaagttggatatttgctccattggccttaaggatctaaggactaaactaagtattatccctcaagaacctacacttttcaggggaaccgtgcgcaccaatttagatcccctcggcctgcattctgatcaagagatatgggaggccttggagaagtgtcaactaaagacagcaatcagcagcacctctgctcttcttgatacagttgtgagtgatgatggcgataactggagtgctggacagcgtcagctcttctgtcttggcagagttctcctccgcaggaacaaaattctagttctagatgaggcgacagcatccatcgactctgcaacggatgcaatcctgcagaaagtaatcaggcaacagttctcaagttgcacggttataaccatagctcacagggtaccaactgtgacagacagcgacagggtcatggtcctgtcctacgggaagctcctagaatatgaaacgccagccaagctgttggaagacaaacaatcagcatttgctaaacttgtggctgagtattgggcaaataccaagcgaaattcaacatga

SEQ ID NO: 21693 - protein, 1492 aa, Sorghum bicolor
  misc_feature: Ceres ANNOT ID no. 8742906
  misc_feature: Up-regulated in root tissues in response to methyl jasmonate treatment
  misc_feature: Up-regulated in shoot tissues in response to salicylic acid treatment
  misc_feature: Up-regulated in root tissues in response to salicylic acid treatment
  misc_feature (196)..(1492): SWISSPROT Homolog: EC 3.6.3.44 Xenobiotic-transporting ATPase
  misc_feature (654)..(825): Pfam ID: ABC_tran Pfam Description: ABC transporter
  misc_feature (1274)..(1457): Pfam ID: ABC_tran Pfam Description: ABC transporter
  misc_feature (310)..(580): Pfam ID: ABC_membrane Pfam Description: ABC transporter transmembrane region
  misc_feature (921)..(1198): Pfam ID: ABC_membrane Pfam Description: ABC transporter transmembrane region
MADNGDPAMALLGWSSSWICGGEDDDGGRLTVASPCVQRTLIDCVNVVLLVAYVSTLAVAAACVRRRQRAATATAASRRSGAPGSGWVLLVVSSCCVAAAVAYGVTGLQDASDVRAAVPYFVRALVWIALAASLHVRPTRPARAVAVLWWVLFSLLVTAYNVEILAGGHGLDLAETISWPVSLLLLLCALGSLLRRGHGDASNDSGGLSEPLIGGKDDRAAVPTSELYRAGLFGQLAFSWLNPLLRVGRSKALDLGDIPLIADEDTAHHTSQKFAEDWSRHVGDKARSRRRVVGSNSLALVLLKCFLGEILLTGFYALLRTLSIAVAPLLLFAFVWYSNQEERDLRVGLVLVGCLLITKLIESLSQRHWFFTSRRTGMRIRSALMAVIFQKQLRLSSQGRKNHSTGEIVNYIAVDAYRLGDAISWLHMGWSSPLQLVFSVATLFWALKLGALPGLVPLVIFGFLNVPFAKMLQGYQAKFMVAQDERLRSTSEILNSMKIIKLQSWEDKFRQMIESLRDGEFKWLKETQMKKAYGAVMYWMSPTVVSAVMYTATAIMGSAPLNASTLFTVLATLRVMAEPVRFLPEILTMMIQYKVSLDRIEKFLLEDEIREEDVKRVPSDNSDVRVQVQDGNFSWKATGADLSLRNVNLRINRGEKVAVCGPVGSGKSSLLYALLGEIPRISGSVAVFGSVAYVSQSSWIQSGTVRDNILFGKPFHKELYDKAIKSCALDKDIENFDHGDLTEIGQRGLNMSGGQKQRIQLARAVYNDADVYLLDDPFSAVDAHTAAVLFYECVMTALAEKTVVLVTHQVEFLTETNRILVMEGGQVSQQGKYSELLGSGTAFEKLVSAHEASITALDTSASQQNQDQGQQAFDEYIVPSALQVIRQASDIEVTAKGPSAAIQLTEEEEKGIGDLGWKPYKDYINVPKAAFQFSGMCTSQVLFTCFQIASTYWLAVAVQMDSVSAALLVGAYSGLSIFSCCFAYFRSLFAANLGLKASKAFFGGLMDSVFKAPMSFFDSTPVGRILTRASSDLSILDFDIPYSMAFVATGAIEVVTTVLVMGTVTWQVLVVAIPVAITMIYVQRYYVSSARELVRINGTTKAPVMNYASESILGVVTIRAFAATERFIHSNMQLIDTDATLFFHTVAAQEWVLIRVEALQSLTIITAALFLVLVPPGAISPGFAGLCLSYALTLTAAQVFLTRFYSYLENYIISVERIKQYMHLPVEPPAIIPENRPPTSWPQEGRIDLQDLKIRYRPNAPLVLKGITCTFSAGNKIGVVGRTGSGKSTLISSLFRLVDPAGGKILIDKLDICSIGLKDLRTKLSIIPQEPTLFRGTVRTNLDPLGLHSDQEIWEALEKCQLKTAISSTSALLDTVVSDDGDNWSAGQRQLFCLGRVLLRRNKILVLDEATASIDSATDAILQKVIRQQFSSCTVITIAHRVPTVTDSDRVMVLSYGKLLEYETPAKLLEDKQSAFAKLVAEYWANTKRNST

SEQ ID NO: 21694 - DNA, 1608 bp, Sorghum bicolor
  misc_feature: Ceres ANNOT ID no. 8742916
  misc_feature: Down-regulated in shoot tissues in response to salicylic acid treatment
  misc_feature: Encodes the peptide sequence at SEQ ID NO 21695
atggcgctcgccttcgacgagttcgggcgccccttcatcatactcagggagcaggagaagaagacgcgcctgcgcgggctcgacgcgcagaaggccaacatcgccgccggcaaggccgtggcgcggatcctccgcacctcgctcggacccaagggcatggacaagatgctccagtcccccgacggagacgtcaccatcacaaatgatggggccacgattctggagcagatggatgttgacaaccagattgcaaagctgatggtggagctgtcccgcagtcaagactatgagatcggggatggtaccactggggtggtggtcatggcaggggcacttctagagcaggctgagaaacttctggagcgtggtattcacccgatacgggttgccgaaggttatgagatggcttcaagggtagcttttgatcaccttgagcgcatctcccaaaagtttgaattcaatgcagacaatatagagccactggttcagacctgcatgacgactctgtcgtcaaagattgttcaccgttgcaagcgggcactcgcagagattgctgtcaaagcagtccttgcggttgctgatttgggcaggaaggatgttaacttggatttaatcaaagtagaaggcaaggtcggtgggaagctggaggacacagaactaatatatggaattgtcgttgacaaagatatgagccaccctcaaatgccaaagagaattgaggatgctaagatagccatcctgacctgcccatttgagcccccgaaacctaagacaaagcataaggttgacattgatactgtagagaaattccagactctgcgtgagcaagagcagaagtactttgatgaaatggttcagaaatgcaaggatgttggtgcaaccctggttatttgtcaatggggttttgatgatgaagccaatcatctattgatgcatagaaatctgccagctgtcagatgggttggtggtgttgaattggaattgattgccatcgctacaggaggacggattgttccaagatttcaagagctgagtccagaaaagcttgggaaggctggattagtcagagagaagtcatttggaacaaccaaggaccggatgctttacattgagcagtgtgccaactccagagctgtaactattttcattcgtggtggaaataaaatgatgattgaggagaccaagcgcagtcttcatgatgctctttgtgtggcaaggaatctaatccgcaataactcaattgtgtatggtggtggctcggcagagatatcttgctcaattgctgttgaaactgcagcagatcggcaccctggagttgagcagtatgctatcaggtcatttgctgatgcattggacgctgttccactggccttagctgagaacagtggtttgcctcctattgataccttaactgtggtgaaagctcaacaagtgaaggatagcaacccccattgtggcatagattgcaatgacgttggcaccaatgacatgaaagagcagaacgtctttgagaccctgattggcaagcagcaacagatcttacttgccacgcaggtggtgaagatgatcctcaagattgacgacgtgatctcgccatctgagtactga

SEQ ID NO: 21695 - protein, 535 aa, Sorghum bicolor
  misc_feature: Ceres ANNOT ID no. 8742916
  misc_feature: Down-regulated in shoot tissues in response to salicylic acid treatment
  misc_feature (68)..(405): SWISSPROT Homolog: EC 2.7.1.68 1-phosphatidylinositol-4-phosphate 5-kinase
  misc_feature (40)..(534): Pfam ID: Cpn60_TCP1 Pfam Description: TCP-1/cpn60 chaperonin family
MALAFDEFGRPFIILREQEKKTRLRGLDAQKANIAAGKAVARILRTSLGPKGMDKMLQSPDGDVTITNDGATILEQMDVDNQIAKLMVELSRSQDYEIGDGTTGVVVMAGALLEQAEKLLERGIHPIRVAEGYEMASRVAFDHLERISQKFEFNADNIEPLVQTCMTTLSSKIVHRCKRALAEIAVKAVLAVADLGRKDVNLDLIKVEGKVGGKLEDTELIYGIVVDKDMSHPQMPKRIEDAKIAILTCPFEPPKPKTKHKVDIDTVEKFQTLREQEQKYFDEMVQKCKDVGATLVICQWGFDDEANHLLMHRNLPAVRWVGGVELELIAIATGGRIVPRFQELSPEKLGKAGLVREKSFGTTKDRMLYIEQCANSRAVTIFIRGGNKMMIEETKRSLHDALCVARNLIRNNSIVYGGGSAEISCSIAVETAADRHPGVEQYAIRSFADALDAVPLALAENSGLPPIDTLTVVKAQQVKDSNPHCGIDCNDVGTNDMKEQNVFETLIGKQQQILLATQVVKMILKIDDVISPSEY

SEQ ID NO: 21696 - DNA, 1476 bp, Sorghum bicolor
  misc_feature: Ceres ANNOT ID no. 8743064
  misc_feature: Down-regulated in shoot tissues in response to methyl jasmonate treatment
  misc_feature: Down-regulated in root tissues in response to methyl jasmonate treatment
  misc_feature: Encodes the peptide sequence at SEQ ID NO 21697
atggcgctcgtgagttccttctccactctccctctccctctctctctcttttttttatcgctctttcagaagtgctgcgtagcgcgtcgcttgtcagactgtctgcgaggaagttttgattatgtttattttttggtcctatcacttagacaatgttgtagatttcattgcttgcttgcatgtaaggatgaaaacggtcggaaacggtattacaatgtagaaatggaagcggtattgcattctggggctggaaacaagaatgccttcaaggcacttattgctgcagaatacagtggggtcaaggtcgagttgaccaaggattttgagatgggtgtctccaacaagacccctgaatttcttaagatgaacccccttgggaaggttcctgttctggagactcctgatggcgctgtttttgagagtaatgctattgcacgctatgttgctcgtttgaaggatgacaaccctctttttgggtcttcccgtattgaacaagcccatgttgagcaatgggtggactttgctgcaacagaagttgatcctggtgttgcatggtacttgtatccaaggcttgggtttatcccttatgctcacacaaccgaggaaacagctattgcttcattgaagagatcgcttggtgctctgaacacacaccttgcctcaaacacataccttgttgggcattctgttactctagctgacattgtattgacatgcaacctctaccatggaattgcacggatcttgaccaagagcttcacttctgatttccctcatgtcgagaggtatttctggaccatggttaaccagcctaacttcaagaaggtcattggtgaggtcaagcaggcagagtctgtacctcctgttcagaaaaaggccgctcctcctaaggagcctaaggcaaaggatgtcaagaaagaagccccaaaggaggcccccaagccaaaggtggttgaggcaccagcagaagaggaagcaccaaagccaaagccaaagaatcctcttgacttgctgccaccaagcaagatggtccttgatgactggaagaggctatactcaaacacaaagaccaacttccgggaggttgccatcaaaggtttctgggacatgtacgacccagagggctactctctgtggttctgtgactacaagtacaacgatgagaacacggtgtcctttgtgaccctgaacaaggttggtgggttcctgcagcggatggacctggctcgcaagtatgcctttgggaagatgctcgtgataggctctgaggcacccttcaagttgaagggcctttggctcttccgtggccaggaggttcccaagtttgtaatggatgaggtctatgacatggagctctacgagtggaccaaggtggacatctctgatgaggcccagaaggagcgtgtcaatgctatgattgaggaccaggagccctttgagggtgaggccttgcttgacgcgaaatgcttcaagtga

SEQ ID NO: 21697 - protein, 491 aa, Sorghum bicolor
  misc_feature: Ceres ANNOT ID no. 8743064
  misc_feature: Down-regulated in shoot tissues in response to methyl jasmonate treatment
  misc_feature: Down-regulated in root tissues in response to methyl jasmonate treatment
  misc_feature (90)..(276): SWISSPROT Homolog: EC 2.5.1.18 Glutathione transferase
  misc_feature (330)..(438): Pfam ID: EF1G Pfam Description: Elongation factor 1 gamma, conserved domain
  misc_feature (75)..(150): Pfam ID: GST_N Pfam Description: Glutathione S-transferase, N-terminal domain
  misc_feature (174)..(271): Pfam ID: GST_C Pfam Description: Glutathione S-transferase, C-terminal domain
MALVSSFSTLPLPLSLFFLSLFQKCCVARRLSDCLRGSFDYVYFLVLSLRQCCRFHCLLACKDENGRKRYYNVEMEAVLHSGAGNKNAFKALIAAEYSGVKVELTKDFEMGVSNKTPEFLKMNPLGKVPVLETPDGAVFESNAIARYVARLKDDNPLFGSSRIEQAHVEQWVDFAATEVDPGVAWYLYPRLGFIPYAHTTEETAIASLKRSLGALNTHLASNTYLVGHSVTLADIVLTCNLYHGIARILTKSFTSDFPHVERYFWTMVNQPNFKKVIGEVKQAESVPPVQKKAAPPKEPKAKDVKKEAPKEAPKPKVVEAPAEEEAPKPKPKNPLDLLPPSKMVLDDWKRLYSNTKTNFREVAIKGFWDMYDPEGYSLWFCDYKYNDENTVSFVTLNKVGGFLQRMDLARKYAFGKMLVIGSEAPFKLKGLWLFRGQEVPKFVMDEVYDMELYEWTKVDISDEAQKERVNAMIEDQEPFEGEALLDAKCFK

SEQ ID NO: 21698 - DNA, 1284 bp, Sorghum bicolor
  misc_feature: Ceres ANNOT ID no. 8743218
  misc_feature: Up-regulated in shoot tissues in response to salicylic acid treatment
  misc_feature: Encodes the peptide sequence at SEQ ID NO 21699
atgcgagctctgctccggatccactcgcccgcggtcatctccaccgcatccttcctccacacctactcaaccgccgcctccaagatcctagccccgagccccaccttcgtcccgctccggctcatccgccgcttcgcggccatggccgccaccgccgcggacgagttcgtgaagggccgcgtcttccccaacggcgtcgccgtcatcacgctcgatcgccccaaggccctcaacgccatgaacgtcgaaatggatgttagatacaaggcacttcttgatgaatgggaagcaaatccaagtgtcaagtgtattcttgtggaaagcagctcttctcgtgccttctcagcagggatggatattaagggggttgctgcggaaatacaaaaggacaaaaacacaccacttgtgcaaaaggtcttcacagcagagtactccttgatttgtaagatacatgagtatgcaaaaccttatatatgcttgatggatggagtgacaatgggatttggaattgggctatcagggcatggccgctaccgcattattactgagaggacactcctagccatgcctgagaatgctattggcctgttcccagatgttggttttgcttacattggtgcaaaagccccaggagggggcgcagttggagcttaccttgggattactggaaaaaggatatcatcacctgctgatgctatgtttataggccttggtactcattatgtaccttctgcaaatttgggttcactcaaggaatccctcctgagtgctaacttcacccatgatcctcatagagatgttgagtcagttctgacaggatacaagaaagaaccagagtctgaatcacaactagaaaagcttttgccatatatcatttcttctttcagtcctgataaatcagtagctgaatctgtggaagagctaaagaaatgtagtcgaagtggtgatgctgcagtggcagaatgggccaatgaagctttagcaggaattgagaaaggtgctccattttctctttgtttaacacagaagcatttctctcaagtggcatcagcgtacaggactagtgaacactatttatctaagctcgctggtgttatgaaattggaataccgcattgccttgaggtcgtcggttagaaatgattttgttgaaggcgtacgtgctgttttagttgacaaggaccagaatccgaagtggaatccagccactctggaagaagtaaacatgggcgaggttgaatctgtttttgagccattaggtgctgaggctgagttgagtgtgtga

SEQ ID NO: 21699 - protein, 427 aa, Sorghum bicolor
  misc_feature: Ceres ANNOT ID no. 8743218
  misc_feature: Up-regulated in shoot tissues in response to salicylic acid treatment
  misc_feature (68)..(355): SWISSPROT Homolog: EC 3.1.2.4 3-hydroxyisobutyryl-CoA hydrolase
  misc_feature (67)..(243): Pfam ID: ECH Pfam Description: Enoyl-CoA hydratase/isomerase family
MRALLRIHSPAVISTASFLHTYSTAASKILAPSPTFVPLRLIRRFAAMAATAADEFVKGRVFPNGVAVITLDRPKALNAMNVEMDVRYKALLDEWEANPSVKCILVESSSSRAFSAGMDIKGVAAEIQKDKNTPLVQKVFTAEYSLICKIHEYAKPYICLMDGVTMGFGIGLSGHGRYRIITERTLLAMPENAIGLFPDVGFAYIGAKAPGGGAVGAYLGITGKRISSPADAMFIGLGTHYVPSANLGSLKESLLSANFTHDPHRDVESVLTGYKKEPESESQLEKLLPYIISSFSPDKSVAESVEELKKCSRSGDAAVAEWANEALAGIEKGAPFSLCLTQKHFSQVASAYRTSEHYLSKLAGVMKLEYRIALRSSVRNDFVEGVRAVLVDKDQNPKWNPATLEEVNMGEVESVFEPLGAEAELSV

SEQ ID NO: 21700 - DNA, 1344 bp, Sorghum bicolor
  misc_feature: Ceres ANNOT ID no. 8743277
  misc_feature: Down-regulated in shoot tissues in response to methyl jasmonate treatment
  misc_feature: Down-regulated in root tissues in response to methyl jasmonate treatment
  misc_feature: Down-regulated in shoot tissues in response to aminocyclopropane carboxylic treatment
  misc_feature: Encodes the peptide sequence at SEQ ID NO 21701
atgggtaaggagaagactcacataaacattgtggtcattggccatgtcgactctggcaagtcgaccaccactggccacctgatctacaagcttggtggtattgacaagcgtgtgatcgagaggttcgagaaagaggctgcggagatgaacaagaggtcgttcaagtatgcgtgggtgcttgacaagctcaaggctgagcgtgagagaggtatcacaattgatattgccctgtggaagttcgagaccaccaagtactactgcacggtcattgatgcccctggccaccgtgacttcatcaagaatatgatcactggcacttctcaggctgactgtgctgttcttatcattgactccaccactggtggttttgaggctggtatctccaaggatggccagacccgtgagcatgctctccttgctttcacacttggagtgaagcagatgatttgctgctgcaataagatggatgccaccacacccaagtactcgaaggcccgttatgatgaaattgtgaaggaagtctcttcctacctgaagaaggttggatacaacccagacaagatccactttgttcccatctctggttttgaaggtgacaacatgattgagaggtccaccaaccttgactggtacaagggcccaaccctgcttgaggctctggacttaatcaatgagccaaagaggccttcagacaagcccctgcgtctcccccttcaggatgtgtacaagattggtggtattggaactgttcctgtgggacgtgttgagactggtatcatcaagccgggtatggttgtcaccttcggtcctagtggccttacaactgaggttaagtctgttgagatgcaccacgaggctctccaggaggcccttcctggtgacaatgttggcttcaacgttaagaatgttgctgtgaaggatctgaagcgtgggtatgtggcctccaactccaaggatgaccctgccaaggaggctgctagcttcacctcacaggtcatcatcatgaaccaccctgggcagattggcaatggctatgccccagtgctggactgccacacctcacacattgctgtcaagtttgctgagcttgttaccaagattgataggcgatctggcaaggagcttgagaaggagcccaaattcctcaagaacggtgatgctggtatggtgaagatggttcccactaagcccatggtggtggagaccttctctgagtatcctcctcttggtcgctttgctgtccgggacatgaggcaaacggtggctgttggagtcatcaagagcgtggagaagaaggacccaactggagccaaggtgaccaaggctgccgccaagaagaaatga

SEQ ID NO: 21701 - protein, 447 aa, Sorghum bicolor
  misc_feature: Ceres ANNOT ID no. 8743277
  misc_feature: Down-regulated in shoot tissues in response to methyl jasmonate treatment
  misc_feature: Down-regulated in root tissues in response to methyl jasmonate treatment
  misc_feature: Down-regulated in shoot tissues in response to aminocyclopropane carboxylic treatment
  misc_feature (3)..(433): SWISSPROT Homolog: EC 2.7.7.4 Sulfate adenylyltransferase
  misc_feature (5)..(225): Pfam ID: GTP_EFTU Pfam Description: Elongation factor Tu GTP binding domain
  misc_feature (322)..(430): Pfam ID: GTP_EFTU_D3 Pfam Description: Elongation factor Tu C-terminal domain
  misc_feature (248)..(315): Pfam ID: GTP_EFTU_D2 Pfam Description: Elongation factor Tu domain 2
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVKEVSSYLKKVGYNPDKIHFVPISGFEGDNMIERSTNLDWYKGPTLLEALDLINEPKRPSDKPLRLPLQDVYKIGGIGTVPVGRVETGIIKPGMVVTFGPSGLTTEVKSVEMHHEALQEALPGDNVGFNVKNVAVKDLKRGYVASNSKDDPAKEAASFTSQVIIMNHPGQIGNGYAPVLDCHTSHIAVKFAELVTKIDRRSGKELEKEPKFLKNGDAGMVKMVPTKPMVVETFSEYPPLGRFAVRDMRQTVAVGVIKSVEKKDPTGAKVTKAAAKKK

SEQ ID NO: 21702 - DNA, 1344 bp, Sorghum bicolor
  misc_feature: Ceres ANNOT ID no. 8743287
  misc_feature: Down-regulated in root tissues in response to methyl jasmonate treatment
  misc_feature: Down-regulated in shoot tissues in response to salicylic acid treatment
  misc_feature: Encodes the peptide sequence at SEQ ID NO 21703
atgggtaaggagaagactcacataaacattgtggtcattggccatgtcgactctggcaagtcgaccaccactggccacctgatctacaagcttggtggtattgacaagcgtgtgatcgagaggttcgagaaagaggctgcggagatgaacaagaggtcgttcaagtatgcgtgggtgcttgacaagctcaaggctgagcgtgagagaggtatcacaattgatattgccctgtggaagttcgagaccaccaagtactactgcactgtcattgatgctcctggacaccgtgacttcatcaagaatatgatcactggtacttcccaggctgactgtgctgttcttatcattgactccaccactggtggttttgaggctggtatctccaaggatggccagacccgtgagcatgctctccttgctttcacacttggagtgaagcagatgatttgctgctgcaacaagatggacgccaccacacccaagtactcgaaggcccgttatgatgagattgtgaaggaagtctcttcttacctgaagaaggttggatacaacccagacaagatccactttgttcccatctctggttttgaaggtgacaacatgattgagaggtccaccaaccttgactggtacaagggcccaaccctgcttgaggctctggacttgatcaatgagccaaagaggccttcagacaagccactgcgtctcccccttcaggacgtgtacaagattggtggtattggaactgttcctgtcgggcgtgttgagactggtatcatcaaacctggtatggttgttacctttggtcctagtggccttacaactgaggttaagtctgttgagatgcaccacgaggctctccaggaggcccttcctggtgacaatgttggcttcaatgttaagaatgttgctgtgaaggatctgaagcgtgggtatgtggcctccaactccaaggatgaccctgccaaggaggctgctagcttcacctcccaggtcatcatcatgaaccatcctgggcagatcggcaacggctacgccccagtgctggactgccacacctcacacattgctgtcaagtttgctgagctggttaccaagattgataggcgatctggcaaggagcttgagaaggagcccaaattcctcaagaacggtgatgctggtatggtgaagatggttcccaccaagcccatggtggtggagaccttctctgagtatcctcctcttggtcgctttgctgtccgggacatgaggcaaacggtggctgttggagtcatcaagagtgtggagaagaaggacccaactggagccaaggtgaccaaggctgccgccaagaagaaatga

SEQ ID NO: 21703 - protein, 447 aa, Sorghum bicolor; identical to SEQ ID NO: 21701
  misc_feature: Ceres ANNOT ID no. 8743287
  misc_feature: Down-regulated in root tissues in response to methyl jasmonate treatment
  misc_feature: Down-regulated in shoot tissues in response to salicylic acid treatment
  misc_feature (3)..(433): SWISSPROT Homolog: EC 2.7.7.4 Sulfate adenylyltransferase
  misc_feature (5)..(225): Pfam ID: GTP_EFTU Pfam Description: Elongation factor Tu GTP binding domain
  misc_feature (322)..(430): Pfam ID: GTP_EFTU_D3 Pfam Description: Elongation factor Tu C-terminal domain
  misc_feature (248)..(315): Pfam ID: GTP_EFTU_D2 Pfam Description: Elongation factor Tu domain 2

SEQ ID NO: 21704 - DNA, 1344 bp, Sorghum bicolor
  misc_feature: Ceres ANNOT ID no. 8743284
  misc_feature: Down-regulated in shoot tissues in response to methyl jasmonate treatment
  misc_feature: Down-regulated in root tissues in response to methyl jasmonate treatment
  misc_feature: Down-regulated in shoot tissues in response to aminocyclopropane carboxylic treatment
  misc_feature: Down-regulated in shoot tissues in response to salicylic acid treatment
  misc_feature: Encodes the peptide sequence at SEQ ID NO 21705
atgggtaaggagaagactcacatcaacattgtggtcattggccatgtcgactctggcaagtcgaccaccactggccacctgatctacaagcttggcggtattgacaagcgtgtgatcgagaggttcgagaaggaggctgcggaaatgaacaagcgttcattcaagtacgcctgggtgctcgacaagcttaaggctgagcgtgagagaggtatcacaattgatattgcgctgtggaagttcgagaccaccaagtactactgcactgtcattgatgcccctggacaccgtgacttcatcaagaatatgatcactggtacttcccaggctgactgtgctgttcttatcattgactccaccactggtggttttgaggctggtatctccaaggatggccagacccgtgagcatgctctccttgctttcacacttggagtcaagcagatgatttgctgctgcaacaagatggacgccaccacacccaagtactcgaaggcccgttatgatgagattgtgaaggaagtctcttcctacctgaagaaggttggatacaacccagacaaaatccactttgttcccatctctggttttgaaggtgacaacatgattgagaggtccaccaaccttgactggtacaagggcccaaccctgcttgaggctctggacttgatcaatgagccaaagaggccttcagacaagccactgcgtctcccccttcaggacgtgtacaagattggtggtattggaactgttcctgtcgggcgtgttgagactggtatcatcaaacctggtatggttgttacctttggtcctagtggccttacaactgaggttaagtctgtcgagatgcaccacgaggctctccaggaggcccttcctggtgacaatgttggcttcaatgttaagaatgttgctgtgaaggatctgaagcgtgggtatgtggcctccaactccaaggatgaccctgccaaggaggctgctagcttcacctcccaggtcatcatcatgaaccaccctgggcagattggcaatggctacgccccagtgctggactgccacacctcacacattgctgtcaagtttgctgagcttgttaccaagattgataggcgatctggcaaggagcttgagaaggagcccaaattcctcaagaacggtgatgctggtatggtgaagatggttcccactaagcccatggtggtggagaccttctctgagtatcctcctcttggtcgctttgctgtccgggacatgaggcaaacggtggctgttggagtcatcaagagcgtggagaagaaggacccaactggagccaaggtgaccaaggctgccgccaagaagaaatga

SEQ ID NO: 21705 - protein, 447 aa, Sorghum bicolor; identical to SEQ ID NO: 21701
  misc_feature: Ceres ANNOT ID no. 8743284
  misc_feature: Down-regulated in shoot tissues in response to methyl jasmonate treatment
  misc_feature: Down-regulated in root tissues in response to methyl jasmonate treatment
  misc_feature: Down-regulated in shoot tissues in response to aminocyclopropane carboxylic treatment
  misc_feature: Down-regulated in shoot tissues in response to salicylic acid treatment
  misc_feature (3)..(433): SWISSPROT Homolog: EC 2.7.7.4 Sulfate adenylyltransferase
  misc_feature (5)..(225): Pfam ID: GTP_EFTU Pfam Description: Elongation factor Tu GTP binding domain
  misc_feature (322)..(430): Pfam ID: GTP_EFTU_D3 Pfam Description: Elongation factor Tu C-terminal domain
  misc_feature (248)..(315): Pfam ID: GTP_EFTU_D2 Pfam Description: Elongation factor Tu domain 2

SEQ ID NO: 21706 - DNA, 1344 bp, Sorghum bicolor
  misc_feature: Ceres ANNOT ID no. 8743276
  misc_feature: Down-regulated in shoot tissues in response to methyl jasmonate treatment
  misc_feature: Down-regulated in root tissues in response to methyl jasmonate treatment
  misc_feature: Down-regulated in shoot tissues in response to aminocyclopropane carboxylic treatment
  misc_feature: Down-regulated in shoot tissues in response to salicylic acid treatment
  misc_feature: Encodes the peptide sequence at SEQ ID NO 21707
atgggtaaggagaagactcacatcaacattgtggtcattggccatgtcgactctggcaagtcgaccaccactggccacctgatctacaagcttggtggtattgacaagcgtgtgatcgagaggttcgagaaagaggctgcggagatgaacaagaggtcgttcaagtatgcgtgggtgcttgacaagctcaaggctgagcgtgagagaggtatcacaattgatatcgccctgtggaagtttgagaccaccaagtactactgcactgtcattgatgcccctggacaccgtgacttcatcaagaatatgattacgggtacttcccaggctgactgtgctgttcttatcattgactccaccactggtggttttgaggctggtatctccaaggatggccagacccgtgagcatgctctccttgctttcacacttggagtgaagcagatgatttgctgctgcaacaagatggatgccacgacacccaagtactcgaaggcccgttatgatgagattgttaaggaagtctcttcttacctgaagaaggttggatacaacccagacaagatccactttgttcccatctctggttttgaaggtgacaacatgattgagaggtccaccaaccttgactggtacaagggcccaaccctgcttgaggctctggacttaatcaatgagccaaagagaccttcagacaagcccctgcgtctcccccttcaggatgtgtacaaaattggtggtattggaactgttcctgtgggacgtgttgagactggtatcatcaagcctggtatggttgtcaccttcggtcctagtggccttacaactgaggttaagtctgttgagatgcaccacgaggctctccaggaggcccttcctggtgacaatgttggcttcaatgttaagaatgttgctgtgaaggatctgaagcgtgggtatgtggcctccaactccaaggatgaccctgccaaggaggcggctagcttcacctcacaggtcatcatcatgaaccaccctgggcagattggcaacggctacgccccagtgctggactgtcacacctcacacatagctgtcaagtttgctgagcttgttaccaagattgataggcgatctggcaaggagcttgagaaggagcccaaattcctcaagaacggtgatgctggtatggtgaagatggttcccactaagcccatggtggtggagaccttctctgagtatcctcctcttggtcgctttgctgtccgggacatgaggcaaacggtggctgttggagtcatcaagagcgtggagaagaaggacccaactggagccaaggtgaccaaggctgccgctaagaagaaatga

SEQ ID NO: 21707 - protein, 447 aa, Sorghum bicolor; identical to SEQ ID NO: 21701
  misc_feature: Ceres ANNOT ID no. 8743276
  misc_feature: Down-regulated in shoot tissues in response to methyl jasmonate treatment
  misc_feature: Down-regulated in root tissues in response to methyl jasmonate treatment
  misc_feature: Down-regulated in shoot tissues in response to aminocyclopropane carboxylic treatment
  misc_feature: Down-regulated in shoot tissues in response to salicylic acid treatment
  misc_feature (3)..(433): SWISSPROT Homolog: EC 2.7.7.4 Sulfate adenylyltransferase
  misc_feature (5)..(225): Pfam ID: GTP_EFTU Pfam Description: Elongation factor Tu GTP binding domain
  misc_feature (322)..(430): Pfam ID: GTP_EFTU_D3 Pfam Description: Elongation factor Tu C-terminal domain
  misc_feature (248)..(315): Pfam ID: GTP_EFTU_D2 Pfam Description: Elongation factor Tu domain 2

SEQ ID NO: 21708 - DNA, 1167 bp, Sorghum bicolor
  misc_feature: Ceres ANNOT ID no. 8743297
  misc_feature: Up-regulated in root tissues in response to salicylic acid treatment
  misc_feature: Encodes the peptide sequence at SEQ ID NO 21709
atggctccttcgctcgttaatctgttatattctgttgtcagctctcggtgttgttcggctattgacaatgtcttttatttcttgtttgcgacagagttctcgaagcaaaacgatctgatgagattcttcaaggggagcgaggtggaggtattgcaggaggcagaggtgccatttggttcgtggaggcctggtgagatcatctccggcaacggacacacctatctggtgagatatgatgaaagtcccgttgactctagcgtggctgttgaaagggtgccaagaaggttgatgagacctcgccctcctgcggatgattctgtacgctggagtttgggtagtattcttgaggcctttgacagctactcgtggaaggttgctgaggtggtgagagtgctcggaaagaatcaatatctggtcaggctccttgggtcctcgctggagttgagtgcacattcatcggatcttcgattgaggaagctttggctagatgacagatgggttgtgactcagaagtattccgcaagatgcttgaacggtggtgcattcggaggtcgatcaaaagacggaaatttagactgcaacttgagaaaggacaggcatattcaacttgagaaccagaatgcttttgagggtgatacatctagaggcatgaagagaaaatcgtctgctatatcaacacatcctcaatgcagtgaaattactaagagattgcggacaccaaatagagatggaaggcactcaaagctggctgatagaggttttttccctttggctgaaaaggtagatgctgtcgattccccatgctttatgctgggcgggaaatacatgcatgctagtcataaagggcatactagaacaactgaagaatttagtgacacagagagtatctcatcttctgttggtagttctagtcctaacagtaccccccatagatcacagtattataatttggtctgccaaagtggagatacctgtagtagaactgatgaagatgaagcttctacatctgaaagagaaacatcagaacataataatgttggattgagggaagaaacccatttactggaattacatgcttatcgtgcaacaatgctagccttgtatgcttgtgggtcaattagctgggagcaagaggctttgttgactaacctaagattcggctgttaa

SEQ ID NO: 21709 - protein, 388 aa, Sorghum bicolor
  misc_feature: Ceres ANNOT ID no. 8743297
  misc_feature: Up-regulated in root tissues in response to salicylic acid treatment
  misc_feature (42)..(105): Pfam ID: Agenet Pfam Description: Agenet domain
MAPSLVNLLYSVVSSRCCSAIDNVFYFLFATEFSKQNDLMRFFKGSEVEVLQEAEVPFGSWRPGEIISGNGHTYLVRYDESPVDSSVAVERVPRRLMRPRPPADDSVRWSLGSILEAFDSYSWKVAEVVRVLGKNQYLVRLLGSSLELSAHSSDLRLRKLWLDDRWVVTQKYSARCLNGGAFGGRSKDGNLDCNLRKDRHIQLENQNAFEGDTSRGMKRKSSAISTHPQCSEITKRLRTPNRDGRHSKLADRGFFPLAEKVDAVDSPCFMLGGKYMHASHKGHTRTTEEFSDTESISSSVGSSSPNSTPHRSQYYNLVCQSGDTCSRTDEDEASTSERETSEHNNVGLREETHLLELHAYRATMLALYACGSISWEQEALLTNLRFGC

SEQ ID NO: 21710 - DNA, 1557 bp, Sorghum bicolor
  misc_feature: Ceres ANNOT ID no. 8743344
  misc_feature: Up-regulated in shoot tissues in response to methyl jasmonate treatment
  misc_feature: Up-regulated in shoot tissues in response to salicylic acid treatment
  misc_feature: Encodes the peptide sequence at SEQ ID NO 21711
atgaccggcgcggcggcccacgcggtgagcccccgcggcggcgcctccgcctccgcgtccgcgtcccagccccacgccgcagcagccgcggccgcgggggccggagcggcggggtgcgagccggtgcggaaggcggggcccgtgaccatggagcacgtgctgctcgcgctccacgagacggaggccgagcgggaggcgcggatccgggacatgttcgccttcttcgacaccgagggccgcgggcagctcgactacgcgcagatcgaggccggcctcgccgcgctgcaggtgcccgccgagtgcaagtacgccagggagctgctccgcgcctgcgaccgcgaccgcgacggccgcgtcggctacgacgacttcaggcgctacatggacgacaaggagctcgagctctaccgcatcttccaggccatcgacgtcgagcacaacgggtgcatcctccccgaggagctctgggacgcgctcgtcaaggctggtatagagattaatgatgaggagctggcaagatttgttgagcatgtggataaggacaacaatgggattattacttttgaagaatggagggattttcttctactttaccccaatgaggcgaccattgagaacatttatcatcactgggaaagagtctgccttgttgatataggtgaacatgctgctataccagaaggcataagtaaacatgtcaatgcaagcaaatatctcattgctggagggattgctggtgcagcatctcgtactgcaactgctcctctggatcgccttaaagtgatcatgcaagtacaaacgacgcgtactacagtcatgcatgcaattaaagatatctggactaaaggtggcatgctgggattttttagagggaatggattgaatgttgtaaaagtcgctccagaaagtgcaataagattttatgcctatgaaatgttaaaagaatatattatgaagagcaaaggagaaaataagagtgaaattggtgcttctgaacgtctcgttgctggtggtttagctggtgcagtggctcaaacagcaatttatcctatagatttagtaaagactcgtctacagacgtattcaggtgagggtggtaaagttcctagaattggtcagctctcaagggatattttggtgcatgaaggcccccgagctttttacagaggtcttgttccatctttgcttggtatcgtaccttatgccggaattgatcttgctgtatatgagactttgaaagatgtgtcaaagacatatatactgaaggacagtgatcctggtcctctagtacagctaggttgtgggactgtctctggagctctaggggcaacatgtgtttaccctttacaggtcatcagaacaagactgcaagctcaacaagccaattcagaatctgcctatagaggaatgtctgatgtcttctggagaaccctacagcatgagggtgtttctggattctacaaaggaattctaccaaatctccttaaagtggtgcctgctgcaagtattacctatatagtttatgaggcgatgaagaaaaatctgtctcttgattaa

SEQ ID NO: 21711 - protein, 518 aa, Sorghum bicolor
  misc_feature: Ceres ANNOT ID no. 8743344
  misc_feature: Up-regulated in shoot tissues in response to methyl jasmonate treatment
  misc_feature: Up-regulated in shoot tissues in response to salicylic acid treatment
  misc_feature (63)..(191): SWISSPROT Homolog: EC 2.7.11.1 Non-specific serine/threonine protein kinase
  misc_feature (234)..(321): Pfam ID: Mito_carr Pfam Description: Mitochondrial carrier protein
  misc_feature (329)..(420): Pfam ID: Mito_carr Pfam Description: Mitochondrial carrier protein
  misc_feature (427)..(517): Pfam ID: Mito_carr Pfam Description: Mitochondrial carrier protein
  misc_feature (170)..(198): Pfam ID: efhand Pfam Description: EF hand
  misc_feature (103)..(131): Pfam ID: efhand Pfam Description: EF hand
MTGAAAHAVSPRGGASASASASQPHAAAAAAAGAGAAGCEPVRKAGPVTMEHVLLALHETEAEREARIRDMFAFFDTEGRGQLDYAQIEAGLAALQVPAECKYARELLRACDRDRDGRVGYDDFRRYMDDKELELYRIFQAIDVEHNGCILPEELWDALVKAGIEINDEELARFVEHVDKDNNGIITFEEWRDFLLLYPNEATIENIYHHWERVCLVDIGEHAAIPEGISKHVNASKYLIAGGIAGAASRTATAPLDRLKVIMQVQTTRTTVMHAIKDIWTKGGMLGFFRGNGLNVVKVAPESAIRFYAYEMLKEYIMKSKGENKSEIGASERLVAGGLAGAVAQTAIYPIDLVKTRLQTYSGEGGKVPRIGQLSRDILVHEGPRAFYRGLVPSLLGIVPYAGIDLAVYETLKDVSKTYILKDSDPGPLVQLGCGTVSGALGATCVYPLQVIRTRLQAQQANSESAYRGMSDVFWRTLQHEGVSGFYKGILPNLLKVVPAASITYIVYEAMKKNLSLD

SEQ ID NO: 21712 - DNA, 951 bp, Sorghum bicolor
  misc_feature: Ceres ANNOT ID no. 8743485
  misc_feature: Up-regulated in shoot tissues in response to salicylic acid treatment
  misc_feature: Encodes the peptide sequence at SEQ ID NO 21713
atggctaccaaagccaaatcaagctcctcgtcatgcctctccttcctcaaggacgccctgctccttccatccaagaaccccaagctcttcgtccctgtcttcttcctggtaaccgcttccctcctccttctccaaatcaccaatgtcttctgcatccagccgcgcacagccgacatactgcaccagctcgacgagatcaagaacatggatccctcaagctccgattacgccaaactcatggcggagatcataaaggaaaccagggagcttgtcgtcatctccatcacgctcctaatcatcagctttgcagaaagcttcgccagacagatcattgccttcttcgccacctccaccacctacgccggcgaccgctactcgctccctgagctcttcaccgaggtgatcatgaaggggcgtcgcgtgaggggccctctaataaccgtggccatggtgggcgtcctcaacgtcgcgtgcatgctcctcctcgtcgcgctgctgcagctcgcgatgcgccacatgggggtgctctacatggcggtcctcttcgtgctcccgttcctcgcgttcctctacctcaacgtcgtcttcttcgtcgccgtcgccgcgtcggtggccgacgcggaccaccgcggcgtgagcgcgctcaggctggcgtggcggttgatgacgaaggtgtggaggaaagaaggctgcgtgctggtcgtcgtggtccacttggtggcgacggttccgtccccgctctacgcggtggcgctcgcgtgcttgaagaagagcatgcccatgggactggctctgctctccgtgtacacgctgctgggcggcttggtgcagctcttctactacgccgcagcgatggtgtactactaccaagccatggagagcaaggagaaggaggtgatggcccatgatgactacgtcaagatcccgaccggtgaagcaacaactgtgtga

SEQ ID NO: 21713 - protein, 316 aa, Sorghum bicolor
  misc_feature: Ceres ANNOT ID no. 8743485
  misc_feature: Up-regulated in shoot tissues in response to salicylic acid treatment
MATKAKSSSSSCLSFLKDALLLPSKNPKLFVPVFFLVTASLLLLQITNVFCIQPRTADILHQLDEIKNMDPSSSDYAKLMAEIIKETRELVVISITLLIISFAESFARQIIAFFATSTTYAGDRYSLPELFTEVIMKGRRVRGPLITVAMVGVLNVACMLLLVALLQLAMRHMGVLYMAVLFVLPFLAFLYLNVVFFVAVAASVADADHRGVSALRLAWRLMTKVWRKEGCVLVVVVHLVATVPSPLYAVALACLKKSMPMGLALLSVYTLLGGLVQLFYYAAAMVYYYQAMESKEKEVMAHDDYVKIPTGEATTV

SEQ ID NO: 21714 - DNA, 3429 bp, Sorghum bicolor
  misc_feature: Ceres ANNOT ID no. 8743588
  misc_feature: Down-regulated in shoot tissues in response to methyl jasmonate treatment
  misc_feature: Down-regulated in root tissues in response to methyl jasmonate treatment
  misc_feature: Encodes the peptide sequence at SEQ ID NO 21715
atgagtgttttagttagaaaagaaggaaaccccaaggtcaggcctagccatatattgcatgccgctggacctgatgaaccacatgttgcaagtccaacatggtctgatacttcccttgatacacctgacatggatcatgctattagtaaggaggagcttgaagatgttctcaacactccgcttcctgagcatccaaaactaattcgtggccaattgaagaatggccttcggtatcttattttgccaaataaagttccagcaaacaggtttgaggctcacatggaagttcatgttggatcaattgatgaggaggaggacgagcagggaattgcacatatgattgaacatgtcgcgtttcttggcagtaaaaaacgtgaaaagcttttggggaccggtgcgaggtctaatgcatatacagacttccaccatacggtgtttcatatccactctccaactaaaacaaaggaatatggtgaagacttactcccttctgtgttggatgcattgaatgagatagcttttcatccaaagttttcttcgtctcgtgttgagaaggagagaagagcaattctttctgagctccagatgatgaacacaatagagtatcgcgttgattgccagttgttgcaacatctgcactcagaaaacaaactgagcaacaggtttcctattggacttgaagagcaaatacataaatgggaccctgataagatccgcagatttcacgagcgctggtactatcctgctaatgccactttatatcttgtcggggaaattgatgatattcctagagctgtgcgggaaatagaggctgtatttgaacacacactttcagaaaatgaaggaaaccttgtaccgagctctagtccatttggtgctatggcaagcctttttgcaccaaagctcccaagtggctttgctgcaaacctatctggtgaaaaatcacctgctacagataaaataaagcctatgaaaagggaaagacaagcagttagaccacctgtagagcataagtggtcccttcctggagttgctcaggatgccaaacccccagcaatttttcagcacgagttgattcagagtttctctatcaacatgttctgtaagatacctgttagcaaagttcagacctacaaggacctgcgtagtgtactcatgaaaaggatatttttgtctgccctacattttcgaatcaatacaagatacaagagctcaaaccctccttttacgtcagttgagctagaccacagtgactctggaagggaaggttgcacggtcactactcttacagtaactgctgaaccccaaaattggagaagtgcaatcaaagttgctgttcacgaggtgcgaagactgaaagaatttggtgttacaatgggagaaatgacccgttacatggacgcactaataaaagatagtgagcagttggctatgatgattgacagtgttccctcagttgacaacttggacttcatcatggagagtgatgcacttggccacactgtcatggatcaattacagggacatgaaagtttgcttgcagttgctgaaactgtcacccttgaagaggttaacactgttggcgcagaagtactggaattcatttcggattttggaaaacccaatgcaccccttcctgctgccattgtggcatgtgtccccagaatggtgcatgttgatggcgtaggtgaaactgaatttgagatatatccagaagaaatcacagaggccatcaaggcaggtcttgaggaacctatttacccagagcctgagcttgaggtgccaaaggaattgatcacccaatcagagctcgatgaactgaaattgcaacacaaaccgtcatttgttcctttaacaaaagaggagaatgtggtgaaagtgtttgacagtgaaactggtatagcacaacgccgtctttctaatggaatttccgtcaactacaagatcacgcaaaatgaagcaagggttggtgtcatgcggctcatagtaggtggagggagagcaacagaagattctgaatcaaagggatcggtcattgttggtgttcgtaccctgagtgaaggtggctgtgttggtaacttttctagggaacaggttgaacttttctgtgtgaataatcttatcaactgctcactggaatcgaatgaggaattcatatttatggaatttagatttgctttaagagacaatggcatgcgtgctgctttccaactccttcatatggtccttgagcataatgtgtggctggaggatgcattcgatagagcaactcagttatatctgtcttactatcgctctatccccaaaagtttggaacgttctacagctcataagcttatgttagccatgctaaaccatgatgaaaggtttgtagagccgtcaccacattcgttgcaaaagttgactcttcagtcagttaaagatgctgtcatgaaccagtttgtgggtggcaacatggaggtcagcattgttggtgatttcactgaggaagaagtagaatcttgtgttcttgattatcttgggactgtgagggctgcaagttctccaagcacagaggagcgtattgaaaagatttccttccgaccgtttccatcagatgttcatttccagcaagtatacataaaggacacagatgagagagcctgtgcatatattgcaggccctgctcctaaccgttggggatttgctactgaaggaaatgacctatttaatgttattcagagatctgatgctgatgcagaaatatccgaaccagtaaacttggatctaacagggaagagacgcatcgatgttcgcagccaccctcttttctttggcatcactttgagtctgcttgctgaaattatcaattctaggttatttactacagttcgagattccatgggattaacatatgatgtttcttttgaattaaacctttttgacaaattggatcttggttggtatgtgatcgcggtcacttcaactccgagcaaggtccataaagctgttgatgcttgcaaaggtgttctgagaggattacatagtagccgaattgtggaaagggagcttgaccgggcaaagaggacgctgttgatgaaacatgaggctgagacgaagacaaatgcctactggcttggtttgctagcccatctacagtcttcgtctgtaccaagaaaggatgtatcatgcatcaaggaattgacgacgttatatgaaagtgccacaattgaggatctgtatcttgcatatgagcatctgaaagttgacgattcttctttgtttgcttgcattgggattgctggcgctgaatctggtgaagatacaaatggtaataagagtcacatggccctaggagacggcatgttgacagtcgttttccagcaaaactgtttaaagatcattgaagcattggatctggtcagggagactatttattatttcctgtga

SEQ ID NO: 21715 - protein, 1142 aa, Sorghum bicolor
  misc_feature: Ceres ANNOT ID no. 8743588
  misc_feature: Down-regulated in shoot tissues in response to methyl jasmonate treatment
  misc_feature: Down-regulated in root tissues in response to methyl jasmonate treatment
  misc_feature (71)..(250): SWISSPROT Homolog: EC 3.4.24.55 Pitrilysin
  misc_feature (800)..(1024): Pfam ID: Peptidase_M16_C Pfam Description: Peptidase M16 inactive domain
  misc_feature (232)..(469): Pfam ID: Peptidase_M16_C Pfam Description: Peptidase M16 inactive domain
  misc_feature (78)..(230): Pfam ID: Peptidase_M16 Pfam Description: Insulinase (Peptidase family M16)
MSVLVRKEGNPKVRPSHILHAAGPDEPHVASPTWSDTSLDTPDMDHAISKEELEDVLNTPLPEHPKLIRGQLKNGLRYLILPNKVPANRFEAHMEVHVGSIDEEEDEQGIAHMIEHVAFLGSKKREKLLGTGARSNAYTDFHHTVFHIHSPTKTKEYGEDLLPSVLDALNEIAFHPKFSSSRVEKERRAILSELQMMNTIEYRVDCQLLQHLHSENKLSNRFPIGLEEQIHKWDPDKIRRFHERWYYPANATLYLVGEIDDIPRAVREIEAVFEHTLSENEGNLVPSSSPFGAMASLFAPKLPSGFAANLSGEKSPATDKIKPMKRERQAVRPPVEHKWSLPGVAQDAKPPAIFQHELIQSFSINMFCKIPVSKVQTYKDLRSVLMKRIFLSALHFRINTRYKSSNPPFTSVELDHSDSGREGCTVTTLTVTAEPQNWRSAIKVAVHEVRRLKEFGVTMGEMTRYMDALIKDSEQLAMMIDSVPSVDNLDFIMESDALGHTVMDQLQGHESLLAVAETVTLEEVNTVGAEVLEFISDFGKPNAPLPAAIVACVPRMVHVDGVGETEFEIYPEEITEAIKAGLEEPIYPEPELEVPKELITQSELDELKLQHKPSFVPLTKEENVVKVFDSETGIAQRRLSNGISVNYKITQNEARVGVMRLIVGGGRATEDSESKGSVIVGVRTLSEGGCVGNFSREQVELFCVNNLINCSLESNEEFIFMEFRFALRDNGMRAAFQLLHMVLEHNVWLEDAFDRATQLYLSYYRSIPKSLERSTAHKLMLAMLNHDERFVEPSPHSLQKLTLQSVKDAVMNQFVGGNMEVSIVGDFTEEEVESCVLDYLGTVRAASSPSTEERIEKISFRPFPSDVHFQQVYIKDTDERACAYIAGPAPNRWGFATEGNDLFNVIQRSDADAEISEPVNLDLTGKRRIDVRSHPLFFGITLSLLAEIINSRLFTTVRDSMGLTYDVSFELNLFDKLDLGWYVIAVTSTPSKVHKAVDACKGVLRGLHSSRIVERELDRAKRTLLMKHEAETKTNAYWLGLLAHLQSSSVPRKDVSCIKELTTLYESATIEDLYLAYEHLKVDDSSLFACIGIAGAESGEDTNGNKSHMALGDGMLTVVFQQNCLKIIEALDLVRETIYYFL

SEQ ID NO: 21716 - DNA, 3198 bp, Sorghum bicolor
  misc_feature: Ceres ANNOT ID no. 8743668
  misc_feature: Up-regulated in root tissues in response to salicylic acid treatment
  misc_feature: Encodes the peptide sequence at SEQ ID NO 21717
atggcggagatcgccgagcgggccgtcgcgggcgagctgccggaggagccgcggccgccgcacggggaggaggaggacgaggaggaggaggaggagggggacgtgtgccggatctgccgcaaccgcggcgacgaggaccacccgctgcgctacccgtgcgcctgcagcggcagcatcaagttcgtgcaccaggactgcctcctccagtggctcgaccatagcaactcgcgccagtgcgaggtctgtaaacatgcattctccttctcacccgtgtacgctgagaatgctccgacaagacttcctttccaggaactgatagttggtgttggaatgaaagcatgccatgtgtttcaattcatccttcggcttgcctttgttctctcagtttggctcatgattatccctttcattacctattggatatggcggttaacatttgtgagaagtcttggtgaagcgcaaaggctgttcctcagtcacatcagtgctcagttgatccttagtgattgccttcatgggttccttctctcagctatcattgtccttatatttctcggagccacctcattacgggactacataaggcatttgcgtgaacttggtggacatgatgctgagagggatgatggaggacgtgaaaggcatggtgctcgggctgtcaggaggctagctggtcctaataatagggttcctggagatgcaaatattgatgaattagcagaagcccaaggaattggtcctggtgaacttctcaggagaaatgctgaaaatgttgctgctcgattagaacgacttgaggctcaggttgagcagatgcttgatggtctggatgacgcagatggtgcagaggatgttccttttgatgaacttgttggcatgcaaggccctgtcttccacttggttgagaatgcaataacagttttggccagcaatgctatattccttattgttgtgatctttgttccattctcattgggaaggattgtcctgtactatctatcatggtttttctcttcggcttctactcctatgctggcaaaaatgatgcccttcacagaaacagctatttctatagctaatgatacattgaagagcgcacttaatgttgtgaagaatttttcttccgacagtaataatgaaggtgttattgggcatgtgattgaggttgttactcaatccttgaagataaatgccactggtcttagtgtaattcaaggcactgggaagagcagtctgatgaaaggaacaacaattggctcatcttatctttcagatttgacaactcttgctgttggatacatgttcatcttctgtctggtatttttgtacattggatcactggccttacttcgatatgccaggggagaacgtttcaccattggaagactctatggtatagctactatattagaggccatcccttctctatgcaggcagttctttgctggaatgaagcaccttatgactatggtcaaagttgcattccttctggtcattgagcttggtgtatttcctcttatgtgtggttggtggcttgatgtttgcactctaaagatgctgggcacaacaattgcgcagagagttgaattctttacaatgtcacccttggcgagctcatctatccattggctagttgggattgtgtatatgcttcaaataagcatatttgtcagccttcttcgaggggtgctgcgcaatggagttctttattttctgcgggaccctgctgatccaaattacaatccatttagggatttgattgacgatcctgtgcataagcatgcccggcgtgttcttttgtcagttgcagtgtatggaagtttgattgtgatgctggtcttcttacctgtaaaactggccatgagagtagctccttcaatttttcctcttgacatcaccatatttgacccgtttactgagattccagttgatgtccttctgttccaaatatgcataccatttgctattgagcatttcaagcctcgtgcaaccattaaatctcttttacatcattggtttgctgcggttggttgggcccttggcttaaccgatttcttactgccaaaacctgaagaaaacggtgggcaggaaaattggaatggcagggcagaaagaagagacaggggacatggtggacgggaaatggttgccccacaggtcgaacaacgcatgatacagcatgttgccgcagaagataatggcaggggaaatgcaaatgaagcaaatgatgccactgaagaatctgatgtagatgatcaaggagactctgagtatggctttgtgcttcggatcgtgctcttgcttgtactggcatgggtgacactactgatattcaatgccggaatgatagttattcctatctcgcttggccgtttggtttttgaggctgttccccgtctgccaatcacacatggcatcaagtgcaatgatctgttctcctttagcattgggtgctatattctctggagtgcggcagctgggaccagatatgcgattgattacatcagatcacgacagctgggatttctgatctttgttattcctgtgctgattggactcctttttgagctgctggtcatcgtaccaatgagggtgcctattgatgagagccctgtcttcctattgtaccaggattgggcactggggttaatattcttgaaaatatggactagactggttatgttggatcagatggcacctttggttgatgaaagctggaggtcaaagtttgagagagttagagatgatggcttctcccgtttaaggggtctgtgggtcctccatgaaattataatgccgattgtcaccaagctccttacagctctctgtgtcccatacgtccttgcaaggggcatcttcccggtgctgggttaccctctcatagtgaactcagcagtgtaccgctttgcctggcttggatgcctgatcttcagcgcactcttcttttgtggcaagagattccatgtctggttcaccaacctccacaactccatcagggatgaccgctatctgattggccggaggctgcacaactttggcgaggactcacactcacccgaaccaagtgaatctggagcaactatagggtcagatgaccaggaccgagcccttgtcctgcgagatcaggaagaggacgtggggttgaggatgaggcgcaataatatgcgtgcaaaccaacaacccaggctggctttataa

SEQ ID NO: 21717 - protein, 1065 aa, Sorghum bicolor
  misc_feature: Ceres ANNOT ID no. 8743668
  misc_feature: Up-regulated in root tissues in response to salicylic acid treatment
  misc_feature (36)..(82): Pfam ID: zf-C3HC4 Pfam Description: Zinc finger, C3HC4 type (RING finger)
MAEIAERAVAGELPEEPRPPHGEEEDEEEEEEGDVCRICRNRGDEDHPLRYPCACSGSIKFVHQDCLLQWLDHSNSRQCEVCKHAFSFSPVYAENAPTRLPFQELIVGVGMKACHVFQFILRLAFVLSVWLMIIPFITYWIWRLTFVRSLGEAQRLFLSHISAQLILSDCLHGFLLSAIIVLIFLGATSLRDYIRHLRELGGHDAERDDGGRERHGARAVRRLAGPNNRVPGDANIDELAEAQGIGPGELLRRNAENVAARLERLEAQVEQMLDGLDDADGAEDVPFDELVGMQGPVFHLVENAITVLASNAIFLIVVIFVPFSLGRIVLYYLSWFFSSASTPMLAKMMPFTETAISIANDTLKSALNVVKNFSSDSNNEGVIGHVIEVVTQSLKINATGLSVIQGTGKSSLMKGTTIGSSYLSDLTTLAVGYMFIFCLVFLYIGSLALLRYARGERFTIGRLYGIATILEAIPSLCRQFFAGMKHLMTMVKVAFLLVIELGVFPLMCGWWLDVCTLKMLGTTIAQRVEFFTMSPLASSSIHWLVGIVYMLQISIFVSLLRGVLRNGVLYFLRDPADPNYNPFRDLIDDPVHKHARRVLLSVAVYGSLIVMLVFLPVKLAMRVAPSIFPLDITIFDPFTEIPVDVLLFQICIPFAIEHFKPRATIKSLLHHWFAAVGWALGLTDFLLPKPEENGGQENWNGRAERRDRGHGGREMVAPQVEQRMIQHVAAEDNGRGNANEANDATEESDVDDQGDSEYGFVLRIVLLLVLAWVTLLIFNAGMIVIPISLGRLVFEAVPRLPITHGIKCNDLFSFSIGCYILWSAAAGTRYAIDYIRSRQLGFLIFVIPVLIGLLFELLVIVPMRVPIDESPVFLLYQDWALGLIFLKIWTRLVMLDQMAPLVDESWRSKFERVRDDGFSRLRGLWVLHEIIMPIVTKLLTALCVPYVLARGIFPVLGYPLIVNSAVYRFAWLGCLIFSALFFCGKRFHVWFTNLHNSIRDDRYLIGRRLHNFGEDSHSPEPSESGATIGSDDQDRALVLRDQEEDVGLRMRRNNMRANQQPRLAL

SEQ ID NO: 21718 - DNA, 7581 bp, Sorghum bicolor
  misc_feature: Ceres ANNOT ID no. 8743723
  misc_feature: Up-regulated in root tissues in response to salicylic acid treatment
  misc_feature: Encodes the peptide sequence at SEQ ID NO 21719
atggcggcggcatctccaaagccagtcgctgctctgctattgcgaggctggcgctctttggtgttggtgcttgcatcggtcaatccaatatcggaaaagagtcgcaccaccaactggattagacaagaacaagaagacactggaagaatcggaatggcggataagctgactgtgggctccgctgtgacaagtcgcatatggaaatggatgagccaatttcagaaggagcaatgcaaagttccaaacttccaactgtcggccggtgctagcaaagtccaactgcggcatttccaatacaatgcccacatcgaagagcggacagagtaccaagctcaccggcgcggcgctagcgctccctccgccgttgcttcccagctgagcctgtgcgtccaccgctttgtgctccttttcaaccccaacgaagtttcgtgtagacttcggtttcaaggaaagcttggccgacaacaacaatatatcatgcagcctatttctttcccgtcatatctgacaatggttgcggtcggggagttgctagctaagctcgccttcaacgccacctggaacgagattgctttgcagctgaatttcagtaaagatttgaagagcatcaaggacaacctttcctttgtccaatctttccttgaggacgcggagagactgtcgtcaaggttggagagcgtccgtcacacgcttaagaagctcaaggctgcggcttatgacttggaggatatgctgctactcttcgagtgctggaccacccctcacaagggtgaaggccttgcgcttagcgccaaggctaaaaaggggttagttttatgctttgaaaggttgaagatgcctcataaaatgagaaaaatgagggaaaccatagaggagatagtagatctccagaataaattcaacttcatcaaacacactggcaacaatgatgaagaagtaatcaggaaacgggagacattctcagatgctgatgaagtccccgttgggaggatggaagaaaaagaaagattaatcagtatgttgcaaacagatgactcaaactgccttattgtttttatctctggctttgcaggagtaggtaaaactactcttgcccagatggtgttcaacgatgatagaacaagacaattatttgaaatccaagcgtgggtctatgtctctctaaaatttgatatcaataccatcggtcaatctatcatctcccaactggataaatcaagcagcccttctggtatccccttacaagctacacgtggccgactgaaaactattgtaacagggcaacggtttcttattattctcgatgacatatgggaagaagatccacatgagttggaaaaactatggacattgctgcggggtgctaaagcaggcagcaagatcattgcaaccacacgcagtgtaaaagttgctaagctaatgaatgggagtttgacaatagaattaagtgctttaccagacaattactgctgggagttgttccgaaaaaaggcatttccatatggaaaggtggatgttgataaggaaagtataggaagacagatagtcatgaaatgcagaggaatgccactagcagcaatttctctcggatacctttgccggacaactaatgaatggaaagctatcctggatagtgatatctgggcagaaaatggagatgatggacggttactcaaagatacgaaagtgctaccatcactgaagcttagttatcaatgcatgtcttatcatctcaagctctgttttgcatattgcgctattttccccaaaggctggtatatagagaagagtagcttgattcagcagtggattgcccttggatttcttcagctccatggcgaatcgttcactgcacaacaaatgcatgatttggttcgtgagcttgcaagattagttgcgggtgacgaagttgttgcctttgacactaggaagcaaaatcctcctacaaatatagacaactgtcgatacatgttgctctcaaacttatgtaactcatcctcatcttattggtctattcctagcacatcaagagctcttcattttaaggagtgcagcattgttcagactactttaaagtctctaatgggagctgaattcctacgtgtgctggattttagtgcatgtgctatttctgatctacctgcttctgtcggcaatttgagactcttgaagttcttaaatatatctggaatgcaaactggtctgctgcctaagcccctgagctcattgcatggtttacaagcattgaacctttctgaaaatacttgccttattgaacttccaagttacatttctgaatttgtcaacctacaatatttggacctacatggctgctcaaatcttgaagagctgccacagggcattcataaactcaaagagctactacacctgaacgtatcaagatgtggtaggctacaatttctgcctgaagagtttggggagcttcggaaacttgcattcctcaacctttcatattgttcccagcttcaaacgctgccttcaaattttggtggccttcaggatctttcatatctcaatctattgcactgttacaaacttcatgggctgcctgattctttcatctacctagcaaatatgatacatctaaatatgtccttctgccgccagttgaaactgctgcctagtgggttatttaagtacatgaagaaacttctagtcttgaatttgtctggttgtacctctcttgaagttcttcctgaattttgcaatattgatgctggctgtcggatgttgaaaactttggagttaccagattgtactaatctggctgtccttcccaaatcctgtaccagtctttgtgagctccggtgtttaaatctatcaggttgttctcgaattcagaactttctaaatttgattccgcagtggaaattcggtaagttggagtacctaaatctctccgaggtcggtgcaaaagcttattttgaagatccaggaacctctgcgggaaatgtagggagttcagaagaccctaatagagaactagagttaggtatgctgcaagaggatattgtgacccaacgtttggtttatcttaaatacctgtcagttggagggttcacactcttctcagaacaaggcattgcaagcttggtagaccttctaaccttgcccaattttgatgtacagacacaacccggtgacaaccaaagcaatattaagcttctccagcagattctggatctcacacatcatgagttaaacatcaaatgccttgagaatgtggtatcaccagaggaagcaaagcaagtggaactgggtaggaatcaacaacttcatttcttgagtcttgaatggtcctcatctgatattgggtcttctattggaaaggatcgtctaacaaaggctaccgaagtgctggaacatttgaagccccatcagaatttacagcatctctctataaaaggctacagcggcacaatatttccagattggattaacaatataaatgatgcactcccgaatctggtgaaaataatattgtctgatctcaagggatgtgaccacattcctgcattgggaaatttgccaaatctacaagaactggaaatcaatgatatgcccctgcttggccatgtaagaattgtaccatgcaagaagctaagacgacttgcattggttaatctgcgagaatacaccactgtacatatattttatgatgacaacactgagactcaagtaaatgaggtggtggaattaagtcacgactgtgataaggtagagaaactaacaggagacgagataagactacatgaagttgcatcaagttgtgactgtagtgaggaagagaggaaaacagcagaaaaaactgacgagttagctggttctcttccttcaaacaggcaatctaaaagaaagtggcatatcatggcctgtgaaggccaagacctaaagtctatggtaggagcccgagctctgcgtgtgaaggtcaaggatttgttgaaaggtccatattgtggcaagtggagggaaacatacataacacaggacactgcaggtgccggaaatgactcacctgctgtaatgagcagcaagccggcactaactccaggtccatctaatgaaacaacagaacaagcagcagtccctacgcttgattacttcaagatagaaagctgtcagaacctacgactgtatccatattacatcccaatgtgtgaagagttgttcatcaatgatagcagtatcgacctggatgatatggaacaggagtcatctgagtcacctgcagttaccagtagcaggccggcactaactccaggtccatctattgaaacaagagaacaagcggtccctaggcttgatttgttcaagttagaaagcagccagaacctacaactgtatccatattacatcccaatgtgtgaagagttattcatcaaggatagcagtcttgatctggatgatatggaacaggagttatctgagtcacctgcagttaccagtagcaggccggcactaactccaggtccatctattgaaacaagagaacaagcagcagtccctacgcttgattacttcaagttagaaagcagccagaatctacaactgtatccatattacagcccaatgtctgaagaattattcatcaaggatagcagtctcgatctggatgatatggaatcagagtcacctggaatgctcggacaggagttatcttacggaatgtatgaaggggagtttggttccttaatgcacggacgagaccccacttccagaaggtacagatcggagtctatttctggaacctcacggaaactcaagatagcaaattgcaaccagctgtctcttggtcggctgttgcttttattaaaatcatcactacaggaactcgaaattgatagcatggaaaggatcgatgactccatgcgcggacggtacatggacaaatgggagtctatctctggaaccctacggaaactcaagataacaaattgcaaccagcatattgttaaccgactgttgcttctattcaaatcatcactacaggaacttgaaattgatggcatcaaaagcattgatgccttgccatcaaatctgttcgaaatgaccagattggaaaaaatcactatatcatctcttgagcttcaagaagcaaaagggagcaacaatattaggaaacaactgtacgtttctggaattgcatacatcaatacaagacatgtggctctttttactgtgagaccgaagcaagggggttgggtgggctcaagccccacctacatccggcagaccgaagaagaggagaccgaagaagaagagaccgaagaagaagagaccgaagaagaggaggaagagcaccgcctacactttgccgctggttccaacaccagttgctccagtaacttctctcttctatatcagtatcttgataatgaaattcagtcgctaatgatccacggtcttgagcatattgatgagacagtagaggaagtaagcgaatgcagcgagttggctcaatatcggcaactgcagtcactgattttgatgtggtccagaagcagtttaccacaggattcaagcatagtcaatgacattgtggttctccggaaactccagcctcatgggaacctagaaacacttgaaatacaaggctataggggtgatacattttgttcctgggtaacgaatataagttatttccttccaaatcttgtgaaagttgagctttctaacatattatggtgccaacatatccctttattattaggccaactatcaaacttagaagtgctgcacatctcaaatatgcctagcatcagaaaagttggtggtgatatatatggggctgacagggcatttatgaaactgagagaacttacgcttgcaagtatggacaacctggaggagtggacgaccacactatcaactcgtgatgatgagcagaggcttcaggaaatccatggagatgaaatattatttcctaatctccaagtacttaccattagaaactgccccaggctgaggtttgttccagctttccctggaagccggagctgcatcatagaaagaagcagcgatgtactatcatctgagagatacattggaagttcgaatttggcattattgaacttgcaaatacggaactgtggcatttcttcagatatttccaaacttcttcagtactgtgttaatctggaaaaactgagtgttcattcctgcacggaccttatcaccttgccagaaagcatccgaagctactgcttcctcagggaactggagatagtaaactgttgggaattttctgctctaccggattggcttggagaactgacgtcgctacagaagctgacagtgcacgctgccaaactggaggttttaccccaatcgatccgatacctgactactttggacacgttagttctcaagaagagcaatttcagaatccttgagggttgcacactgggaaaggactttgacaatattaaacacatcaaacatatacgttataaacctcagagacctgttctttccttctgcagaagtggccctcatattgttgagctacaaattgaggatcttcatcttgtcaaccgagcagaggaagcagaggatttgaatttgattgggaaaaagaatctgcgttcactgagtttggactggagttcttattataaagaaagcttacctaataagcttgttttagaaaagctccagccatatgatagcctcgaaatactttgtataaataattataccggtgttgatttccctctttggatgtcatcactctcaaaccttgtcaaagtggagctctccaatgtgcgaattgagcacctgcacctggatcagttacagagtctggaagagctgcacatttctcggatacagagcctagggtcggaagtttgcatctggtgcaccgaaccacttagaaagctccgaaggattgtcttgtccgcattagccaagcaggagttgaaaatatccatgagggaggagctgggtcgcgacgagaatttattcccacgccttcaggatttggaggtacactgttgttttggattgaggttcgaaccatcaatcccaaggagtgctaggtatgtagtatcaggtagggaaggaacacaacgccaaggtcttttgccatctttccatcgaatcatggggccatctgtccctgcttcgttatctaaaatggagatcaggtgtagcagtgggttgtcatccgcatcctggaacgacctacgacactttgacatcggggaattgattattgacgactgttctgatgagatgcctttgccagagagcattcggggatggagatccctccagaaaatacagattttgaactgtgaccaaattacaacactgccggagtggttgggcgagatgacctccctccgggagctcacggtggagacctactttatgaaaactttacctgcatgcatccaacggctcactggattgcaggctttgaccctgtcaaaatgcggatcagtgcttgtggaaagatacaagttcggggaggacaaggataagatagtacacattccaaatttacatatagagcggagaaaatggaccttctcttcttcaacatccgcgctgtaa

SEQ ID NO: 21719 - protein, 2526 aa, Sorghum bicolor
  misc_feature: Ceres ANNOT ID no. 8743723
  misc_feature: Up-regulated in root tissues in response to salicylic acid treatment
  misc_feature (700)..(873): SWISSPROT Homolog: EC 2.7.11.1 Non-specific serine/threonine protein kinase
  misc_feature (310)..(614): Pfam ID: NB-ARC Pfam Description: NB-ARC domain
MAAASPKPVAALLLRGWRSLVLVLASVNPISEKSRTTNWIRQEQEDTGRIGMADKLTVGSAVTSRIWKWMSQFQKEQCKVPNFQLSAGASKVQLRHFQYNAHIEERTEYQAHRRGASAPSAVASQLSLCVHRFVLLFNPNEVSCRLRFQGKLGRQQQYIMQPISFPSYLTMVAVGELLAKLAFNATWNEIALQLNFSKDLKSIKDNLSFVQSFLEDAERLSSRLESVRHTLKKLKAAAYDLEDMLLLFECWTTPHKGEGLALSAKAKKGLVLCFERLKMPHKMRKMRETIEEIVDLQNKFNFIKHTGNNDEEVIRKRETFSDADEVPVGRMEEKERLISMLQTDDSNCLIVFISGFAGVGKTTLAQMVFNDDRTRQLFEIQAWVYVSLKFDINTIGQSIISQLDKSSSPSGIPLQATRGRLKTIVTGQRFLIILDDIWEEDPHELEKLWTLLRGAKAGSKIIATTRSVKVAKLMNGSLTIELSALPDNYCWELFRKKAFPYGKVDVDKESIGRQIVMKCRGMPLAAISLGYLCRTTNEWKAILDSDIWAENGDDGRLLKDTKVLPSLKLSYQCMSYHLKLCFAYCAIFPKGWYIEKSSLIQQWIALGFLQLHGESFTAQQMHDLVRELARLVAGDEVVAFDTRKQNPPTNIDNCRYMLLSNLCNSSSSYWSIPSTSRALHFKECSIVQTTLKSLMGAEFLRVLDFSACAISDLPASVGNLRLLKFLNISGMQTGLLPKPLSSLHGLQALNLSENTCLIELPSYISEFVNLQYLDLHGCSNLEELPQGIHKLKELLHLNVSRCGRLQFLPEEFGELRKLAFLNLSYCSQLQTLPSNFGGLQDLSYLNLLHCYKLHGLPDSFIYLANMIHLNMSFCRQLKLLPSGLFKYMKKLLVLNLSGCTSLEVLPEFCNIDAGCRMLKTLELPDCTNLAVLPKSCTSLCELRCLNLSGCSRIQNFLNLIPQWKFGKLEYLNLSEVGAKAYFEDPGTSAGNVGSSEDPNRELELGMLQEDIVTQRLVYLKYLSVGGFTLFSEQGIASLVDLLTLPNFDVQTQPGDNQSNIKLLQQILDLTHHELNIKCLENVVSPEEAKQVELGRNQQLHFLSLEWSSSDIGSSIGKDRLTKATEVLEHLKPHQNLQHLSIKGYSGTIFPDWINNINDALPNLVKIILSDLKGCDHIPALGNLPNLQELEINDMPLLGHVRIVPCKKLRRLALVNLREYTTVHIFYDDNTETQVNEVVELSHDCDKVEKLTGDEIRLHEVASSCDCSEEERKTAEKTDELAGSLPSNRQSKRKWHIMACEGQDLKSMVGARALRVKVKDLLKGPYCGKWRETYITQDTAGAGNDSPAVMSSKPALTPGPSNETTEQAAVPTLDYFKIESCQNLRLYPYYIPMCEELFINDSSIDLDDMEQESSESPAVTSSRPALTPGPSIETREQAVPRLDLFKLESSQNLQLYPYYIPMCEELFIKDSSLDLDDMEQELSESPAVTSSRPALTPGPSIETREQAAVPTLDYFKLESSQNLQLYPYYSPMSEELFIKDSSLDLDDMESESPGMLGQELSYGMYEGEFGSLMHGRDPTSRRYRSESISGTSRKLKIANCNQLSLGRLLLLLKSSLQELEIDSMERIDDSMRGRYMDKWESISGTLRKLKITNCNQHIVNRLLLLFKSSLQELEIDGIKSIDALPSNLFEMTRLEKITISSLELQEAKGSNNIRKQLYVSGIAYINTRHVALFTVRPKQGGWVGSSPTYIRQTEEEETEEEETEEEETEEEEEEHRLHFAAGSNTSCSSNFSLLYQYLDNEIQSLMIHGLEHIDETVEEVSECSELAQYRQLQSLILMWSRSSLPQDSSIVNDIVVLRKLQPHGNLETLEIQGYRGDTFCSWVTNISYFLPNLVKVELSNILWCQHIPLLLGQLSNLEVLHISNMPSIRKVGGDIYGADRAFMKLRELTLASMDNLEEWTTTLSTRDDEQRLQEIHGDEILFPNLQVLTIRNCPRLRFVPAFPGSRSCIIERSSDVLSSERYIGSSNLALLNLQIRNCGISSDISKLLQYCVNLEKLSVHSCTDLITLPESIRSYCFLRELEIVNCWEFSALPDWLGELTSLQKLTVHAAKLEVLPQSIRYLTTLDTLVLKKSNFRILEGCTLGKDFDNIKHIKHIRYKPQRPVLSFCRSGPHIVELQIEDLHLVNRAEEAEDLNLIGKKNLRSLSLDWSSYYKESLPNKLVLEKLQPYDSLEILCINNYTGVDFPLWMSSLSNLVKVELSNVRIEHLHLDQLQSLEELHISRIQSLGSEVCIWCTEPLRKLRRIVLSALAKQELKISMREELGRDENLFPRLQDLEVHCCFGLRFEPSIPRSARYVVSGREGTQRQGLLPSFHRIMGPSVPASLSKMEIRCSSGLSSASWNDLRHFDIGELIIDDCSDEMPLPESIRGWRSLQKIQILNCDQITTLPEWLGEMTSLRELTVETYFMKTLPACIQRLTGLQALTLSKCGSVLVERYKFGEDKDKIVHIPNLHIERRKWTFSSSTSAL

SEQ ID NO: 21720 - DNA, 3906 bp, Sorghum bicolor
  misc_feature: Ceres ANNOT ID no. 8743759
  misc_feature: Up-regulated in root tissues in response to methyl jasmonate treatment
  misc_feature: Up-regulated in shoot tissues in response to methyl jasmonate treatment
  misc_feature: Up-regulated in root tissues in response to salicylic acid treatment
  misc_feature: Encodes the peptide sequence at SEQ ID NO 21721
atggccgccaccgccggtgcgtcggacgacggcggtagcgtcggcggcggcgggggcggcgagcggatgaagctgctgtgcagcctcggcgggcgcatcctcccgcgcccgggggacggcacgctgcggtacgcgggtggggacacccggatcgtgtccgtgccgcgcggggtgtcgctgccggacctcctggcgcggctcgccgacgcgtacggcggcgccacgggcccgcacttcgccgtcaagtaccagctccccgacgaagggctcgacgcgctcatctccgtgtcctcgccggaggatctcgacaacatggtcgaggagtacgacaagctcagcggcgccagccccaagctgagggtcttcatcttccccatcctggatgcggtgggggccggcagcggcgccgccggcggggaggagttggagaccgggagcttcgacgcgggccttcggtacctggaggccgtgaacggcattgtgcgcaaggacagcatcgcgagcctctcctccacgcagtgctctgacggggggctgccccctccggcgccgtcaggtggtggcggcggccctgggtctccggctgggctttcccccacctccactagctcaaatgatgccgcgagatcgaacatcagtggggctggggtggcgcctccgccccttgttgatgtcttcagcaatgctgctcctgctcctgtacaggtgaagccacaggagattgctgctgaagggagggctccccaggcgaatccacatccacatccagaggtagctacacatccccatccagaggcaacgaggtacaggcaaccactgtcgcagctgccaccactgcctcctgtcttcatgaacgatcatagagatgccattcagggtctgaatcagcagccaccaggtcatgggccaagattcgacgattgccacatgtgcttgaaggcattgcctcacgcccactctgatccggtggtgaatgagtatggcaatgaggtgcatggaggggctgctcctgagcctgggcctgtgttcatgagcctgcggcctgaagatgtggcaaggatgatgataccagagaggggcgttcaggcaccaatgggggcttatggatacacacatatgcatccagtgccgcaggagagggtgtatgtgcccaagatggaaggggttacaaactcagtgctcattgacccaactggcttgcatcagcatgtgtatgtgcagcagcaaatgccgccacaacagttgccatcaacctatgggtttagccatattcccgtgattcctagcgagaaggacagagtagtttctccaagttctgcgcatactgatgttgcgagctctcatcatcaatttttgcagcagtcacagcagcagttaccttctggccatgggatgcctcagtattcagtgaagcctgctagtcccaataacccgcttgctggtgaaggtagtgtaagtggcaattcaaggcatcgtgaggatgggcaggtgtatcgtgacaatgcgcctccagttgcacctgtggctgtgccaacatacatggcaaatgtggacaggatgatggattcactccggatgagccccagcgaggtttctggctctactgaacaaaggaaacatgcaatgtctcctgacagtggtttaccccagaatgcagtgccagatcactctcaggggcacccagagaacagtatcagtacctggccagatacccgagcaaatgaggttcatccaagcaacaccaatactttttttgatgttagtgaaccaaaggtattacttcaaactgaatctgcaccaccaccttctgtggccagctcttatctgcacaacgtccagcatgttaatatgagccatatgccacatatgatgagcattgggggaccctattctagttatgttgttgctacagtcggacctggtggattgcctcaatcaacttatggtattgatatggtctatccaaatgccactgttaatccagcaagtgagagaagagatgttccgcctgaagtttatcacaaggaagctccacatgaagtcgtagctcctccaaacacagttcagttgccgacagcagcattggcaaaccatgctccaaatgtggatcaagcagctgccaatgcacatgcgctgccaccaagacctaagagggtagcaagcagagagaacatcagcccaaaggatccccatccaaacaactctttgttgaactgcaaagggccagatctgaatattccagctgaggatgtttctctccagaaacagtcagatcacaaaggtgatgacatctctaacctagatttactgagtatggaggatgagttagctacatctaaagctcagtcatccgagcctcaacctcctctgattataaagaacaatgaccttgaagagctccaagagcttggttctggaacttttggaactgtctatcatggtaaatggagaggcactgatgttgcaataaaacgaatcaatgatagatgttttgctgggaaaccatctgagcaagaaaagatgcggtatgacttctggaatgaagcatctaaacttgccgatctgcaccacccaaatgttgtcgctttttatggtgttgtgcttgatggacctgggggatccattgccacagttacagaatatatggtcaatggctcacttaggacagctttgctaaagaatgccaaaaccctcgatcggcgcaagagattaattattgccatggatacagcctttggaatggaatacttgcatagcaagaacatcgtgcactttgacctgaaaagtgacaatttgcttgttaatttgagggaccctcagcgtccaatatgcaaggttggtgatcttgggctttcaaaagtgaagtgtcagaccctcatctctggaggtgtccggggaacacttccatggatggccccagaacttctgaatggtagcagcagcttggtctcggaaaaggttgatgtattctcttttgggattgttctctgggaactgttaacaggagaagagccatatgcagatttacactatggtgttataataggtggcattgtgagcaacactctacggccggcagtgcccgactcctgtgacccagagtggaggtcactaatggagcaatgctggtcaacagaaccatctgagcggccaaactttacagagattgcgaacaggctgcgctccatggcagcgtcccagaagtcggtcaggtcggttggtcagttagaatgtgaactggttgttgctggcttggcaccccttgttccccatcctcctggctgccggggctgtgattgtgaacaatggcgagtgctctgtcacggcttgaagttgtcaggctgtcatgggctgaggaccgcagagccagcaggcagccagggtgacgacgacacagggaggcagggagcagctagtcgacggccgtgcagtcgtgatggggacggcgacgcacgcatggcacccctaccctgttccgggaggcgtggcggtggcgcgcccaccatgaccccgcacgcccgccgctatctagcgtgtcacgtatggggcgcacgccccgtgcgcgttgcggtgtacgcgtgcgctcgcgccaacgcaggaatcgcatccggtaccccatgggcaagtgggtcgtatccatccctgaccgtgcccacaacttgtggaaaatctctgcactctccacgacgccaccggagggaacccagatccaacatcgcgggtcgcgacttgcgacaagacacggcggcatatgcactgccagtgcggcttttgcacagcgctagatcagctggcacggagccagagcccagagagtaccagacacgcaggcacgacgactatgaaatgaagcgctacactactgggctgccgacatccatcagcagcagagccgaggcagattga

SEQ ID NO: 21721 - protein, 1301 aa, Sorghum bicolor
  misc_feature: Ceres ANNOT ID no. 8743759
  misc_feature: Up-regulated in root tissues in response to methyl jasmonate treatment
  misc_feature: Up-regulated in shoot tissues in response to methyl jasmonate treatment
  misc_feature: Up-regulated in root tissues in response to salicylic acid treatment
  misc_feature (796)..(1066): SWISSPROT Homolog: EC 2.7.11.1 Non-specific serine/threonine protein kinase
  misc_feature (797)..(1060): Pfam ID: Pkinase_Tyr Pfam Description: Protein tyrosine kinase
  misc_feature (37)..(126): Pfam ID: PB1 Pfam Description: PB1 domain
MAATAGASDDGGSVGGGGGGERMKLLCSLGGRILPRPGDGTLRYAGGDTRIVSVPRGVSLPDLLARLADAYGGATGPHFAVKYQLPDEGLDALISVSSPEDLDNMVEEYDKLSGASPKLRVFIFPILDAVGAGSGAAGGEELETGSFDAGLRYLEAVNGIVRKDSIASLSSTQCSDGGLPPPAPSGGGGGPGSPAGLSPTSTSSNDAARSNISGAGVAPPPLVDVFSNAAPAPVQVKPQEIAAEGRAPQANPHPHPEVATHPHPEATRYRQPLSQLPPLPPVFMNDHRDAIQGLNQQPPGHGPRFDDCHMCLKALPHAHSDPVVNEYGNEVHGGAAPEPGPVFMSLRPEDVARMMIPERGVQAPMGAYGYTHMHPVPQERVYVPKMEGVTNSVLIDPTGLHQHVYVQQQMPPQQLPSTYGFSHIPVIPSEKDRVVSPSSAHTDVASSHHQFLQQSQQQLPSGHGMPQYSVKPASPNNPLAGEGSVSGNSRHREDGQVYRDNAPPVAPVAVPTYMANVDRMMDSLRMSPSEVSGSTEQRKHAMSPDSGLPQNAVPDHSQGHPENSISTWPDTRANEVHPSNTNTFFDVSEPKVLLQTESAPPPSVASSYLHNVQHVNMSHMPHMMSIGGPYSSYVVATVGPGGLPQSTYGIDMVYPNATVNPASERRDVPPEVYHKEAPHEVVAPPNTVQLPTAALANHAPNVDQAAANAHALPPRPKRVASRENISPKDPHPNNSLLNCKGPDLNIPAEDVSLQKQSDHKGDDISNLDLLSMEDELATSKAQSSEPQPPLIIKNNDLEELQELGSGTFGTVYHGKWRGTDVAIKRINDRCFAGKPSEQEKMRYDFWNEASKLADLHHPNVVAFYGVVLDGPGGSIATVTEYMVNGSLRTALLKNAKTLDRRKRLIIAMDTAFGMEYLHSKNIVHFDLKSDNLLVNLRDPQRPICKVGDLGLSKVKCQTLISGGVRGTLPWMAPELLNGSSSLVSEKVDVFSFGIVLWELLTGEEPYADLHYGVIIGGIVSNTLRPAVPDSCDPEWRSLMEQCWSTEPSERPNFTEIANRLRSMAASQKSVRSVGQLECELVVAGLAPLVPHPPGCRGCDCEQWRVLCHGLKLSGCHGLRTAEPAGSQGDDDTGRQGAASRRPCSRDGDGDARMAPLPCSGRRGGGAPTMTPHARRYLACHVWGARPVRVAVYACARANAGIASGTPWASGSYPSLTVPTTCGKSLHSPRRHRREPRSNIAGRDLRQDTAAYALPVRLLHSARSAGTEPEPREYQTRRHDDYEMKRYTTGLPTSISSRAEAD

SEQ ID NO: 21722 - DNA, 2169 bp, Sorghum bicolor
  misc_feature: Ceres ANNOT ID no. 8743885
  misc_feature: Down-regulated in root tissues in response to aminocyclopropane carboxylic treatment
  misc_feature: Down-regulated in root tissues in response to salicylic acid treatment
  misc_feature: Down-regulated in shoot tissues in response to salicylic acid treatment
  misc_feature: Up-regulated in shoot tissues in response to methyl jasmonate treatment
  misc_feature: Encodes the peptide sequence at SEQ ID NO 21723
atggaggaagagcagagcccgaggatcatcgagaacgatctgttcaagcacgactggcgcagccggtccaacgtggaggtgctgcagtacatcttcctcaagtgggccatggcgttcctcgtcggcctcctcaccggcgtcatcgcgtccctcatcaacctcgccatcgagaacatctccggcctcaagatgcaacacatggtcaacctcgtccgcgagaagcgctactgggcgggcttcctctacttcgccggcgtcaacttcgcgctcaccttcgtcgccgccgtgctctgcgtcgtcttcgcccccaccgccgccggccccggcatccccgagatcaaggcttatctcaacggcgtcgacacgcccaacatgttcggcgcgccgcagctcatcgtcaagatcattggcagcatcggcgccgtgtcgtcgggaatggatctcggcaaggagggcccgctggtgcacatcggcgcgtgcctggccaacctgctcagccagggcggcgagggccgctggcggctgcgctggcggtggctgcgctacttcaacaacgaccgggaccgccgggacctgatcacgtgcggcgcgtcgtccggggtgtgcgcggcgtttcgcgcgcccgtcggcggcgtgctgttcgcgctggaggaggtggcgacgtggtggcggagcgcgctgctgtggcgcaccttcttcagcacggccaccgtcgtggtggtgctgcgcggcttcatcgaggtgtgcagggacgggcgctgcggcatgttcggcgagggcgggctcatcctcttcgacgtcagcgatgtcaccgtccgctaccacgtcggcgacctcctccccgtcacgctcgtcggcgtcctcggcggcgtcctcggggcgctctacaaccacgtcctccaccaggtgctccggctgtacaacctgatcaatgccaagggacggatggcgaagctggcgctcgccctcgcggtgtccgtgttcacgtcggcggggctgtacctcctgccgttcgccgtgccgtgctcgccgtgcgacccggcgttcggcgacgcgtgcccgacggtgggcaagtccggcaacttcaagcagttcaactgccccgacggctactacaacgacctcgcgtcgctgctccacgccaccaacacggacgccacgcgcaacatcttctccacgggcaccgccggcgagttcaggctcgactcgctgctcatcttcttcgccatctactgcgtgctggggctcttcaccttcggcatcgccgtgccgtcgggcctcttcctgcccatcatcctcatgggctccgcctacggccgcatggtcgcgctcgtgctcgcgcgcttcgtgcggatcgaccacggcctctacgccgtgctcggcgccgccgcgctcatgtcgggctccatgaggatgaccgtctcgctctgcgtcatcttcctcgagctcaccaacaacctcctcctgctccccatcaccatgttcgtgctgctcatcgccaagacggtcggtgacgccttcaaccccagcatctacgagatcatcctcgacctcaagggcctgccgttcctggagcccaagccggagacgtggatgaaggacctggccgtcggcgagctcgcggccgccaagccgcgggtcgttacgctgcaggtcatcgagaaggtgtccaccgtcgtcgaggtgctcaggtccacgccgcacaacggcttccccgtgctggaccggccacggccaggcgtgtcggagctccacgggctggtgctccggtcccacctcatggcagtgctcaagaagcggtggttcctgacggagaagaggaggacggaggaatgggaggcccgtgagaggttctcgtcgacggagctcgcggagaagtccgggagcatcgacgaggtggcggtgcagttgacgccggaggagctggacatgtacattgacctccacccgttcaccaacaccacgccgtacaccgtcgtagagaccatgtcggtggccaaggccgtggtgctcttccgaacctgcgcgctccggcacatgctcatcatcccaaagttccaaggccctgagatagctccaattgttgggattctaacaaggcaggacctcagggcacacaacatccttggtgcatttcctcatctggcaaacaaaaggaaagtacactaa

SEQ ID NO: 21723 - protein, 722 aa, Sorghum bicolor
  misc_feature: Ceres ANNOT ID no. 8743885
  misc_feature: Down-regulated in root tissues in response to aminocyclopropane carboxylic treatment
  misc_feature: Down-regulated in root tissues in response to salicylic acid treatment
  misc_feature: Down-regulated in shoot tissues in response to salicylic acid treatment
  misc_feature: Up-regulated in shoot tissues in response to methyl jasmonate treatment
  misc_feature (89)..(506): Pfam ID: Voltage_CLC Pfam Description: Voltage gated chloride channel
  misc_feature (541)..(708): Pfam ID: CBS Pfam Description: CBS domain pair
MEEEQSPRIIENDLFKHDWRSRSNVEVLQYIFLKWAMAFLVGLLTGVIASLINLAIENISGLKMQHMVNLVREKRYWAGFLYFAGVNFALTFVAAVLCVVFAPTAAGPGIPEIKAYLNGVDTPNMFGAPQLIVKIIGSIGAVSSGMDLGKEGPLVHIGACLANLLSQGGEGRWRLRWRWLRYFNNDRDRRDLITCGASSGVCAAFRAPVGGVLFALEEVATWWRSALLWRTFFSTATVVVVLRGFIEVCRDGRCGMFGEGGLILFDVSDVTVRYHVGDLLPVTLVGVLGGVLGALYNHVLHQVLRLYNLINAKGRMAKLALALAVSVFTSAGLYLLPFAVPCSPCDPAFGDACPTVGKSGNFKQFNCPDGYYNDLASLLHATNTDATRNIFSTGTAGEFRLDSLLIFFAIYCVLGLFTFGIAVPSGLFLPIILMGSAYGRMVALVLARFVRIDHGLYAVLGAAALMSGSMRMTVSLCVIFLELTNNLLLLPITMFVLLIAKTVGDAFNPSIYEIILDLKGLPFLEPKPETWMKDLAVGELAAAKPRVVTLQVIEKVSTVVEVLRSTPHNGFPVLDRPRPGVSELHGLVLRSHLMAVLKKRWFLTEKRRTEEWEARERFSSTELAEKSGSIDEVAVQLTPEELDMYIDLHPFTNTTPYTVVETMSVAKAVVLFRTCALRHMLIIPKFQGPEIAPIVGILTRQDLRAHNILGAFPHLANKRKVH

SEQ ID NO: 21724 - DNA, 2406 bp, Sorghum bicolor
  misc_feature: Ceres ANNOT ID no. 8743888
  misc_feature: Down-regulated in root tissues in response to aminocyclopropane carboxylic treatment
  misc_feature: Down-regulated in root tissues in response to salicylic acid treatment
  misc_feature: Down-regulated in shoot tissues in response to salicylic acid treatment
  misc_feature: Up-regulated in shoot tissues in response to methyl jasmonate treatment
  misc_feature: Encodes the peptide sequence at SEQ ID NO 21725
atggaggaagagcagagcccgaggcttggccgggagccggcgaccgagcccagtccttcgctggaatggccggagccggaatgtaagaacgacgacggtgtgaaagacccagaagacccggagagcaccggcggcggcggtgacggcaacggcatcagctccctggagcagccgctgctcaagcggagcaccaccctgacggccagccacctcgccatcgtcggcgccaaggtctcccacatcgagagcctcgactacgagatcatcgagaacgatctgttcaagcacgactggcgcagccggtccaacgtggaggtgctgcagtacatcttcctcaagtgggccatggcgttcctcgtcggcctcctcaccggcgtcatcgcgtccctcatcaacctcgccatcgagaacatctccggcctcaagatgcaacacatggtcaacctcgtccgcgagaagcgctactgggcgggcttcctctacttcgccggcgtcaacttcgcgctcaccttcgtcgccgccgtgctctgcgtcgtcttcgcccccaccgccgccggccccggcatccccgagatcaaggcttatctcaacggcgtcgacacgcccaacatgttcggcgcgccgcagctcatcgtcaagatcattggcagcatcggcgccgtgtcgtcgggaatggatctcggcaaggagggcccgctggtgcacatcggcgcgtgcctggccaacctgctcagccagggcggcgagggccgctggcggctgcgctggcggtggctgcgctacttcaacaacgaccgggaccgccgggacctgatcacgtgcggcgcgtcgtccggggtgtgcgcggcgtttcgcgcgcccgtcggcggcgtgctgttcgcgctggaggaggtggcgacgtggtggcggagcgcgctgctgtggcgcaccttcttcagcacggccaccgtcgtggtggtgctgcgcggcttcatcgaggtgtgcagggacgggcgctgcggcatgttcggcgagggcgggctcatcctcttcgacgtcagcgatgtcaccgtccgctaccacgtcggcgacctcctccccgtcacgctcgtcggcgtcctcggcggcgtcctcggggcgctctacaaccacgtcctccaccaggtgctccggctgtacaacctgatcaatgccaagggacggatggcgaagctggcgctcgccctcgcggtgtccgtgttcacgtcggcggggctgtacctcctgccgttcgccgtgccgtgctcgccgtgcgacccggcgttcggcgacgcgtgcccgacggtgggcaagtccggcaacttcaagcagttcaactgccccgacggctactacaacgacctcgcgtcgctgctccacgccaccaacacggacgccacgcgcaacatcttctccacgggcaccgccggcgagttcaggctcgactcgctgctcatcttcttcgccatctactgcgtgctggggctcttcaccttcggcatcgccgtgccgtcgggcctcttcctgcccatcatcctcatgggctccgcctacggccgcatggtcgcgctcgtgctcgcgcgcttcgtgcggatcgaccacggcctctacgccgtgctcggcgccgccgcgctcatgtcgggctccatgaggatgaccgtctcgctctgcgtcatcttcctcgagctcaccaacaacctcctcctgctccccatcaccatgttcgtgctgctcatcgccaagacggtcggtgacgccttcaaccccagcatctacgagatcatcctcgacctcaagggcctgccgttcctggagcccaagccggagacgtggatgaaggacctggccgtcggcgagctcgcggccgccaagccgcgggtcgttacgctgcaggtcatcgagaaggtgtccaccgtcgtcgaggtgctcaggtccacgccgcacaacggcttccccgtgctggaccggccacggccaggcgtgtcggagctccacgggctggtgctccggtcccacctcatggcagtgctcaagaagcggtggttcctgacggagaagaggaggacggaggaatgggaggcccgtgagaggttctcgtcgacggagctcgcggagaagtccgggagcatcgacgaggtggcggtgcagttgacgccggaggagctggacatgtacattgacctccacccgttcaccaacaccacgccgtacaccgtcgtagagaccatgtcggtggccaaggccgtggtgctcttccgaacctgcgcgctccggcacatgctcatcatcccaaagttccaaggccctgagatagctccaattgttgggattctaacaaggcaggacctcagggcacacaacatccttggtgcatttcctcatctggcaaacaaaaggaaagtacactaa

SEQ ID NO: 21725 - protein, 801 aa, Sorghum bicolor
  misc_feature: Ceres ANNOT ID no. 8743888
  misc_feature: Down-regulated in root tissues in response to aminocyclopropane carboxylic treatment
  misc_feature: Down-regulated in root tissues in response to salicylic acid treatment
  misc_feature: Down-regulated in shoot tissues in response to salicylic acid treatment
  misc_feature: Up-regulated in shoot tissues in response to methyl jasmonate treatment
  misc_feature (168)..(585): Pfam ID: Voltage_CLC Pfam Description: Voltage gated chloride channel
  misc_feature (620)..(787): Pfam ID: CBS Pfam Description: CBS domain pair
MEEEQSPRLGREPATEPSPSLEWPEPECKNDDGVKDPEDPESTGGGGDGNGISSLEQPLLKRSTTLTASHLAIVGAKVSHIESLDYEIIENDLFKHDWRSRSNVEVLQYIFLKWAMAFLVGLLTGVIASLINLAIENISGLKMQHMVNLVREKRYWAGFLYFAGVNFALTFVAAVLCVVFAPTAAGPGIPEIKAYLNGVDTPNMFGAPQLIVKIIGSIGAVSSGMDLGKEGPLVHIGACLANLLSQGGEGRWRLRWRWLRYFNNDRDRRDLITCGASSGVCAAFRAPVGGVLFALEEVATWWRSALLWRTFFSTATVVVVLRGFIEVCRDGRCGMFGEGGLILFDVSDVTVRYHVGDLLPVTLVGVLGGVLGALYNHVLHQVLRLYNLINAKGRMAKLALALAVSVFTSAGLYLLPFAVPCSPCDPAFGDACPTVGKSGNFKQFNCPDGYYNDLASLLHATNTDATRNIFSTGTAGEFRLDSLLIFFAIYCVLGLFTFGIAVPSGLFLPIILMGSAYGRMVALVLARFVRIDHGLYAVLGAAALMSGSMRMTVSLCVIFLELTNNLLLLPITMFVLLIAKTVGDAFNPSIYEIILDLKGLPFLEPKPETWMKDLAVGELAAAKPRVVTLQVIEKVSTVVEVLRSTPHNGFPVLDRPRPGVSELHGLVLRSHLMAVLKKRWFLTEKRRTEEWEARERFSSTELAEKSGSIDEVAVQLTPEELDMYIDLHPFTNTTPYTVVETMSVAKAVVLFRTCALRHMLIIPKFQGPEIAPIVGILTRQDLRAHNILGAFPHLANKRKVH

SEQ ID NO: 21726 - DNA, 3753 bp, Sorghum bicolor
  misc_feature: Ceres ANNOT ID no. 8744031
  misc_feature: Up-regulated in shoot tissues in response to methyl jasmonate treatment
  misc_feature: Encodes the peptide sequence at SEQ ID NO 21727
atggttgaaggatcagagagtgccccaagggataatttctgcttctgcttaggtgaaccaggatcatttatggcagacaaatcttgtgaatgtacacgacagtctttattcagaaagaatcgtgcttcttccattgatgttgcaaacattctgtcttgtagcaagaagcctgtatttgctaaagagttgaaaagactgaaactagtcgaggagatagtctgtttgaagagcaacattacttgctgcagtggtgatgcaatctttttcagttcattagtgtcggctgctactactgctggtgatgtacttatgaaattacaagggcttctcatggtggtgtcgacagaaagtataaatcttgaacttattggggatggagctccgaaaaagaaagatgttgaaaagaccagtggaggttctcggaaaggaaagaagaagtctaacacattgaaaaagccaacagtatctactaagccgtccaaggataacggatgcagtagttcagatagtcgcaattgtaggcctttaccaaaccattgtggtccatctgttgaaggcactgctgctggacctccatctgaaaaaactcctaacaaggaaattgtaccaacaatgaaggttgagcaaactgtcgtgttggatggttgcagaaatcaatgtaacaaaaagaagaacaaacgcaaagggaaaacaaaactaccaaatctgatgaggcctgagagcccaagatctaccaaattgaaaacagctgttccccatagtgctgcagaggcctcgcatgaagctgctgaagaggctgatgtctcacctcatcacccatcttatgtccgtccttccaagaacgagatctctgaagcagttaactgttctaactcttccattttatctaatggaacaaaggtaatagccaccagtaagggtgcaaaacttgaagacacattgtatcctcctagagtttgctcatcaattgctacagaactttctcagagtgctcatgatgatgccttcaatgtggctgagcaggcctcttcgtacattagtcaaagtgaatccttggttcagtcatcctcttgtttaccttctagaagcaatgatgtctcttccactaatatggatggaagttcagttgactccttggtaagatctgcacaggaaaaaactgaatgtgatgagaaacatgtggataataaatctgaagtgacaaagaacaaaattttaccttctgttattcctactgacatgcttcaaagtgctataagtgaaaatggagttatgaaaaatagtggcggtgaatattatgtatacaataggaacctactgggaggaacgtcatatgaatggcctagtgtaacaccatctcattttgtatctcctcaaatgcaacagcgtccagctgcagaagacaggttgcatcttgatgttggttacaaatggccaactcaatttagccaaccctttctccctgccaaccatcaggtgaggaatccaccaattgatgctggatgcaatcaaatgttaccttctctagcagtgccgctaagttttgactggcctcctgtttttagaggttatggtaaaaatgctgctgtaagctatgatccattgtataccccacagatgcaatcttctgcttggtcagggttccctgctcaattagtgcaaagagggggtatctgcagtgacagtgatgttgcggatgatactgaaagctactggttttctgaagaagaatcagatagtcgcgcacattctggaagagatattaatcaatactttggtggaggtgtgatgtactggagtcctgcggaacatgcaggaactggtttttctaggccaccatctcttagttcagatgatagtgcctgggcttggcatgaggctgatgttatacgagttgttgatgatgtggctaatggtattccatctacatacacaaatggtgtatcatcaccaccctccactccatcctgttctcaaaacgaatctttggatccaggtgctcactcgataacagggaatgaaatcaataatgaagctctgacctctccatcttccgtgcaagatagccctgaagataaaataacttcagttgcaaaggctgtgtcttgtggcagtgaagtagttaaggcagatacattaccatatgccatgctgaggccgatagttgttcctaatatatcacgaaggtcatcaagatctgacattaagggtggtcatgatcacaggagcccatgcgtaccatcaacaaggagggacatacctattctaagaagacctccatcaccagtagtacttagtgttcctcgcgtacctaggccaccacctccttcacctgctggagagtcaagaaaacgaggattccctatcgttagatccggcagctcaagtcctcgacattgggggatgagaggtttattttctgaagacaaaattttccatagggctcagttttgcttggatggtcctgaagttgtatggccttcatggggtaacaagggcacttctggtacattggtgcaaacaattgaggatactgttttgcaggaccaccttgttaagatttcacagctatctcgtgatcaacatccactagatatgctaaatggtttgtctcacaagacatccctctctttgatgcacaatgctctacatgaagaaatagatcaattctgtaagcaggttgctgctgctgatctggtgaggaggccctatataaactgggctgtcagaagagtcacacggtgcttgcaagttttgtggcctcgctcccgtacaaatctatttggctcaaatgccactggtttggctcttccaactagtgatgttgatcttgtggtttctcttcctcctgtccgaaacctggaacctattaaagaagctggaattttggaaggccgtaatggtatcaaggaaacatgtctgcagcatgcagcaagatgtcttacaaaccaggattgggttagaagtgattcccttaaaacagttgaaaacacagctatacctgtgatcatgcttgtagcggatgtaccctgtgacacaaatatgtccaatgagtattcttcagtactggatggctcacaagaatattcagttaacatgcttggagaacaagggagtcctcctcggtctgacacctctagttcagaaggcagcaacatgctggtgtgctcaaaattgaataaggacgattgtgatattgtgcagtcaattcgtcttgatataagtttcaaatcgtcatcccacacagggctgcagactactgagttggtgcgcgagttgacccaacaatttcctgcggttgtacctcttgccttgattctcaagaagtttttggctgaccggagtttggaccacccctattcaggtggtctaagctcttactgtttgcatgagcatcatcttggtcggcctattaaccaaaatctgggcagccttttgatggatttcttgtacttttttgggaacatatttgatccacgccatatgcgcatttccatccaaggaagtggaatttatttgaatcgagaaagagggcacagcattgacccgattcacatagatgatccactttgccctgctaacaatgtgggcaggaattgtttccgcattcaccaatgcattaaggcatttgctgatgcttttgctgttcttgagaatgagctactgcagttcagttcagaatgtagcatgcctgcatcagcattcaatatactaaagaaaataatcccgagtatcgattctgatgagctgtag

SEQ ID NO: 21727 - protein, 1250 aa, Sorghum bicolor
  misc_feature: Ceres ANNOT ID no. 8744031
  misc_feature: Up-regulated in shoot tissues in response to methyl jasmonate treatment
  misc_feature (1070)..(1176): SWISSPROT Homolog: EC 2.7.7.7 DNA-directed DNA polymerase
  misc_feature (1141)..(1194): Pfam ID: PAP_assoc Pfam Description: Poly(A) polymerase
  misc_feature (909)..(980): Pfam ID: NTP_transf_2 Pfam Description: Nucleotidyltransferase domain
MVEGSESAPRDNFCFCLGEPGSFMADKSCECTRQSLFRKNRASSIDVANILSCSKKPVFAKELKRLKLVEEIVCLKSNITCCSGDAIFFSSLVSAATTAGDVLMKLQGLLMVVSTESINLELIGDGAPKKKDVEKTSGGSRKGKKKSNTLKKPTVSTKPSKDNGCSSSDSRNCRPLPNHCGPSVEGTAAGPPSEKTPNKEIVPTMKVEQTVVLDGCRNQCNKKKNKRKGKTKLPNLMRPESPRSTKLKTAVPHSAAEASHEAAEEADVSPHHPSYVRPSKNEISEAVNCSNSSILSNGTKVIATSKGAKLEDTLYPPRVCSSIATELSQSAHDDAFNVAEQASSYISQSESLVQSSSCLPSRSNDVSSTNMDGSSVDSLVRSAQEKTECDEKHVDNKSEVTKNKILPSVIPTDMLQSAISENGVMKNSGGEYYVYNRNLLGGTSYEWPSVTPSHFVSPQMQQRPAAEDRLHLDVGYKWPTQFSQPFLPANHQVRNPPIDAGCNQMLPSLAVPLSFDWPPVFRGYGKNAAVSYDPLYTPQMQSSAWSGFPAQLVQRGGICSDSDVADDTESYWFSEEESDSRAHSGRDINQYFGGGVMYWSPAEHAGTGFSRPPSLSSDDSAWAWHEADVIRVVDDVANGIPSTYTNGVSSPPSTPSCSQNESLDPGAHSITGNEINNEALTSPSSVQDSPEDKITSVAKAVSCGSEVVKADTLPYAMLRPIVVPNISRRSSRSDIKGGHDHRSPCVPSTRRDIPILRRPPSPVVLSVPRVPRPPPPSPAGESRKRGFPIVRSGSSSPRHWGMRGLFSEDKIFHRAQFCLDGPEVVWPSWGNKGTSGTLVQTIEDTVLQDHLVKISQLSRDQHPLDMLNGLSHKTSLSLMHNALHEEIDQFCKQVAAADLVRRPYINWAVRRVTRCLQVLWPRSRTNLFGSNATGLALPTSDVDLVVSLPPVRNLEPIKEAGILEGRNGIKETCLQHAARCLTNQDWVRSDSLKTVENTAIPVIMLVADVPCDTNMSNEYSSVLDGSQEYSVNMLGEQGSPPRSDTSSSEGSNMLVCSKLNKDDCDIVQSIRLDISFKSSSHTGLQTTELVRELTQQFPAVVPLALILKKFLADRSLDHPYSGGLSSYCLHEHHLGRPINQNLGSLLMDFLYFFGNIFDPRHMRISIQGSGIYLNRERGHSIDPIHIDDPLCPANNVGRNCFRIHQCIKAFADAFAVLENELLQFSSECSMPASAFNILKKIIPSIDSDEL

SEQ ID NO: 21728 - DNA, 2691 bp, Sorghum bicolor
  misc_feature: Ceres ANNOT ID no. 8744119
  misc_feature: Down-regulated in shoot tissues in response to methyl jasmonate treatment
  misc_feature: Down-regulated in root tissues in response to methyl jasmonate treatment
  misc_feature: Encodes the peptide sequence at SEQ ID NO 21729
atggcgtggccgtggccgccgccgccgccgcggtcgaccgcgcaccgccgcctcctcttcctcgtcctcctcctctccctcctcgccgctaccccgtggcccagcgccgccgcccaggtcgctgggtaccgcgtcgtgtcggtggccagggccagggcgcgggggggccagctgtccgcgcggctggagctcgccggaggcgccggcggcaagccggagctcggccccgatgtccagaggctcagcctgaccgcgagtcttgagacagacagccggctgcacgtccgcatcaccaacgccgaccacccacgatgggaggtcccccagagcgtcatcccgcgcgaggcgccgcggcaaatcaccctggagtcgagcacgggcgccgcctcgccgcacagccgcgtcctctccgcggcgacgtccgacctgaccttcaccctgcacgcctcgccgttccgcttcaccgtgtcccggcgctccagcggcgacgtcctcttcgacacctccgcggcgctggtgttcaaggacaggtacctggagctgaccacggcgctgccggcggacgtccgggcgtcgtcgctgtacgggctgggcgagcacaccaagcgcacgttccggctgcagcgcaacgacaccttcacgctctggaacgccgacatcccggccagcaccgtggacgtcaacctctacggctcccacccgttctacctcgacgtgcgccaccccgcctccggcggcggcgccgcgcatggcgtgctcctgctcaacagcaacggcatggacgtcgagtacggcggctcctacctcacctacaaggtcatcggcggcgtgctcgacttctacttctttgccggacccgcgccgctcgacgtcgtcgaccagtacacccagctcatcggccgcccggcccccatgccgtactggtctttcgggttccaccagtgcaggtacgggtacaagaacctggctgacctggagggcgtggtggccggctacgccaaggccaggatcccgctggaggtgatgtggacggacatcgactacatggacgcgttcaaggacttcacgctggatccggtgaacttcccggccgtccccatgcggcagttcgtcgaccgccttcaccggaacggccagaagtacgtcgtcatcatagacccagggatcaacgtgaaccagacgtacgggacgttcgtccgagggatgcagcaggacgtgttcctgaagcggaacggcaccaactacctgggcaaggtgtggccggggtacgtctacttcccggacttcctcaacccgcgcgccgccgagttctgggcgcgcgagatcgcgctgttccggcggacgctcctccccgtcgacggcctgtggatcgacatgaacgaggtctccaacttcgtcgacccggcgccgctcaacgcgctggacgacccgccgtaccgcatcaacaactccggcgtgcgccgccccatcaacaacaagaccacgccggcgtccgcggtgcactacggcggcgtgcgcgagtacgacgcgcacaacctctacggcttcctggaggcgcgcgccacgcacggcgcgctgctcgccgacaccggccgccgccccttcgtcctcagccggtccacgttcgtggggtccggccggtacaccgcgcactggaccggcgacaacgccgccacctgggacgacctccggtactccatcaacaccatgctcagcttcggcctcttcggcatccccatggtcggcgctgacatctgcggcttcggcggcaacaccaccgaggagctctgcagccgctggatccagcttggcgcgttctacccgttcgcgagggaccattcggcgatcggcacgatccggcgggagctgtacctgtgggaggtggtggcgcggtcggcgaggaaggcgctgggcctgcggtaccggctgctgccgtacctgtacacgctgatgcacgaggcgcacacgacgggggcccccatcgcgcggccgctcttcttctcctaccccaaggacgcggcgacgtacgacgtggaccggcagttcctgctgggccgcggcgtgctcgtgtcgccggtgctggagccgggggccaccaccgtcgacgcctacttcccggcggggcggtggttcagcctgtacgactacacgctcgcggtcgcctcggcgacgggcaagcgcgtcacgctcccggcgcccgcggacacggtcaacgtgcacgtggccggcggcaacatcctgccgctgcagctgccggcgccgacgacgtcgcgggcgcggcggaccgcgttccacctcctggtcgcgctcggcgaggacggagccgcgtccggggagctgttcctggacgacggcgagtcgccggagatggccggttcgcgcggcaagtggagcctggtgcggttcagctgcgcggcggggcacgacggggttaccgtgaggtcgcacgtggtgcgcgacgcctacgggccgacccggaagctggccatcggcaaggtgatcttcctgggactgcactcgccggcggcgccacagagggagttctccgtgtatgtcaacggcgtgaagacggccaactcgatcggcggcgcgttagggtaccagaggaacggagcattcggcgcagctcaagtggaggggctgtcgctggccgtcggcaaggagttcgagctcaaggtcgtcatgttgtag

SEQ ID NO: 21729 - protein, 896 aa, Sorghum bicolor
  misc_feature: Ceres ANNOT ID no. 8744119
  misc_feature: Down-regulated in shoot tissues in response to methyl jasmonate treatment
  misc_feature: Down-regulated in root tissues in response to methyl jasmonate treatment
  misc_feature (58)..(895): SWISSPROT Homolog: EC 3.2.1.20 Alpha-glucosidase
  misc_feature (281)..(747): Pfam ID: Glyco_hydro_31 Pfam Description: Glycosyl hydrolases family 31
MAWPWPPPPPRSTAHRRLLFLVLLLSLLAATPWPSAAAQVAGYRVVSVARARARGGQLSARLELAGGAGGKPELGPDVQRLSLTASLETDSRLHVRITNADHPRWEVPQSVIPREAPRQITLESSTGAASPHSRVLSAATSDLTFTLHASPFRFTVSRRSSGDVLFDTSAALVFKDRYLELTTALPADVRASSLYGLGEHTKRTFRLQRNDTFTLWNADIPASTVDVNLYGSHPFYLDVRHPASGGGAAHGVLLLNSNGMDVEYGGSYLTYKVIGGVLDFYFFAGPAPLDVVDQYTQLIGRPAPMPYWSFGFHQCRYGYKNLADLEGVVAGYAKARIPLEVMWTDIDYMDAFKDFTLDPVNFPAVPMRQFVDRLHRNGQKYVVIIDPGINVNQTYGTFVRGMQQDVFLKRNGTNYLGKVWPGYVYFPDFLNPRAAEFWAREIALFRRTLLPVDGLWIDMNEVSNFVDPAPLNALDDPPYRINNSGVRRPINNKTTPASAVHYGGVREYDAHNLYGFLEARATHGALLADTGRRPFVLSRSTFVGSGRYTAHWTGDNAATWDDLRYSINTMLSFGLFGIPMVGADICGFGGNTTEELCSRWIQLGAFYPFARDHSAIGTIRRELYLWEVVARSARKALGLRYRLLPYLYTLMHEAHTTGAPIARPLFFSYPKDAATYDVDRQFLLGRGVLVSPVLEPGATTVDAYFPAGRWFSLYDYTLAVASATGKRVTLPAPADTVNVHVAGGNILPLQLPAPTTSRARRTAFHLLVALGEDGAASGELFLDDGESPEMAGSRGKWSLVRFSCAAGHDGVTVRSHVVRDAYGPTRKLAIGKVIFLGLHSPAAPQREFSVYVNGVKTANSIGGALGYQRNGAFGAAQVEGLSLAVGKEFELKVVML

SEQ ID NO: 21730 - DNA, 3084 bp, Sorghum bicolor
  misc_feature: Ceres ANNOT ID no. 8744484
  misc_feature: Up-regulated in shoot tissues in response to methyl jasmonate treatment
  misc_feature: Down-regulated in root tissues in response to methyl jasmonate treatment
  misc_feature: Encodes the peptide sequence at SEQ ID NO 21731
atgggggacgccgccgtgccggcggggaccctgcagaagagctacttcgacgtgctggggatctgctgcccctccgaggtacccctcgtcgagaagctgctgcgcccgctgcccggcgtccacaccgtcaccgtcatcgtcccctcccgcaccgtcatcgtcctccacgacgccgccgccacgtcgccagcacaaatcgtcaaggcgttgaaccaggcgaggctggaggcgtctgttcgagcctacggcagtggctccgaggagaaggtagccaacaaatggccgagtccctacgttcttttctgcggggttttcctggtcgtctcgctcttcgagcacttctggcctcccctgaaatggtttgcgctggtggcggcggcggccggcctgccgccgatcgttctgaggagctttgcagctgcccggaggctcaccctcgatgtcaacatactcatgctgattgcagtttctggggcgatagctctgaaggactactctgaggctgggttcattgttttcctgttcactacagctgaatggcttgagaccagggcaagccacaaggcgactgctgggatgtcatcactgatgagcatgacaccacagaaggctgttctagcagagactggggaagtggtttcagctcaggatgtcaaggtgaatacagtaatagctgtcaaagctggggaagtcgttccaattgatggtgtggttgtggatggacggagtgaggttgatgaaagtaccctaactggggagtccttcccagttgcgaagcagccagactcccaggtctgggccggcacgctcaacatagatggctatattgctgtcaggaccactgcaatggctgacaactccgcagtggctaaaatggcaaggctagttgaagaagcacaaaacagtaggtccaaaactcagaggctgattgatacatgtgccaagtactatacgcccgctgttgttgtcatggctgcgggggtagcagtgattcctgtggcgatcagagcacaccacctcaaacactggttccaattggccctggtccttctagtgagtgcttgcccatgtgctttagtgctgtcgacgccggttgctaccttctgtgctcttctgacggctgcgaggacagggctccttatcaaaggaggggatgtccttgaaaccttggcaaggatcaaaattgctgcttttgataaaacgggtacaatcactagaggagagttctgtgttgaggaattccaggcagttggcgaacgtatcccaatgcaacaacttctttactgggtatcaagcattgaaagcagatcaagccacccaatggcatctgtgctagttgactatgccctgtcaaagtcagtcgaaccaaaatctgataatgttactgagttccaaatctaccctggagaggggatttatggtgaaatcgacggggaaggtgtatatattgggaacaaaagaattctgtcaagggcttcatgtgaaacagttcctgacatgaaagatatgaaaggagttaccatcggatatgttgcctgcaaagggcaattgatcggagtatttaccctctcggattcctgccgaactggatcagctgaggccatcagggagctgaggtcactgggcatcaagtcagtgatgcttactggggatagttctgcagcagcttcatatgcacagaaccagcttgggaacatacttgatgaggttcaccctgaacttcttccagaggacaaagtgagaattgttgatgaactcaaggcaaaacatggccctactctgatgattggtgatggcatgaatgatgccccagctctggccaaggctgacgttggagtctcgatgggtgtatctggttccgctgttgcaatggagacgagccacataactttgatgtcgaacgacatccgcaggatcccaaaggctatccagctggcacggaggactcaccggactatcatcgtgaacatcatcttctcggtgatcaccaagcttgcaatcgttggacttgcactctctggacatccgcttatctgggcagccgtcctcgcagatgttggcacatgcatgctggtgatcatgtacagcatgttgctattgagatcaaagggcggtcggaaggcgaagaaatgttgtgcctcttcacagcatgggtcacacatggaccgtgcaagtcgacaggctgttccaaagagtcgtctgctggtaaacatggttgtcatgatcatggccatgcccacacccactgcaaagagccgagcagccagcaccctacagaaaagcacgcttgtcatgatcacggccacagccataaccactgcaaagagcccagcagccatgtggtcacggaaaagcatgtttgccatgaccatggaaacacccataaccactgcaaggaggcaggcaaccagttgctgcttgtggagggccatggttgccatgatcgtgaccatggccatagccatgaacacaccggcaagcaggattgccatggccatgagcacagccactgcaaagaacccaagactccgcgtgctgacagtgaaggtgcttgccatggccatggccatgaccatggacatgaacataggcactgcgaaggggacagccactcacatgctacaggtgagcttggctgccatgaacactctactgttgagcatgcttgcgagcatcagtgccatgctgagcagcaaactgtgcacactgcggaaacacaccactgccatgaccatgagcatggacagcacaagcatgaccatggggagattgaggagccagaaaaggactgccatgaccacagccaccactgctgccatgagcctcatgacaaggacaagactccagctgagccagttgaagaggtcacgatttcaattgctgcccttcccaaagatgaaggccaccaccacagcgaagaacacaagggggagcactgcgggaaggcgaaagactgcggtgttcctgctcccactgactgcgctgcgagcaagaactgctgcagcgtcaaaggtggagacacctgctcgagctcgcaggctgcgtgtgccaaggagaccagcccgtgctgcaggagctacgtga

SEQ ID NO: 21731 - protein, 1027 aa, Sorghum bicolor
  misc_feature: Ceres ANNOT ID no. 8744484
  misc_feature: Up-regulated in shoot tissues in response to methyl jasmonate treatment
  misc_feature: Down-regulated in root tissues in response to methyl jasmonate treatment
  misc_feature (74)..(694): SWISSPROT Homolog: EC 3.6.3.5 Zinc-exporting ATPase
  misc_feature (170)..(389): Pfam ID: E1-E2_ATPase Pfam Description: E1-E2 ATPase
  misc_feature (393)..(619): Pfam ID: Hydrolase Pfam Description: haloacid dehalogenase-like hydrolase
MGDAAVPAGTLQKSYFDVLGICCPSEVPLVEKLLRPLPGVHTVTVIVPSRTVIVLHDAAATSPAQIVKALNQARLEASVRAYGSGSEEKVANKWPSPYVLFCGVFLVVSLFEHFWPPLKWFALVAAAAGLPPIVLRSFAAARRLTLDVNILMLIAVSGAIALKDYSEAGFIVFLFTTAEWLETRASHKATAGMSSLMSMTPQKAVLAETGEVVSAQDVKVNTVIAVKAGEVVPIDGVVVDGRSEVDESTLTGESFPVAKQPDSQVWAGTLNIDGYIAVRTTAMADNSAVAKMARLVEEAQNSRSKTQRLIDTCAKYYTPAVVVMAAGVAVIPVAIRAHHLKHWFQLALVLLVSACPCALVLSTPVATFCALLTAARTGLLIKGGDVLETLARIKIAAFDKTGTITRGEFCVEEFQAVGERIPMQQLLYWVSSIESRSSHPMASVLVDYALSKSVEPKSDNVTEFQIYPGEGIYGEIDGEGVYIGNKRILSRASCETVPDMKDMKGVTIGYVACKGQLIGVFTLSDSCRTGSAEAIRELRSLGIKSVMLTGDSSAAASYAQNQLGNILDEVHPELLPEDKVRIVDELKAKHGPTLMIGDGMNDAPALAKADVGVSMGVSGSAVAMETSHITLMSNDIRRIPKAIQLARRTHRTIIVNIIFSVITKLAIVGLALSGHPLIWAAVLADVGTCMLVIMYSMLLLRSKGGRKAKKCCASSQHGSHMDRASRQAVPKSRLLVNMVVMIMAMPTPTAKSRAASTLQKSTLVMITATAITTAKSPAAMWSRKSMFAMTMETPITTARRQATSCCLWRAMVAMIVTMAIAMNTPASRIAMAMSTATAKNPRLRVLTVKVLAMAMAMTMDMNIGTAKGTATHMLQVSLAAMNTLLLSMLASISAMLSSKLCTLRKHTTAMTMSMDSTSMTMGRLRSQKRTAMTTATTAAMSLMTRTRLQLSQLKRSRFQLLPFPKMKATTTAKNTRGSTAGRRKTAVFLLPLTALRARTAAASKVETPARARRLRVPRRPARAAGAT

SEQ ID NO: 21732 - DNA, 2463 bp, Sorghum bicolor
  misc_feature: Ceres ANNOT ID no. 8744479
  misc_feature: Up-regulated in root tissues in response to salicylic acid treatment
  misc_feature: Encodes the peptide sequence at SEQ ID NO 21733
atgaggatcaagcttgcctgtttgcttctcatctttgtgcaagtgcaacgagtggtccttggaacgcatgatgtgtacattgtcaccatggaaggggatccggttgtgagctaccgaggcggcgttgatggatttccagcaactgctgtggatttggacgaggaaatggatgttaccagtgaggctgtcacatcgtacgccctccacctccgagggcaccatgataagctcctagactcgcttttagtagaaggaacttacgagaagctttatagctaccaccatcttatcaatggcttcgcagttcacatgtcgtccctgcaggctgagttcttgaggaaagccccaggagttaagcatgttgagagagacatgaaggtacagaaattgactacacacacgcctcagtttctaggattgccaactggggtgtggccaacaggaggtggacttgatagagctggtgaagatgttgtgatcggtttcgtggattctggaatttaccctgaacatccaagcttcgctgcgcacaagactgatccttatgggcctattcctcattataaagggaaatgtgagatggatccagtaacacaaagaagtttctgtaatgggaagatagttggagcccagcattttgcaaaagctgcaatggctgctggcgcgttcaatcccgatgttgaatttgcatctccattagatggtgatggtcatggaagtcacacagctgcaattgctgctggaaacaatgggattccggtgcgaatgcatggtcatgaatttggcaaagcaagtggtatggccccacgtgctagggtagctgtctacaaggttctttacaggctttttggtggttacgtagctgatgttgtggcagctattgatcaggctgttcaggatggtgtagacattctcaacctttctgttggacccaatagcccaccaacagctacaaggactactttcttgaacccttttgacgctgcacttctttctgctgtgaaagctggggtatttgttgcccaagctgcaggaaatggtggaccatttccaaaaacactggtgtctttcagcccatggataaccactgttgctgctggagttgatgaccgcagatacaagaatcatttaacactaggaaatggaaaacttatttctgggcttggagtatcacctgcaacacatgggaatatgtcattcagcctgatttctgcagctgatgctttactgggttcatcttcaaccaagtacagtgcattagactgtcagaggccagaactattgaataagaggaaagttcaggggaaaattcttttgtgtggctattcattcaattacatttctgggacagcttcaataaagaaagtgtctcagacggccaggaatctcggggcagctggctttattgttgctgtggagaatagttacccaggaacaaaatttgaccctgtaccagtcagcatccctggaattctcatcacagatgtcagcaaaacagaggatcttatagactactacaattcttccaccataagagattgggctggaagggctacagcctttaaagcaaccgcaggtattgcagatggtttggcaccaacactatacaattcagctcctcaggttgcgctgttctcttctcgaggacctgatgttaaagattttagttttcaagacgctgatgttcttaaaccagacatacttgcacctggcaatcttatatgggctgcatgggcacctaatggaacagatgaatcaaattatgctggtgaaggatttgcaatgatttctggaactagcatggctgcaccgcatattgctggcattgcagcactgataaaacagaagaacccaaaatggagcccctcagcaataaaatctgccctgatgacaacggccaatacactggacaaagggagccatcctcttagagcgcagcagtacactgcatcagaaatgatgacactctcacgggccacaccatttgattgtggtagtggcgcagttaacccaaaagctgcccttgatcctggtcttgttctagatgcaacccatgaagactacatcacatttttgtgctcgatccctgacgtcaatcagagcgaagtatcaaacatagcgggttcagcttgcaactccaactccaagggacaacgcccttttgacctcaacatcccctcaattgccatctctcagcttcgaggcacggtgacagtgaagcggaccgtcacaagcgtgtctgacgaaactgagacctacaccatgatgacaagaatgccgccagaggttgccctggaggtgacgcctccggcggtgaccgtgctccctggagcatcaagagagataactgtgaccctgacagctaggtctgttacgggcacctacagtttcggtgagattgccatgaaaggtgaccgtggtcacctcgtcagaatcccagtggtagctatgggattcaagtag

SEQ ID NO: 21733 - protein, 820 aa, Sorghum bicolor
  misc_feature: Ceres ANNOT ID no. 8744479
  misc_feature: Up-regulated in root tissues in response to salicylic acid treatment
  misc_feature (467)..(814): SWISSPROT Homolog: EC 3.4.21.25 Cucumisin
  misc_feature (140)..(667): Pfam ID: Peptidase_S8 Pfam Description: Subtilase family
  misc_feature (393)..(506): Pfam ID: PA Pfam Description: PA domain
  misc_feature (24)..(130): Pfam ID: Subtilisin_N Pfam Description: Subtilisin N-terminal Region
MRIKLACLLLIFVQVQRVVLGTHDVYIVTMEGDPVVSYRGGVDGFPATAVDLDEEMDVTSEAVTSYALHLRGHHDKLLDSLLVEGTYEKLYSYHHLINGFAVHMSSLQAEFLRKAPGVKHVERDMKVQKLTTHTPQFLGLPTGVWPTGGGLDRAGEDVVIGFVDSGIYPEHPSFAAHKTDPYGPIPHYKGKCEMDPVTQRSFCNGKIVGAQHFAKAAMAAGAFNPDVEFASPLDGDGHGSHTAAIAAGNNGIPVRMHGHEFGKASGMAPRARVAVYKVLYRLFGGYVADVVAAIDQAVQDGVDILNLSVGPNSPPTATRTTFLNPFDAALLSAVKAGVFVAQAAGNGGPFPKTLVSFSPWITTVAAGVDDRRYKNHLTLGNGKLISGLGVSPATHGNMSFSLISAADALLGSSSTKYSALDCQRPELLNKRKVQGKILLCGYSFNYISGTASIKKVSQTARNLGAAGFIVAVENSYPGTKFDPVPVSIPGILITDVSKTEDLIDYYNSSTIRDWAGRATAFKATAGIADGLAPTLYNSAPQVALFSSRGPDVKDFSFQDADVLKPDILAPGNLIWAAWAPNGTDESNYAGEGFAMISGTSMAAPHIAGIAALIKQKNPKWSPSAIKSALMTTANTLDKGSHPLRAQQYTASEMMTLSRATPFDCGSGAVNPKAALDPGLVLDATHEDYITFLCSIPDVNQSEVSNIAGSACNSNSKGQRPFDLNIPSIAISQLRGTVTVKRTVTSVSDETETYTMMTRMPPEVALEVTPPAVTVLPGASREITVTLTARSVTGTYSFGEIAMKGDRGHLVRIPVVAMGFK

SEQ ID NO: 21734 - DNA, 1203 bp, Sorghum bicolor
  misc_feature: Ceres ANNOT ID no. 8744600
  misc_feature: Up-regulated in shoot tissues in response to methyl jasmonate treatment
  misc_feature: Encodes the peptide sequence at SEQ ID NO 21735
atggggcgtgggggagcgggtgcggaggtggaggtggaggatgccggctccggctgggagagcagcaagccgacgctgctgcagcggtggtcctcgtcggtgtgggccatcagcggcagcgggcatctgctgtgggcgggcaacgaggcgtggcgggcgcacgtcgggatggccttcgtccaggtcgcctacggcggctaccacgtcctcaccaagtccgtcctcaacgtcggcatgaaccagatcgtcttctgcgtctaccgcgacctcgtcgcgctcgcgctcctcgcccccatcgccttcctgcgcgagaggatcttcgggaaccagctcctcttcctgctaggcctcagctacaccaacgcctcctacgcggcggcgttccagccggcgataccggtgttcacgttcctcttggccgcaatcgtcggcgtcgaggtggtcaacatcttcacgaaagatggggttgtcaaagttcttggcacagccgtgtgcgtctttggcgccgtcttgatggtcttctaccaaggcccgtctttgattgggatgggaggcgccactgcagccgatgcagctgccctggccggcacttggagcagcaatgcctattctcctcagtggttgaccgcaaccgccatgctccgaaatggtctggacgcatggagtctcggggtcgtctgcctcattggaaactgcttcctgatgggtgcttaccttgtcattcaggccccggtgctgataaaatatcctgcaagcttatccctaactgcttactcctattcttttgcaaccttgtttatggtggttactggagtatttgctaccaatgggctccatgagtgggcactgacaacgaccgagataatagccgtcgtatatgctggaattgttgcgtcctgtctcaactatgcaatcatgacttgggcaaataagattcttgggccctctctagtggccctctataatccactccaaccagcatgctctaccttgctttcaactattttccttggaaccccaatttatgttggaagtgttattgggggactcttcatcattgctggtctttacctggttacctgggctcggtacaatgaagctcagagagttctgactacccgttatttacaacctcttcttgtggaggatctaccaaccaccaaagcagaaggaagttccttcaggggctccatcgatccttag

SEQ ID NO: 21735 - protein, 400 aa, Sorghum bicolor
  misc_feature: Ceres ANNOT ID no. 8744600
  misc_feature: Up-regulated in shoot tissues in response to methyl jasmonate treatment
MGRGGAGAEVEVEDAGSGWESSKPTLLQRWSSSVWAISGSGHLLWAGNEAWRAHVGMAFVQVAYGGYHVLTKSVLNVGMNQIVFCVYRDLVALALLAPIAFLRERIFGNQLLFLLGLSYTNASYAAAFQPAIPVFTFLLAAIVGVEVVNIFTKDGVVKVLGTAVCVFGAVLMVFYQGPSLIGMGGATAADAAALAGTWSSNAYSPQWLTATAMLRNGLDAWSLGVVCLIGNCFLMGAYLVIQAPVLIKYPASLSLTAYSYSFATLFMVVTGVFATNGLHEWALTTTEIIAVVYAGIVASCLNYAIMTWANKILGPSLVALYNPLQPACSTLLSTIFLGTPIYVGSVIGGLFIIAGLYLVTWARYNEAQRVLTTRYLQPLLVEDLPTTKAEGSSFRGSIDP

SEQ ID NO: 21736 - DNA, 1089 bp, Sorghum bicolor
  misc_feature: Ceres ANNOT ID no. 8744602
  misc_feature: Up-regulated in root tissues in response to methyl jasmonate treatment
  misc_feature: Up-regulated in shoot tissues in response to methyl jasmonate treatment
  misc_feature: Encodes the peptide sequence at SEQ ID NO 21737
atgctgtcgtcttccacctccaccctccgcctccaccaaccaacccgtccccaccgccaccacccgccggccccggccgccgggggcgccacccacctagcctccccgcggcggtggcgcggccacgccccgggggcgtcgtccccgccggcgctccgcgcacgggcccagcgcatccgcgcgctggacgccgcccagccgttcgacttcgagtcccgcgcggcggggctgctggaggagcgtcagcgcctgaagatcgccatcgtcgggttcggcaacttcgggcagttcctggcgcgcaccttcgcgcggcaggggcacacgctgctcgcccactcccgcaccgaccactccgcgctggcgtccacgctgggggcctccttcttcaccgacccgcacgacctgtgcgagtgccacccggacgtggtgctcctcgccacctccatcctctccgcggaggccgtgctccgctcgctgcccgtccaccgtctccgccgcaacacgctcttcgtcgacgtgctctccgtcaaggagttccccaggaacctgctgctcagctcgttaccgcccgacttcgacgtcatctgcacccaccccatgttcgggccggagtcggcgcgcgacggctgggacggccttcccttcgtgttcgacaaggtgcgcgtgggcgactgcccggcccgccgcgcccgcgccgaggcgttcctcaacatcttcgagcgggaagggtgccggatggtggagatgtcgtgcgccgagcacgacgcgcacgccgccgagacccagttcctgacgcacaccgtcgggaggatgctcgccatgctggagctccgctccacgcccatcaacaccaaggggtacgagacgctgctccgcctggtcgacaacacctgcagcgacagcttcgacctctacaacgggctcttcatgtacaacaagaactccaccgagctgctcaaccgcgtcgagtgggccatggactccgtcaagaagaagctcttcgacggcctccacgacgtgctccggaagcagctcttcgaggggtcgccgcacgcccccaatgtctcctcctccaacgtccgcaagtaa

SEQ ID NO: 21737 - protein, 362 aa, Sorghum bicolor
  misc_feature: Ceres ANNOT ID no. 8744602
  misc_feature: Up-regulated in root tissues in response to methyl jasmonate treatment
  misc_feature: Up-regulated in shoot tissues in response to methyl jasmonate treatment
  misc_feature (68)..(353): SWISSPROT Homolog: EC 1.3.1.78 Arogenate dehydrogenase (NADP(+))
MLSSSTSTLRLHQPTRPHRHHPPAPAAGGATHLASPRRWRGHAPGASSPPALRARAQRIRALDAAQPFDFESRAAGLLEERQRLKIAIVGFGNFGQFLARTFARQGHTLLAHSRTDHSALASTLGASFFTDPHDLCECHPDVVLLATSILSAEAVLRSLPVHRLRRNTLFVDVLSVKEFPRNLLLSSLPPDFDVICTHPMFGPESARDGWDGLPFVFDKVRVGDCPARRARAEAFLNIFEREGCRMVEMSCAEHDAHAAETQFLTHTVGRMLAMLELRSTPINTKGYETLLRLVDNTCSDSFDLYNGLFMYNKNSTELLNRVEWAMDSVKKKLFDGLHDVLRKQLFEGSPHAPNVSSSNVRK

SEQ ID NO: 21738 - DNA, 1014 bp, Sorghum bicolor
  misc_feature: Ceres ANNOT ID no. 8744667
  misc_feature: Down-regulated in shoot tissues in response to aminocyclopropane carboxylic treatment
  misc_feature: Up-regulated in root tissues in response to salicylic acid treatment
  misc_feature: Encodes the peptide sequence at SEQ ID NO 21739
atgggcaaaattaagatcggaatcaacggtttcggaaggatcggcaggctcgtggccagggtcgcgcttcagagcgaggatgtcgagctggtcgccgtcaacgaccccttcatcaccacggactacatgacctacatgttcaagtatgacacggtgcacggccactggaagcacagtgacatcaccctcaaggactccaagacccttctcttcggtcagaagccggtcaccgtctttggcatcaggaaccctgaggagatcccgtggggcgaggctggtgctgactatgtcgtggagtccactggtgtcttcactgacaaggataaggctgcggctcacttgaagggtggtgccaagaaagttgttatctctgccccaagcaaagatgcgcccatgttcgttgttggtgtcaacgaggacaagtacacctcagatattaacattgtttccaatgctagctgcacaacaaactgcctggctccccttgccaaggtcatccatgacaactttggtatcatcgagggtctgatgacaactgttcatgccatcactgccacccagaagactgttgatggaccctcagccaaggactggagaggtggcagggctgctagctttaacatcatccccagcagcactggagctgccaaggctgttggtaaggttcttcctgatttgaatggcaagctcactggtatgtccttccgggttcccaccgtggatgtgtcagttgttgaccttactgtcagaatcgagaagggtgcctcctatgaggatatcaagaaagctattaaggctgcttctgagggcccactcaagggtatcatgggctacgtggaggaggatttggtttccacagacttcgttggtgacagcaggtcgagcatctttgatgccaaggctggtattgccctgaacgacaacttcatcaagcttgtctcgtggtacgacaacgagtggggctacagcaaccgtgttgtcgacctgatccgccacatgttcaagacccagtag

SEQ ID NO: 21739 - protein, 337 aa, Sorghum bicolor
  misc_feature: Ceres ANNOT ID no. 8744667
  misc_feature: Down-regulated in shoot tissues in response to aminocyclopropane carboxylic treatment
  misc_feature: Up-regulated in root tissues in response to salicylic acid treatment
  misc_feature (1)..(337): SWISSPROT Homolog: EC 1.2.1.12 Glyceraldehyde-3-phosphate dehydrogenase (phosphorylating)
  misc_feature (159)..(316): Pfam ID: Gp_dh_C Pfam Description: Glyceraldehyde 3-phosphate dehydrogenase, C-terminal domain
  misc_feature (4)..(154): Pfam ID: Gp_dh_N Pfam Description: Glyceraldehyde 3-phosphate dehydrogenase, NAD binding domain
MGKIKIGINGFGRIGRLVARVALQSEDVELVAVNDPFITTDYMTYMFKYDTVHGHWKHSDITLKDSKTLLFGQKPVTVFGIRNPEEIPWGEAGADYVVESTGVFTDKDKAAAHLKGGAKKVVISAPSKDAPMFVVGVNEDKYTSDINIVSNASCTTNCLAPLAKVIHDNFGIIEGLMTTVHAITATQKTVDGPSAKDWRGGRAASFNIIPSSTGAAKAVGKVLPDLNGKLTGMSFRVPTVDVSVVDLTVRIEKGASYEDIKKAIKAASEGPLKGIMGYVEEDLVSTDFVGDSRSSIFDAKAGIALNDNFIKLVSWYDNEWGYSNRVVDLIRHMFKTQ

SEQ ID NO: 21740 - DNA, 1014 bp, Sorghum bicolor
  misc_feature: Ceres ANNOT ID no. 8744666
  misc_feature: Down-regulated in shoot tissues in response to aminocyclopropane carboxylic treatment
  misc_feature: Up-regulated in root tissues in response to salicylic acid treatment
  misc_feature: Encodes the peptide sequence at SEQ ID NO 21741
atgggcaagattaagatcggaatcaacggtttcggaaggatcggcaggctcgtggccagggtcgcgcttcagagcgaggatgtcgagctggtcgccgtcaacgaccccttcatcaccacggactacatgacctacatgttcaagtatgacacggtgcacggccactggaagcacagtgacatcaccctcaaggactccaagacccttctcttcggtcagaagccggtcaccgtctttggcatcaggaaccctgaggagatcccgtggggcgaggctggtgctgactatgtcgtggagtccactggtgtcttcactgacaaggataaggctgcggctcacttgaagggtggtgccaagaaagttgttatctctgccccaagcaaagatgcgcccatgttcgttgttggtgtcaacgaggacaagtacacctcagatattaacattgtttccaatgctagctgcacaacaaactgcctggctccccttgccaaggtcatccatgacaactttggtatcatcgagggtctgatgacaactgttcatgccatcactgccacccagaagactgttgatggaccctcagccaaggactggagaggtggcagggctgctagctttaacatcatccccagcagcactggagctgccaaggctgttggtaaggttcttcctgatttgaatggcaagctcactggtatgtccttccgggttcccaccgtggatgtgtcagttgttgacctcactgtccgaatcgagaagggtgcctcctatggggatatcaagaaagctattaaggctgcttctgagggaccactcaagggtatcatgggctatgtggaggaggatttggtttccaccgacttcgttggtgacagcaggtcgagcatcttcgatgccaaggctggtattgccctgaacgacaacttcatcaagcttgtctcgtggtacgacaacgagtggggctacagcaaccgtgttgtcgacctgatccgccacatgttcaagacccagtag

SEQ ID NO: 21741 - protein, 337 aa, Sorghum bicolor
  misc_feature: Ceres ANNOT ID no. 8744666
  misc_feature: Down-regulated in shoot tissues in response to aminocyclopropane carboxylic treatment
  misc_feature: Up-regulated in root tissues in response to salicylic acid treatment
  misc_feature (1)..(337): SWISSPROT Homolog: EC 1.2.1.12 Glyceraldehyde-3-phosphate dehydrogenase (phosphorylating)
  misc_feature (159)..(316): Pfam ID: Gp_dh_C Pfam Description: Glyceraldehyde 3-phosphate dehydrogenase, C-terminal domain
  misc_feature (4)..(154): Pfam ID: Gp_dh_N Pfam Description: Glyceraldehyde 3-phosphate dehydrogenase, NAD binding domain
MGKIKIGINGFGRIGRLVARVALQSEDVELVAVNDPFITTDYMTYMFKYDTVHGHWKHSDITLKDSKTLLFGQKPVTVFGIRNPEEIPWGEAGADYVVESTGVFTDKDKAAAHLKGGAKKVVISAPSKDAPMFVVGVNEDKYTSDINIVSNASCTTNCLAPLAKVIHDNFGIIEGLMTTVHAITATQKTVDGPSAKDWRGGRAASFNIIPSSTGAAKAVGKVLPDLNGKLTGMSFRVPTVDVSVVDLTVRIEKGASYGDIKKAIKAASEGPLKGIMGYVEEDLVSTDFVGDSRSSIFDAKAGIALNDNFIKLVSWYDNEWGYSNRVVDLIRHMFKTQ

SEQ ID NO: 21742 - DNA, 1110 bp, Sorghum bicolor
  misc_feature: Ceres ANNOT ID no. 8744688
  misc_feature: Down-regulated in shoot tissues in response to salicylic acid treatment
  misc_feature: Encodes the peptide sequence at SEQ ID NO 21743
atgggcttgtcgcggcgttttctgaatctgatcgtgcaaagccacgcgccaaccattagatcgctgcgctgcatcgatctgaagcgtctgcaactcttttacccaaccccaccgtcaccaaccaaccccgccgccaataccatggagacctttgggcttcccggaccaactccgatcttccgagcctgcgattcggatgctgattgccagtggagagttgcttgctacccactttcacaacggagggtgctttgcacagaccagtgtcggcgcaacttgctctacgacgccagcacgcacgaagtggcagctattcccgagttctacaggcctaggttggattctctctcgctctttgtcccggccagcggcgaaggtgaagagggcaacaaagatgaaaaggaccgccaagagggcagtgaagacgaagaccaacaacgtggaggcggtggtggcagtctctttctgatggagaagattctccgaccggtaactggtgatttagaggtcttgttctatggcaatggcagaagaacctcgcactgcaaactcttgccacctccgccctatatccatgagccctccaagatcgggtcttacgctgtggttggcaatggcgctcatgtttgcatatcggtcaatggcagaggcacctatttcctggacacagccgggcacacatggaacaaagctggtgactggactcttcccttccatggcaaggtcgaatatgtacctgagcttgaactctggtttggcctctccgccaatgcccaacaattgattgctgctgacctctccaccacggactcccagccacagccagtttacagttggaagctgtttcagcctctagaagaatggatcgaacacaaagacgctcaacttgtgaacctgggctcaggcagattttgcattgcaaggttcttcaaacatgactttgattttgttgaacaagatgactctccccgtgattgtattgtcttgaccggtttggaggtggtcccgcgtgtcctcaatggtaaagtgaaactcgaaatgttccatcacaaatcgatgcgtcacacgactttgcctatctatggaaattccgtcgatttagtgttctga

SEQ ID NO: 21743 - protein, 369 aa, Sorghum bicolor
  misc_feature: Ceres ANNOT ID no. 8744688
  misc_feature: Down-regulated in shoot tissues in response to salicylic acid treatment
MGLSRRFLNLIVQSHAPTIRSLRCIDLKRLQLFYPTPPSPTNPAANTMETFGLPGPTPIFRACDSDADCQWRVACYPLSQRRVLCTDQCRRNLLYDASTHEVAAIPEFYRPRLDSLSLFVPASGEGEEGNKDEKDRQEGSEDEDQQRGGGGGSLFLMEKILRPVTGDLEVLFYGNGRRTSHCKLLPPPPYIHEPSKIGSYAVVGNGAHVCISVNGRGTYFLDTAGHTWNKAGDWTLPFHGKVEYVPELELWFGLSANAQQLIAADLSTTDSQPQPVYSWKLFQPLEEWIEHKDAQLVNLGSGRFCIARFFKHDFDFVEQDDSPRDCIVLTGLEVVPRVLNGKVKLEMFHHKSMRHTTLPIYGNSVDLVF

SEQ ID NO: 21744 - DNA, 1605 bp, Sorghum bicolor
  misc_feature: Ceres ANNOT ID no. 8744794
  misc_feature: Up-regulated in shoot tissues in response to methyl jasmonate treatment
  misc_feature: Encodes the peptide sequence at SEQ ID NO 21745
atggcggtggcctcaatctggcggagagcatggaagagattgagatctaggggcagcagcgaggacgacgccgacggcagaggcggtcggctgcggcctaccggtggcgagggcgacgccgacggcggaggaggttggcagcggcctaccggcggctacatcagcagttttggtacaaccaacaccgccagcaccatcaccccattcaattcacacggagaagcgcagcctcgtgatatccatgcatccatggctccgtccacggcgcccatggaagaaaacgcggaggaggagcttgatatagatgtagatcaggagctcgaggaagacagggtggagaagctcgagcatctcaagggcctggcggtgcaattccgtggcgataatcgcagtgccttggagaggtggctcttggagctggacgtcccctgggttatccacctcgcccccggaacacatgaatcttcagggagcgtcgttgccacgcacggcttccaatttcttgtccagagctggatcctggctctacacaagatccgtggatccatccttacaagccttgatggatggtccagacagaggcaggaccaagatgaaggaagaacgagcaagcaaccatctgcttctgaatttgcacagcttgtccaagcaattgtgctcaagatgctgcctttcgttgacattgctgtggcaaaaaccacccattggccgggggtagtggctcagaagctccaggtactgatagacatgcatgacgctctttccatggcctcgcaacatgtcctgtcattattgtcctgctatgtacaagaagaatgttctaacgacaagatgagagaactcttgtcagcagatctgaccaagttggatgaggccatatgggatacagctgttgagatgaggaataatatcatggcttggagctggacagacgatagcagttcatgtgacattcacaaggtctcacactccatagtaagctacaccaaggtgctgtgggccaattgcaagtcagtgaatcgcattctacatgccgcggttctccgcggtgagtttgtgtcggagaacaaaaacttgaaccatgtgaccaacctcatcacacagatggtctcttcactagagagagagccttccacaaattcatccccggggtccttcccagatgagagcctcaggggccaaggtccctccagtctttttcaaaaaaaaaatttccactacttgttgcaagagttacagacaattcagagtttgggtttcaatatggtatccttcacctacgatatcaattactacatcaatcgttatctccatgtgtcttgggaaccggtgttgaaatgcttgcaggattctgctacacctcgttgcttcactacatactcgtctcctataccaaagtttgagtcaaagtttcagaagacttactccggccaaaagctctggaaggtcccagaccctgagatgagaaggaggctgaggaaagccattgtcgataaagttactccagtgtttacacagttctgggaggatgaccagattgccacacccccaggattcactcccatggaggtagagaagatgctgggagagttattcgaaggatga

SEQ ID NO: 21745 - protein, 534 aa, Sorghum bicolor
  misc_feature: Ceres ANNOT ID no. 8744794
  misc_feature: Up-regulated in shoot tissues in response to methyl jasmonate treatment
MAVASIWRRAWKRLRSRGSSEDDADGRGGRLRPTGGEGDADGGGGWQRPTGGYISSFGTTNTASTITPFNSHGEAQPRDIHASMAPSTAPMEENAEEELDIDVDQELEEDRVEKLEHLKGLAVQFRGDNRSALERWLLELDVPWVIHLAPGTHESSGSVVATHGFQFLVQSWILALHKIRGSILTSLDGWSRQRQDQDEGRTSKQPSASEFAQLVQAIVLKMLPFVDIAVAKTTHWPGVVAQKLQVLIDMHDALSMASQHVLSLLSCYVQEECSNDKMRELLSADLTKLDEAIWDTAVEMRNNIMAWSWTDDSSSCDIHKVSHSIVSYTKVLWANCKSVNRILHAAVLRGEFVSENKNLNHVTNLITQMVSSLEREPSTNSSPGSFPDESLRGQGPSSLFQKKNFHYLLQELQTIQSLGFNMVSFTYDINYYINRYLHVSWEPVLKCLQDSATPRCFTTYSSPIPKFESKFQKTYSGQKLWKVPDPEMRRRLRKAIVDKVTPVFTQFWEDDQIATPPGFTPMEVEKMLGELFEG

SEQ ID NO: 21746 - DNA, 1815 bp, Sorghum bicolor
  misc_feature: Ceres ANNOT ID no. 8744844
  misc_feature: Down-regulated in root tissues in response to methyl jasmonate treatment
  misc_feature: Encodes the peptide sequence at SEQ ID NO 21747
atgcagccgccctcgccgcgccgccgcgccaccaccagggccctactgcgcctgctcttcctcgtcgccctctccctcgccgcgctgctcgccttcgtcacctccaccccgtcctcctccttctccaccgcgcgccgcgccctgcagctcgtgccgccgcgccgccaccgccagccgctaaccaccctccgcgccgtccggagggacgaggacgagccggacaggcccacctcgcccgtcgtcgccccgcgagcggtggggcagggccaccaccgctcgtcggacctcgacgccgtgctgctcccggactgggaggtcctcgtcctgctccgccccggcgacgacgacgacgcgccccccggcaacgccacgtgcgcgttcccggccggggccacgtccccggcgcggtcgctcgggaggatgcccgcgtccggccgccgagcctacacgtgcgccatgcccaggccggagcgccgccacagcaggcccttccgcgcgccacgcctcgtcgtcgtcgccgccactaccacgctgtcgtcgtcgtcctcggaggaagagcggtcgttgacgccggagatgatgcgttggagcggccgcctcgtgtacgactccgccgcgctcgccgccggcggcgacgtcctcgtgttcgccaagggagtcaacgcgcgccagggagtcaaccgcgacgccacggacgtccggtgcatctactaccgccgcggcattagcggcagcgccgccaccgtcgtcgcctcgctcccggcctctacctcggcgcagcaggtcttccggtgccccccgccgccaagcactgccgccatgaccatgaccgcgtccccagccgaggcgcagcagcttcgcgtcacgatcgccgtcgctggcgaggaccccatcccctcggtggcgacctacacccctcctcctcctcctcctcctcctccaccaaagaagaagctcatctgcggctgcaccatggtccgcgacgtggccaagttcctccgggagtgggtggtctaccacgcggcggtgggcgtcgaccgcttctacctctacgacaacgggagcggggatgacctggagggccaggtgcaccagctcagcgcggagggcttccacgtatccacacacgcgtggccctggcccaagacgcaggaggccgggttctcctacacagccgcggtgcaccgagattcgtgtgagtggatggcgttcatcgacgtcgatgagttcatcttctccccagactgggctgggtcgagcaagccgaccaaatccatgctccggtccgttgtcaccgccgtcaagcctaacatcgggcaggtcacgctagggtgcaaagatttcgggccctcagggcggaccaagcaccccaaggagggagtcacccaagggtacacgtgccggaggcgagccgaggagcgccacaagtcactcgttaggctcgactctgtggccccatcactgatgaactctgtccaccatttcaagcttcggcccgagttcaagtgggagcgatcgagggctgtgagggtgaaccactacaagtaccaggcttgggatgagttcaaggtcaagttccgccgccgtgtgtccacctatgtggcggactggaccgaccgggtcaaccatgggtccaaggaccgcacacccggcctagggttcgaggcggttgaaccagccgggtggccacacaagttctgcgaggtggaggacaccctgctccgggacgtgacacggaggtggtttggtgttggattcaccaataagcttgctcatcaccggccggttggagggacaactcacagcagctcatag

SEQ ID NO: 21747 - protein, 604 aa, Sorghum bicolor
  misc_feature: Ceres ANNOT ID no. 8744844
  misc_feature: Down-regulated in root tissues in response to methyl jasmonate treatment
MQPPSPRRRATTRALLRLLFLVALSLAALLAFVTSTPSSSFSTARRALQLVPPRRHRQPLTTLRAVRRDEDEPDRPTSPVVAPRAVGQGHHRSSDLDAVLLPDWEVLVLLRPGDDDDAPPGNATCAFPAGATSPARSLGRMPASGRRAYTCAMPRPERRHSRPFRAPRLVVVAATTTLSSSSSEEERSLTPEMMRWSGRLVYDSAALAAGGDVLVFAKGVNARQGVNRDATDVRCIYYRRGISGSAATVVASLPASTSAQQVFRCPPPPSTAAMTMTASPAEAQQLRVTIAVAGEDPIPSVATYTPPPPPPPPPPKKKLICGCTMVRDVAKFLREWVVYHAAVGVDRFYLYDNGSGDDLEGQVHQLSAEGFHVSTHAWPWPKTQEAGFSYTAAVHRDSCEWMAFIDVDEFIFSPDWAGSSKPTKSMLRSVVTAVKPNIGQVTLGCKDFGPSGRTKHPKEGVTQGYTCRRRAEERHKSLVRLDSVAPSLMNSVHHFKLRPEFKWERSRAVRVNHYKYQAWDEFKVKFRRRVSTYVADWTDRVNHGSKDRTPGLGFEAVEPAGWPHKFCEVEDTLLRDVTRRWFGVGFTNKLAHHRPVGGTTHSSS

SEQ ID NO: 21748 - DNA, 3468 bp, Sorghum bicolor
  misc_feature: Ceres ANNOT ID no. 8744876
  misc_feature: Up-regulated in shoot tissues in response to salicylic acid treatment
  misc_feature: Encodes the peptide sequence at SEQ ID NO 21749
atgccgtgtgcacttgaagtaatcgacacaaggttgcagaacacatcacatattcagtgcagcagatcattcgaccaaaatattggcagacgcttttcaaagggccatctaatacaaaaacctgttgctgtttgtcccgagaacagtgacacctcatcatcaatacttccgcttgggcacgattcagatcagaaacaggcaccatttttgtcagacactcaagaggtcaacaaggtaatctcgtcatcaggagctcttggtacagagtgccttgagctattatctgcacagccaagaatactgtgttgcttaggccagccgaatgaaaggaacatgcatgatcaggttgattcttctaaaccagtttccaatggaaacacacatggaggaagcaccttaagacaatctcggcaaaggaaaaacgtttgtaattcatcgacggcagtccctccctgccatatagctgcaaagtactccagacctgtcgctactactctgagtctgagatctgattctgatattttgcacaatgatgacaagctttcaaaaaggagtactagaaagagaggaaaacagtgcaagcgaacaatccgcaaaaggctgaatttggcatcaaaaaccacttttgaagagagtacttatggtgcttctcctgtggaggtagttccgaccaatttactggttgataagttctcagagaccacaccctctgctagctcgtcggttaaaaatgatggtcagtacaacaaggattatgtggaatgtggtattatgttgaatttagctacattgggaactgatgagatggatggttctggatgtgctggttcatcttctaatgtcgcaggagggagattaagctccagttgtgctccttacttgaatgatgaatcaaatatgatcgattcttcggaatttgatggatccactttcactgaacatggctttggagaagaaagcaatagctaccagaagttaacatgtgcctatgtttataaccctagtcatgcaaccacagattccatctttagtaggtggaacattgacaacagtgggaactacagtgtcgatattgattctaccatcaaagatgaaaatggacatgaccattcaaaaccaggggcctccacagggctgagcaatatgagggcggaatgccagttgatagggtcacatcttagtgctattcatgctgaagatacaaatgatcatctaggaatcagatcgtactctaaggatgttactgatagttgtagcaatactgaaagggtccagtgcagcagtcaggcatgcagcagcaaggcctctcttcaatttagttcagggaggaggaacataaaatcaagtaaaacaccaagctacattggtttgactgtgtctaacagagtgagaggttgcaataggcacaagaacaatggaaaagatagttcagcagtgtggcagaaggtagaaagaaatgaaaagatgatctctaaagcagggcatttgagcaattcacctattcatgataagggtgctcatgaagttggtaagaagggtgtacaggaagatccaacaagaattcaggcaaaatataatcagaataggaaaatgtgcaaacaggattcctcaaatgggacagttgaactggagcctaccaaagaagaagatgcattgaactcctgccatacattttctggacctgtctacaagaagcaagcaccctttctacgccagcaaagaagctcttcttcgaaacaaggttctcagtcattgaaaaactactatgctcctaggattggtatccccaaggcgccaaaggattacttgcagcaagaacaattgcctatgttggtgctagttcatgccaaggacaccagtgatagatcaacctcatattcaagttcacctgatgaagttggtctaactggagttggcagcaactacccaactgagggaaatgagggttcacaacctggtattgagatagcagcatcagtatcttgcaacttggttccagatttggccccacaagctgcttctgatgattcccacgtatcagatcctcactctttatgtcctgaaaacaagggtgtatccaccagtcggagctccaagaacctgtgcactgatccttttgctgcagaaacaaaggaagctcgatgtgtgaagttactgacagagaataattctcaagaatgctgtaagtggtattctggtgctggacacttgtcacagaagtgggttcctgttggtaagaaggaatcttgcaatggggtctatttagatgtctcagctaatggtgaggacagcaacttacctagtgaaaggacctataaactgaactcatctgaacatgttgatttgaaattccaagcagataatgcaactgagaccgattacagcaagatgaaagaggctatcagttatgtttacacagcacagcagcaagtggaagatttccaacttcgcattggtaggcctattgctgatttggaaaattttgtttactctgcttctccaattgtgcactgcagcccttgccctgctggctgtaaatcttacctgcaagaatgtgtgaaggatggtttatgtttgcatcagactccagatatcactctaagaactgtctggcagtggtacgaagagcctagctgctatggtttggatgtaaaggcacaagatctctggaggtcaaaaggcttcttgaatagtcatcgtcagtttacaacatattttgtaccatatctatctgctgttcaactcttcagtcaacctaagagaaccaatggtggaagcattgataaggagtcaattcatagggatgtgacatgtgaaacatctccagacctgaacctgcccccgatatttgcaaagctttttccaaaacaatctaatccagtaaagaaatcatctactctgcgtactgaagatgatcagcagccagcagatggggagctgatatttgaattttttgaatctgaacagccatactcgcggcaacagttatttgacaaggtaaatgagctgattgctggtgtgaaaccgtcgaaatgccaaatatctggagacccaaagaatttggaggtcagcctgcatgatctccatccagcctcttggtattgcgttgcatggtatcccatataccggatacctgatggaaaatttcaggctgcattcttgacatatcattctattgggcactggattcatcagagcagctcagcagacggggctgttgttttgccagtcataggcctgcagtcttacaatgccaaggcagagtggtggtttgagatgagcaaatccgattctgaaggtgccgagtcagcagagcatcagtccagtgaagcatcccagattctgaaggagagattgcacacgctgaatgagtctgcggcggtgatgtccagggccagcgtgctgaagaatgggcagatgagtagaaacaggcaccccgactacgagttcttcctctcccggagctga

SEQ ID NO: 21749 - protein, 1155 aa, Sorghum bicolor
  misc_feature: Ceres ANNOT ID no. 8744876
  misc_feature: Up-regulated in shoot tissues in response to salicylic acid treatment
MPCALEVIDTRLQNTSHIQCSRSFDQNIGRRFSKGHLIQKPVAVCPENSDTSSSILPLGHDSDQKQAPFLSDTQEVNKVISSSGALGTECLELLSAQPRILCCLGQPNERNMHDQVDSSKPVSNGNTHGGSTLRQSRQRKNVCNSSTAVPPCHIAAKYSRPVATTLSLRSDSDILHNDDKLSKRSTRKRGKQCKRTIRKRLNLASKTTFEESTYGASPVEVVPTNLLVDKFSETTPSASSSVKNDGQYNKDYVECGIMLNLATLGTDEMDGSGCAGSSSNVAGGRLSSSCAPYLNDESNMIDSSEFDGSTFTEHGFGEESNSYQKLTCAYVYNPSHATTDSIFSRWNIDNSGNYSVDIDSTIKDENGHDHSKPGASTGLSNMRAECQLIGSHLSAIHAEDTNDHLGIRSYSKDVTDSCSNTERVQCSSQACSSKASLQFSSGRRNIKSSKTPSYIGLTVSNRVRGCNRHKNNGKDSSAVWQKVERNEKMISKAGHLSNSPIHDKGAHEVGKKGVQEDPTRIQAKYNQNRKMCKQDSSNGTVELEPTKEEDALNSCHTFSGPVYKKQAPFLRQQRSSSSKQGSQSLKNYYAPRIGIPKAPKDYLQQEQLPMLVLVHAKDTSDRSTSYSSSPDEVGLTGVGSNYPTEGNEGSQPGIEIAASVSCNLVPDLAPQAASDDSHVSDPHSLCPENKGVSTSRSSKNLCTDPFAAETKEARCVKLLTENNSQECCKWYSGAGHLSQKWVPVGKKESCNGVYLDVSANGEDSNLPSERTYKLNSSEHVDLKFQADNATETDYSKMKEAISYVYTAQQQVEDFQLRIGRPIADLENFVYSASPIVHCSPCPAGCKSYLQECVKDGLCLHQTPDITLRTVWQWYEEPSCYGLDVKAQDLWRSKGFLNSHRQFTTYFVPYLSAVQLFSQPKRTNGGSIDKESIHRDVTCETSPDLNLPPIFAKLFPKQSNPVKKSSTLRTEDDQQPADGELIFEFFESEQPYSRQQLFDKVNELIAGVKPSKCQISGDPKNLEVSLHDLHPASWYCVAWYPIYRIPDGKFQAAFLTYHSIGHWIHQSSSADGAVVLPVIGLQSYNAKAEWWFEMSKSDSEGAESAEHQSSEASQILKERLHTLNESAAVMSRASVLKNGQMSRNRHPDYEFFLSRS

SEQ ID NO: 21750 - DNA, 3180 bp, Sorghum bicolor
  misc_feature: Ceres ANNOT ID no. 8744868
  misc_feature: Down-regulated in shoot tissues in response to aminocyclopropane carboxylic treatment
  misc_feature: Up-regulated in root tissues in response to salicylic acid treatment
  misc_feature: Up-regulated in shoot tissues in response to salicylic acid treatment
  misc_feature: Encodes the peptide sequence at SEQ ID NO 21751
atggcggcggtgctggactccttcgtcaagcgatgcacggcgtcattggaagacttcgctagccaggaggcctgtgtcgccctcggcatcggggatgacgtgaggggcctcctcgccacgctgtcgcgcatcgatgccatcatctcccatgaggagcggaggagggtccttagcgccaaagctgatgcgtgggtggtgcaggtgaaggatgccatgtatgagattgacaacatctttgatgtctgcatgattgagggcgcaaaggttcttgccgatgaccgcccacccacgcccaaggtccgatgcttctcctgcttcaagccttcgggcccccggaagttccgccatgagatcggcttcaccattagggacattgatctcaggctcagggaggtggaggaggagatgcctaggcttcctgctggatcagttcactctgatgcaaaaagggactcattcagccataatgtctgtaagaactgttctgatgccatgaagccccaagcagttgggtcgcaggtccagaaggctgtgggtggccttgtgccaaggatgcttagagagggcaagaagaaggtggatgtcttcgccattgttggtgcggtggggattggcaagactacgcttgctagggagatctacaatgatgacaggatgactgaaaatttccccatttgtgtgtgggtcgacatgtcaaaggatttatcggagttagatttcctcaaaatgatcatcaggggtactggtgccaatgttggggatacagaaaacaaggaggatctcctcatcctcctcggctctgccctttcaaaaaggttcctccttgtcctggatgacttggacagcccaagcatatgggacaatctgctcaaagatccgttgggagatggtgtcgcgagaggaagaatactgatcacaactcggaatgaggaagtggcagcaagtatgaaggcaactatccaccgtgttgacaaaatggaccctgagaatgcctgggcattattgtgcaaacaagttgatccagaatgcaatttggaagagcttgcgacattaaaggatgttgggtttaagattgcagagaaatgtgatggccatcctctagcaatcaaggctgaatgggagatggttctgaataatgattcttggttcgtgagcccggtccttccagaagtaccacaagctgtgtatgtgagttatgttgacctgccatctcacctgaaggagtgtttcctccattgctctctgtatccagaagaataccccattcagcgctttgatcttgtgcggcgttggattgctgaaggaattgtaaatcccagagacaacgaactgctcgaagaatcagctgaagagtactatgtagaattgataagcagaaacctactacagcctgatcctgaaagtgttgagcgatgctggataacacaccatcttctccgttcactagcccgccttttgattgcagatgagagtatcttaatttatggtcagcagaaattgaacacctcattgtcaaagccccggcatctcacattgtgtaacatggaaagcagcttggacattccgatttcactgaagcagcagatgagcttaaggtcattggcactcttcaaaagcccaactgtcagagcaattgatcttctcaccgagtcagcttcatgcttgcgtgtattagatttgagcaatacagcagtggaggccctcccgaaatccattggcaacttggtacatttaaggtacctcaatcttgatggaactcaggtccgagacataccttcttccattggatttctcataaacttgcagaccttgagccttcaaggttgccaaagcttacagagacttccttggtccatcagagcattgctagagcttagatgcctttgtcttgagggaacttccctaagctatgtaccaaagggtgttggtgaattgaagcatctcaatcatctagatggtctaatcatcggtcatgacaacaatgtgcctgagggttgtgacctagatgaccttaaagctttgtcagaactaaggcaccttcatgtagagagtttggatagggctacttctggtgctgctgcactcgcaaacaagccattcctaaaggatctgtacctctctgagcaagccccagtaatagaaaaccaggagagtcctgaggacaaggatgaaacagaaaaagaagaggaggaggagcaggaaggaagcaatgaccaatgcaggggagatgaatcagccaaagctagtgaaaagatatggaatgagctcacgccaccccatagcattgagaagctggtaatcaagaactacaaaggtataaaatttccgaattggataagaggtcccaagctaggagcctccttccccagccttgtgtttttggatcttgaaaactgcatgtcatgcactaaactgccttcacttggcctcctgagtcaactccagtccctgcaaatctcaaatgcggactcagtcatcaccattggttctgaatttcttgggaccactgtactttcaccagccacttcatttcccaaacttgaggttttaaagctcagaaacatgaagaaacttgaagactggtctttaactgtggaggagaaccaggtagtgtttccttgtttgaagtcactgcagatacagtggtgtcctaaactgaaagctctaccagaaggcctgaagcatgtggagctgtgtgaacttcatgtagagggtgcacatagcctcactgaaatcaaggacctgccaaaactatctgatgagctacatctcaaagataacaaggtgctccagaggatctccaacctgcccatgcttggttccctcattattgatgactgttcaaagctgaagcatgtggcaggtcttgacgcgctgcaacacctcagacttgtctttcctccatccactgagacattttatttcgaagagctaatcattttctggagcattgccttcccacggtggctggagctactgattcaaaagtgcaaaggcctgcgacggtttgagttgcagtgcggcctgtcattactcaggagctgccttgacagtggcaagaactggcatctcgtgcagcagatccctgaggtgcgcatcataagctgtgatggcaagaggtattttcggtataacaagagtcgtcgcatttacgaaactaatgcacagtcagaagagtga

SEQ ID NO: 21751 - protein, 1059 aa, Sorghum bicolor
  misc_feature: Ceres ANNOT ID no. 8744868
  misc_feature: Down-regulated in shoot tissues in response to aminocyclopropane carboxylic treatment
  misc_feature: Up-regulated in root tissues in response to salicylic acid treatment
  misc_feature: Up-regulated in shoot tissues in response to salicylic acid treatment
  misc_feature (153)..(442): Pfam ID: NB-ARC Pfam Description: NB-ARC domain
MAAVLDSFVKRCTASLEDFASQEACVALGIGDDVRGLLATLSRIDAIISHEERRRVLSAKADAWVVQVKDAMYEIDNIFDVCMIEGAKVLADDRPPTPKVRCFSCFKPSGPRKFRHEIGFTIRDIDLRLREVEEEMPRLPAGSVHSDAKRDSFSHNVCKNCSDAMKPQAVGSQVQKAVGGLVPRMLREGKKKVDVFAIVGAVGIGKTTLAREIYNDDRMTENFPICVWVDMSKDLSELDFLKMIIRGTGANVGDTENKEDLLILLGSALSKRFLLVLDDLDSPSIWDNLLKDPLGDGVARGRILITTRNEEVAASMKATIHRVDKMDPENAWALLCKQVDPECNLEELATLKDVGFKIAEKCDGHPLAIKAEWEMVLNNDSWFVSPVLPEVPQAVYVSYVDLPSHLKECFLHCSLYPEEYPIQRFDLVRRWIAEGIVNPRDNELLEESAEEYYVELISRNLLQPDPESVERCWITHHLLRSLARLLIADESILIYGQQKLNTSLSKPRHLTLCNMESSLDIPISLKQQMSLRSLALFKSPTVRAIDLLTESASCLRVLDLSNTAVEALPKSIGNLVHLRYLNLDGTQVRDIPSSIGFLINLQTLSLQGCQSLQRLPWSIRALLELRCLCLEGTSLSYVPKGVGELKHLNHLDGLIIGHDNNVPEGCDLDDLKALSELRHLHVESLDRATSGAAALANKPFLKDLYLSEQAPVIENQESPEDKDETEKEEEEEQEGSNDQCRGDESAKASEKIWNELTPPHSIEKLVIKNYKGIKFPNWIRGPKLGASFPSLVFLDLENCMSCTKLPSLGLLSQLQSLQISNADSVITIGSEFLGTTVLSPATSFPKLEVLKLRNMKKLEDWSLTVEENQVVFPCLKSLQIQWCPKLKALPEGLKHVELCELHVEGAHSLTEIKDLPKLSDELHLKDNKVLQRISNLPMLGSLIIDDCSKLKHVAGLDALQHLRLVFPPSTETFYFEELIIFWSIAFPRWLELLIQKCKGLRRFELQCGLSLLRSCLDSGKNWHLVQQIPEVRIISCDGKRYFRYNKSRRIYETNAQSEE

SEQ ID NO: 21752 - DNA, 1686 bp, Sorghum bicolor
  misc_feature: Ceres ANNOT ID no. 8744874
  misc_feature: Down-regulated in root tissues in response to aminocyclopropane carboxylic treatment
  misc_feature: Down-regulated in shoot tissues in response to salicylic acid treatment
  misc_feature: Encodes the peptide sequence at SEQ ID NO 21753
atggcggacgtgcatgaacctttggtgcgccgcaagaggaagaaggttttggtggactacttggtgcagttccgatggatccttgtgatcttcgtggtccttcctatttcatctctgatctacttcaatatctttctgggcgacatgtggtctgccatgaagtcagagaagaagcgccagaagcaacacgatgagaatgtgcagaaggttgtgaagcggctcaagcagaggaatccaaagaaggatggtcttgtttgcacagccaggaagccctggattgctgttggcatgcgcaatgtggactacaagcgtgcgaggcatttcgaggttgacctttcttccttcaggaacatccttgagattgacaaagagaggatggttgccaaggttgagccccttgtaaacatgggtcagataaccagagctacctgcccaatgaaccttgcccttgcagttgtcgctgagcttgacgacctcactgttggtgggctgatcaatggttatggaattgaggggagctctcacctatatggccttttctctgacacagttgtcgcaatggaagttgttcttgcagatggccgggtcgttagagccaccaaggataacgagtactctgacctattctatggcattccctggtcccagggaacacttgggttccttgtctctgctgagatcaagctgattcccatcaaggagtacatgaagctcacctacattccagtgaaggggagtctgaaggaaatcgcgcaggcatatgctgattctttcgcgccaagagatggtgacccagcaaaggtccctgactttgttgaaggaatggtgtacacagaaagcgagggtgtcatgatgactggtgtgtatgcttcgaaagaagaggcgaagaagaagggcaacaagatcaactgtgtggggtggtggtttaagccctggttctaccagcatgctcagacggcacttaagaggggcgagtttgtggagtacatcccaacaagagaatactaccatcgccacacccggtgcctgtactgggaggggaagctgatcctgccattcggtgaccagttctggttcaggttcctgctgggttggctcatgccaccaaaggtgtctctgctgaaggcgactcagggtgaggctatcaggaactactaccatgacaaccatgtgatccaggacatgctggtgccactgtacaaggttggagatgctcttgagtttgtgcatcgcgagatggaggtgtatcctctgtggctgtgccctcaccgcctgtacaagctgcccgtgaagacgatggtgtaccctgagcctgggttcgagcaccagcacaggcagggcgacacaagctacgcacagatgttcacagatgtgggcgtgtactacgcccctggtgcagtcctaaggggagaggagttcaacggcgcggaggcggtgcacaggctggagcagtggctgatcgagaaccacagctaccagccacagtacgcggtgtctgagctgaacgagaaggacttctggcgcatgtttgacgcgtcccactacgagcactgccgccacaaatacggggcggtgggcacgttcatgagcgtgtactacaagtcgaagaaggggcgcaagacggagaaggaggtgcaggaggcggaggcggccatcctggagccggcctacgcggacgaggcctaa

SEQ ID NO: 21753 - protein, 561 aa, Sorghum bicolor
  misc_feature: Ceres ANNOT ID no. 8744874
  misc_feature: Down-regulated in root tissues in response to aminocyclopropane carboxylic treatment
  misc_feature: Down-regulated in shoot tissues in response to salicylic acid treatment
  misc_feature (55)..(200): Pfam ID: FAD_binding_4 Pfam Description: FAD binding domain
MADVHEPLVRRKRKKVLVDYLVQFRWILVIFVVLPISSLIYFNIFLGDMWSAMKSEKKRQKQHDENVQKVVKRLKQRNPKKDGLVCTARKPWIAVGMRNVDYKRARHFEVDLSSFRNILEIDKERMVAKVEPLVNMGQITRATCPMNLALAVVAELDDLTVGGLINGYGIEGSSHLYGLFSDTVVAMEVVLADGRVVRATKDNEYSDLFYGIPWSQGTLGFLVSAEIKLIPIKEYMKLTYIPVKGSLKEIAQAYADSFAPRDGDPAKVPDFVEGMVYTESEGVMMTGVYASKEEAKKKGNKINCVGWWFKPWFYQHAQTALKRGEFVEYIPTREYYHRHTRCLYWEGKLILPFGDQFWFRFLLGWLMPPKVSLLKATQGEAIRNYYHDNHVIQDMLVPLYKVGDALEFVHREMEVYPLWLCPHRLYKLPVKTMVYPEPGFEHQHRQGDTSYAQMFTDVGVYYAPGAVLRGEEFNGAEAVHRLEQWLIENHSYQPQYAVSELNEKDFWRMFDASHYEHCRHKYGAVGTFMSVYYKSKKGRKTEKEVQEAEAAILEPAYADEA

SEQ ID NO: 21754 - DNA, 2334 bp, Sorghum bicolor
  misc_feature: Ceres ANNOT ID no. 8744888
  misc_feature: Up-regulated in shoot tissues in response to methyl jasmonate treatment
  misc_feature: Up-regulated in root tissues in response to methyl jasmonate treatment
  misc_feature: Encodes the peptide sequence at SEQ ID NO 21755
atggcggtgcccttcctgctgctgggcctgggattcgtccttggcctcctctccctggcgatcgcggagggtctggcgctcctctgggtcatccgcagcctcacgcgccgcccatcggactcggaggccacgctgccgtcgccaccactccccgtccacccgactctgccgcggtctgtgtctcgccacggcctcaaccgacagggcttcttgtggatgctggagcaacaaaagacgccctccggccccaaagacagcatcaatcgcccgtccaatggcggtagcccggggatcagagacaagaagctcatcatcgaggttttccctgtaaaaatgtcggccacacttgaaggacactcgctcaccttgtctggacctgcagatgatgcctcgcagctaaccattgacctgctcagttgcacagttgttgctgtttctgcatccaatctgccctcacgtaaatgggccaagaggtatccgataaaactggaaagcaaggaatctgatatttgcagggggagcaaggtatgctatgtttatgcagacacctcttgggaaaaggaatcatggtgtaaagcactccgtcttgcttctactacggacaaggacaaactcaaattccatgacatgctgactggagagttccgcagttacatagcctctttgaaagctggatacccttgctttctgggaccctcaacactctccagtcaggaacatgtgcttgtggacaacactgtgaagactgacggatcttcaaaactcagaggttttctgaaacgtttggcaaagaaggcatctgtgaaggcttctcaggagagcaaaacaggtatggtgccatctaaacaagatataaaagaacccagtacgcctagctcctctatgagtttcaacagccagctacctgattcccccaatgcaaaggtggatgaaaagtttgctgatgatggtacgcgttgttggaacctcctaatctctcggttgttttttgatgctaaaatgaatgatgacataagcaaggccatcaaagcacgtattcagcgaacattgtcaaacaccagaactccagcctacattggtgaaattacgcttaccgacctcaattttggcaagcttccaccatatctgcacagaatgagagtcctcccaccggatttgaacgaatcatgggcttttgaagttgactttgagtattctagtggaatattactgcatatcgaaacaagacttgaggttcaagcgccagagttggaaaaggacatactgaagaccaatactaaagacgattctaatggggatgtgagttcagatttccttgatagtattgagcaatatggtaaccaattcaggccttcagaagcttcagattctgcagcagaggttaatgatgaagcagataccttacggaagtcaaagagcactggatgggcatcaaggtggaaaagtatcgtgaattcaatagcggaccaggtttcacaggtgccattgtcattgacgattaaaatgtcatctcttcgtggaacattgcggatacatctaaaacctcctccgagtgatcgagtttggtatggatttacatccatgccagagatagagtgggagttggaatcatcggttggggataggaagatcagcaacagctacatcgcctcacttatcggcaacaggatcaaggcttcggttcgtcagagtttggtgatgcccaactgtgaaagttttcctatttcctggatgatatcagacacggatgactgggtgccccgcagaatcgcaccttttatatggctgaaccgtgagcccactgagagtagcacaaggcgtgctgcagacacaactagagtgatgccaagggaagctttcgcatccaaggccattgcaaagaacaagtcaagtccgttgccgccttcaagaagaatcaccaatggatcgtggaataagacaaacataggttttgatgggccagagcaagcagaagcatcaacgagctggcaatcttggatggtttcagcaagtggagctcctctgcagtcaaatgatgatgcaacaagggaacagctgaggatgccactgctgagcagcagcggagatgagagagcaggccttgtggaggagcagacatcaccttctgctggtgaggagggagatgcgaagaagaggaaacgcggtgttcggcgtgcacgggtgatggatctggggaggaggatggggggcaagctggaagagaagggcaaacatttcatcggaaagatgcgggagaatgcaaggaacaaccgcctgctattgccggacttggagcaggccagcacccctcctgctcctgctcctagttattag

SEQ ID NO: 21755 - protein, 777 aa, Sorghum bicolor
  misc_feature: Ceres ANNOT ID no. 8744888
  misc_feature: Up-regulated in shoot tissues in response to methyl jasmonate treatment
  misc_feature: Up-regulated in root tissues in response to methyl jasmonate treatment
MAVPFLLLGLGFVLGLLSLAIAEGLALLWVIRSLTRRPSDSEATLPSPPLPVHPTLPRSVSRHGLNRQGFLWMLEQQKTPSGPKDSINRPSNGGSPGIRDKKLIIEVFPVKMSATLEGHSLTLSGPADDASQLTIDLLSCTVVAVSASNLPSRKWAKRYPIKLESKESDICRGSKVCYVYADTSWEKESWCKALRLASTTDKDKLKFHDMLTGEFRSYIASLKAGYPCFLGPSTLSSQEHVLVDNTVKTDGSSKLRGFLKRLAKKASVKASQESKTGMVPSKQDIKEPSTPSSSMSFNSQLPDSPNAKVDEKFADDGTRCWNLLISRLFFDAKMNDDISKAIKARIQRTLSNTRTPAYIGEITLTDLNFGKLPPYLHRMRVLPPDLNESWAFEVDFEYSSGILLHIETRLEVQAPELEKDILKTNTKDDSNGDVSSDFLDSIEQYGNQFRPSEASDSAAEVNDEADTLRKSKSTGWASRWKSIVNSIADQVSQVPLSLTIKMSSLRGTLRIHLKPPPSDRVWYGFTSMPEIEWELESSVGDRKISNSYIASLIGNRIKASVRQSLVMPNCESFPISWMISDTDDWVPRRIAPFIWLNREPTESSTRRAADTTRVMPREAFASKAIAKNKSSPLPPSRRITNGSWNKTNIGFDGPEQAEASTSWQSWMVSASGAPLQSNDDATREQLRMPLLSSSGDERAGLVEEQTSPSAGEEGDAKKRKRGVRRARVMDLGRRMGGKLEEKGKHFIGKMRENARNNRLLLPDLEQASTPPAPAPSY

SEQ ID NO: 21756 - DNA, 774 bp, Sorghum bicolor
  misc_feature: Ceres ANNOT ID no. 8748392
  misc_feature: Down-regulated in shoot tissues in response to aminocyclopropane carboxylic treatment
  misc_feature: Down-regulated in shoot tissues in response to methyl jasmonate treatment
  misc_feature: Down-regulated in root tissues in response to methyl jasmonate treatment
  misc_feature: Down-regulated in root tissues in response to aminocyclopropane carboxylic treatment
  misc_feature: Up-regulated in root tissues in response to salicylic acid treatment
  misc_feature: Encodes the peptide sequence at SEQ ID NO 21757
atgcccgcacccccacccccaccgcccgcatcgctgacccccgccggcggcggacggcagtggtggaagcaccgcctcagtcccactgtcgcacgtgaccgctgctacactcgctccttccgctccgcggggctccgtccggcggccattccgctccccgatggcgccgtcgtacacctctggctcccgccacctgccgccgaccccgccaggcccctacaccctgtcctgctcctccacggcttcggcgcacaagccacctggcagtgggcgcccttcctccgcccgctcctcgccgccggtctggccccctatgtcccggacctcgtcttcttcggcgcctcgtcctccgccgctgcagaccgctccccggtctaccaggctgcctgcgtcgccgccgctatggctgcgctccctggcgccccgcagcggtacgccgtcgtcggggtcagttacggcggcttcgtagcataccacctcgcccacgcgttcccggcagcggtggagcggcttgtactcgtcgcggccggtgtttgcctcgaggaggccgacctggccgcggggctcttcgccgttgaggatatcgccgaggctgcaagtctgttgctgccccagcggccggaggatctccggaggttggtggggcttaccttctgccgccctccgcggttcatgccgtcctgcttcatcagggattacatcagggtaggtaaatgcagggacttgccaactaatttcacctgcaatttcttggccgagatgtttcgtggttga

SEQ ID NO: 21757 - protein, 257 aa, Sorghum bicolor
  misc_feature: Ceres ANNOT ID no. 8748392
  misc_feature: Down-regulated in shoot tissues in response to aminocyclopropane carboxylic treatment
  misc_feature: Down-regulated in shoot tissues in response to methyl jasmonate treatment
  misc_feature: Down-regulated in root tissues in response to methyl jasmonate treatment
  misc_feature: Down-regulated in root tissues in response to aminocyclopropane carboxylic treatment
  misc_feature: Up-regulated in root tissues in response to salicylic acid treatment
MPAPPPPPPASLTPAGGGRQWWKHRLSPTVARDRCYTRSFRSAGLRPAAIPLPDGAVVHLWLPPPAADPARPLHPVLLLHGFGAQATWQWAPFLRPLLAAGLAPYVPDLVFFGASSSAAADRSPVYQAACVAAAMAALPGAPQRYAVVGVSYGGFVAYHLAHAFPAAVERLVLVAAGVCLEEADLAAGLFAVEDIAEAASLLLPQRPEDLRRLVGLTFCRPPRFMPSCFIRDYIRVGKCRDLPTNFTCNFLAEMFRG

SEQ ID NO: 21758 - DNA, 2607 bp, Sorghum bicolor
  misc_feature: Ceres ANNOT ID no. 8749070
  misc_feature: Down-regulated in root tissues in response to aminocyclopropane carboxylic treatment
  misc_feature: Encodes the peptide sequence at SEQ ID NO 21759
atggaggcctcctcctcctcctacgcttccgcccctgcagcgctcctcccgctgctggctgccccgccgcgcttcctccacctccctctccgccgtccctctgctcgccgcaacggcttcgcgatttggggtgggggtggccttttgctccagccgccgctgctgggccccggttcccgcgcccgctgtaggacaacctgctgcgcgtcgagccccgagcaggcggaagtgctgctgggcggggcctcgctcgttagcttggcggcggtcgctcttctcaccactctgcagctgatatggttgcggtggcgcagtgcgaggcaaggggatttcccggagattgtacatgaacatggcaaaattattgtaaataagacccttggtgcatcaaaagcaatgtatgacagtaattgggcaacacagctaactcaggatagtcactggctttcagagccttttgtttctggaagagtaactgttgatgaaatgcatggcaaggctggtaactttccttgtgcaaactctgtacataaagaaacacaggcttattctataattacaccatggatatctatggatacaccgttatatatttctagacctgaagaagttagttgctcaacttcaactgcaaatagttccatcaataaggatacaagtctttctgtgatgccacactctgtatcacaagggcaagataaatccaagtgtttatctaacagaacaggccgggtagctgggcttccatatcagtttttatccctttcaggacaaaagaaagaggcacaaaatagtcaaggtcataatgataagcaaatggataccaataccaaggatgctaatttagttggatgccctcagagtgatcaagaggaacatcttgattttacatccctttcgtcctttgaaagagtagaagaagatcatcttaattttgttccccaggccagctactgcaatttacttgaacctggcaaagtgattgaattcaccaactctaatgcaaggagctcttatttgccagcaggacgctttgctccagttgcatgcttaagggaagttcgagtgagtaaacaagtgaaagctgtgaagggccatgatggtggctggaacatttctaacatactaaacaaggagaatctggataacttcgctccagtaaagagagggggattgaagggcacaaaggagacgttagattacttgaggatatacaatagttttttaattgatggaaggttgaaggactgcatggatttgttagaaagcatggaacaaaatggactgcttgatatgaagaagatacaccatgccagctttttcagaatgtgtaagaagcaaagagctgtcttggaagctcttcgcttttgcagattgattggcaaccccaaaataagtaccttcaatatgcttttgtcggtgtgtgctagttcactagattttgacggagcgctccaagttatggagctcctaaaggaagctggactaaaacctgattgtaaactttacacaacgctgatatcaacttgcgcaaagtgtggaaaagttgatgccatgtttgaggtatttcatgagatggttggtgctggtatagagccaaatgttaacacgtacagtgcattaattgatggttgtgctagagctgggcaagtggctaaagcatttggtgcttatgggattatgagttcaaagaaggtgaagccagatcgagttgtcttcaatgctttgatcagtgcttgtggtgaatctggagctgtggctcgggcatttgatgttttatcagaaatgacagcagaatcctcagaatctaaaggatccaaaccaatcattcctgatcatgttactgttggagcgctgatgaaaacatgtattcaggcgtgccaggctgatagagctcgtgaggtgtacaaaatgcttcaggagtataatataaagggtaccccagaagtttacacaatcgcattaagaagctgtagcttgactggcgatttagggtttgcactgaagatatatgaagatatgaacaagattggagtaaaagctgatgaggtgctatttgttgctgataaccataaaatgtttttgagtgctctagttgatgtagctggccatgctaggagggcggatgctgcctttgaaataatgaaagatgcaagagcaaaaggtttactcgttggaacaattgcatacagttcgttaatgggagcttgctgtaatgcggaggactggaagaaggcactgcagctatacgaggagatcaagtctattaaattgaccccatcagtttcaatgatgaatgctttgatcacctctctgtgcaatgtctggtctggtagcagtgagatagacaagactaccaacatcctcaagaggaagaccatccgtgggcttcaggggaagattaagctccataggggtggcggcagtctgagtgtcgatgagaccagtgttggccaggtaaacacaaatggatctcagattcatattggtaaggccagggggcagcttggccctaggctgcttgttggaattgaaatgcaatggcttagtccttacaatactctgaccttgcttggcaaagggcctctacttttctacctgctctag

SEQ ID NO: 21759 - protein, 868 aa, Sorghum bicolor
  misc_feature: Ceres ANNOT ID no. 8749070
  misc_feature: Down-regulated in root tissues in response to aminocyclopropane carboxylic treatment
  misc_feature (501)..(535): Pfam ID: PPR Pfam Description: PPR repeat
  misc_feature (536)..(570): Pfam ID: PPR Pfam Description: PPR repeat
  misc_feature (728)..(762): Pfam ID: PPR Pfam Description: PPR repeat
  misc_feature (466)..(500): Pfam ID: PPR Pfam Description: PPR repeat
MEASSSSYASAPAALLPLLAAPPRFLHLPLRRPSARRNGFAIWGGGGLLLQPPLLGPGSRARCRTTCCASSPEQAEVLLGGASLVSLAAVALLTTLQLIWLRWRSARQGDFPEIVHEHGKIIVNKTLGASKAMYDSNWATQLTQDSHWLSEPFVSGRVTVDEMHGKAGNFPCANSVHKETQAYSIITPWISMDTPLYISRPEEVSCSTSTANSSINKDTSLSVMPHSVSQGQDKSKCLSNRTGRVAGLPYQFLSLSGQKKEAQNSQGHNDKQMDTNTKDANLVGCPQSDQEEHLDFTSLSSFERVEEDHLNFVPQASYCNLLEPGKVIEFTNSNARSSYLPAGRFAPVACLREVRVSKQVKAVKGHDGGWNISNILNKENLDNFAPVKRGGLKGTKETLDYLRIYNSFLIDGRLKDCMDLLESMEQNGLLDMKKIHHASFFRMCKKQRAVLEALRFCRLIGNPKISTFNMLLSVCASSLDFDGALQVMELLKEAGLKPDCKLYTTLISTCAKCGKVDAMFEVFHEMVGAGIEPNVNTYSALIDGCARAGQVAKAFGAYGIMSSKKVKPDRVVFNALISACGESGAVARAFDVLSEMTAESSESKGSKPIIPDHVTVGALMKTCIQACQADRAREVYKMLQEYNIKGTPEVYTIALRSCSLTGDLGFALKIYEDMNKIGVKADEVLFVADNHKMFLSALVDVAGHARRADAAFEIMKDARAKGLLVGTIAYSSLMGACCNAEDWKKALQLYEEIKSIKLTPSVSMMNALITSLCNVWSGSSEIDKTTNILKRKTIRGLQGKIKLHRGGGSLSVDETSVGQVNTNGSQIHIGKARGQLGPRLLVGIEMQWLSPYNTLTLLGKGPLLFYLL

SEQ ID NO: 21760 - DNA, 1308 bp, Sorghum bicolor
  misc_feature: Ceres ANNOT ID no. 8750694
  misc_feature: Up-regulated in root tissues in response to salicylic acid treatment
  misc_feature: Up-regulated in shoot tissues in response to salicylic acid treatment
  misc_feature: Encodes the peptide sequence at SEQ ID NO 21761
atggctgcctccactgtgtcctcctgggttccaccttcttttcccgagtccgccgccgccgcctcaggcttggtcctcctcgacaggcggtgctacatcgccgacctccccaacaacaccaccgccgagagcaccacgagcagcggctttcctatcaaggtgaccttccgcgccgcccgcccgccacttgtctctcacttctgtgtccactcccctggcctggacttccgcagcatagggcccaaggttatcgccaccgacgcagatctcgtcctcctctacgttcccgtcaaccccaacagcaccatcagaggattggactgggactacttcgtctacaacccgcgcgcccagtggctagatctgctaccgaaccctgaccccaagtgtctcgacgacaaggcaactgcgctcattagccgcgacgacggcgcttggtatgtcgtcgctgctctcggtgttagggcccccctgtacgatggcggcgtgctcattaggtgggagttcgacctccacctgtacagatcctcatcagtttccaaaagaaggtggatctccaagcggttgtcagtgaatgagttcgagagggacaagcttatccctttacctctagcagtcgacaggctgtaccacgagacggataagaccatcaccattggcgacctctggcgtggcatcttcttctgcgacgtgctcaagcaatgcccactgctccaggatgtcccgctgccggtgccggcaaggggtaactggggtcgcatcctcacaaattttgacgccaactgtttgcgggacgtaactatcagccgaaacaaagactcgatcaagtatgttgagttggaattcttgtcacgagaagagctgaatgccacccctgtttcctacactgactgggtgcgcaataactcaaggaaataccaggtcatccgtgatggctggaaagccacaacatggaacatggcaataccagttggttcgccggagggctggcaccgtgactgtgtagttgacgttaaagacgtcaacatggaggctagtgacccatgtctttctgatctcatggctatgctgagcagcaagaccacacgaacattgaaggaacttcctgtggcataccccatcctaagcatggatgatgatgttgtttacttgctttctcgaaccagacccagggagatggacaagttggcactgatgtttgctattgatttgaggaaggcaacattgcgaggattggctgagcttgatgtccagaagttcattttcttatgtaacttctgcacaagtgagatctgcaggggtacctga

SEQ ID NO: 21761 - protein, 435 aa, Sorghum bicolor
  misc_feature: Ceres ANNOT ID no. 8750694
  misc_feature: Up-regulated in root tissues in response to salicylic acid treatment
  misc_feature: Up-regulated in shoot tissues in response to salicylic acid treatment
MAASTVSSWVPPSFPESAAAASGLVLLDRRCYIADLPNNTTAESTTSSGFPIKVTFRAARPPLVSHFCVHSPGLDFRSIGPKVIATDADLVLLYVPVNPNSTIRGLDWDYFVYNPRAQWLDLLPNPDPKCLDDKATALISRDDGAWYVVAALGVRAPLYDGGVLIRWEFDLHLYRSSSVSKRRWISKRLSVNEFERDKLIPLPLAVDRLYHETDKTITIGDLWRGIFFCDVLKQCPLLQDVPLPVPARGNWGRILTNFDANCLRDVTISRNKDSIKYVELEFLSREELNATPVSYTDWVRNNSRKYQVIRDGWKATTWNMAIPVGSPEGWHRDCVVDVKDVNMEASDPCLSDLMAMLSSKTTRTLKELPVAYPILSMDDDVVYLLSRTRPREMDKLALMFAIDLRKATLRGLAELDVQKFIFLCNFCTSEICRGT

SEQ ID NO: 21762 - DNA, 1095 bp, Sorghum bicolor
  misc_feature: Ceres ANNOT ID no. 8752222
  misc_feature: Up-regulated in root tissues in response to salicylic acid treatment
  misc_feature: Encodes the peptide sequence at SEQ ID NO 21763
atggcttcttccgggaccacagcccctggcattccgccctccacaagcgccccgcccggcgccggcgcggttgtgacgacctccgccggcgccctgatcactgccaccacgccgccgccggctgcgtcctccacaccgccagccccaatgctggtcatcccttccgatgcgcttatggccttcaccagcgccatccagggcctccagaaccagatggccctcatgagcttccagatgggcgatctggtcacgcgtgtgtcggccctggacggtcgggatctgcctacagccgcgcagttcccacaactgctgatgtcaagcgcgggttatcttccctcgctgcaggcaccgtccttaccgctgggcgtgcatccatctgcctcggttcccatccagcagccatggatgctggtgcacacgatggcaagcaccccggcggccacgacaacggttgctccagcaccctccaccagcgctgttgtcctccccggtgtatcaaccatccagcatccattcaccgatgggatcttctataggggtgccagcttccagcaggtccgagatgagggcgacatgctgcagcagaccgagcagccgatggcgacggagctgacagggaagatgcttcgctgccaggtgtcggcgacagtgcagctgcaagctgctgtgcgtggcctccttgcacgtcggcgggtgcagaagatgcgcgatctgccgctgattcagccctgcacctatttgcagctccaccatgtggaggactgcgatctcatctgctgcgtcggggattttcagaatgtggttccgcccacgggcagcgtgcatgttgtttttcccgcgggtggtggactcaaagtcttcggcgtcggcagttggaagccctatgctcttccatgtgcggtgcaggccagcagccgtccagcaaggagaaggcatggtgtcatcggtgggagcgcactgcctagcgccgccagattccgccaccgaccaccgcgagggcgccttcgctggtccctgttgcgaccacttcctggaggccacacacaagcacgtatttcatccagatggtctccatgggatccaggtggggtgtag

SEQ ID NO: 21763 - protein, 364 aa, Sorghum bicolor
  misc_feature: Ceres ANNOT ID no. 8752222
  misc_feature: Up-regulated in root tissues in response to salicylic acid treatment
MASSGTTAPGIPPSTSAPPGAGAVVTTSAGALITATTPPPAASSTPPAPMLVIPSDALMAFTSAIQGLQNQMALMSFQMGDLVTRVSALDGRDLPTAAQFPQLLMSSAGYLPSLQAPSLPLGVHPSASVPIQQPWMLVHTMASTPAATTTVAPAPSTSAVVLPGVSTIQHPFTDGIFYRGASFQQVRDEGDMLQQTEQPMATELTGKMLRCQVSATVQLQAAVRGLLARRRVQKMRDLPLIQPCTYLQLHHVEDCDLICCVGDFQNVVPPTGSVHVVFPAGGGLKVFGVGSWKPYALPCAVQASSRPARRRHGVIGGSALPSAARFRHRPPRGRLRWSLLRPLPGGHTQARISSRWSPWDPGGV

SEQ ID NO: 21764 - DNA, 3285 bp, Sorghum bicolor
  misc_feature: Ceres ANNOT ID no. 8752518
  misc_feature: Down-regulated in shoot tissues in response to methyl jasmonate treatment
  misc_feature: Down-regulated in shoot tissues in response to salicylic acid treatment
  misc_feature: Encodes the peptide sequence at SEQ ID NO 21765
atgagtctatcgcttaaaagaaaagatctcatgatagtcaatatgggtcctcaacacccatcaatgcatggtgttcttcgactgattgttactctcgatggtgaagatgttattgattgcgaacccatattagggtatttacacagaggaatggaaaaaattgcggaaaacagaagtattatacaatacttgccttatgtaacacgatgggattatttagctactatgtttacagaagcaataacggtaaatgcaccagaattcttagagaatattcaaataccccaaagagccagctatattagagtaattatgttagaattgagccgtatagcttctcatttgttatggcttggaccttttatggcggatctcggggcacagactccttttttctacatttttagagagagagaattgatatatgatctatttgaagctgctacaggtatgcgaatgatgcataattactttcgcatcggaggggtagcagccgatctcccttatggatggatggataaatgtttagatttctgtgattattttttacaaggagttgttgaatatcaacaacttattacacggaatcccatttttttagaacgagttgaaggagtcggttttattagcggagaagaagctgtaaattggggcttatcgggaccaatgttacgagcttctggaatacaatgggatcttcgtaaaatcgatccttatgagtcttacaatcaattcgattggaaagtccaatggcaaaaagaaggagattcgttagctcgctatttagtacgagtcggtgaaatgagggaatccataaaaataattcaacaggctgtagagaaaattcctggaggaccttatgagaatttagaagcccgacgctttaagaaagcaaagaatcccgaatggaatgattttgaatatcgatttcttggtaaaaaaccgtcgcccaattttgaattatcaaagcaagagctttatgtaagagtagaagctccaaaaggcgaattaggaatttatctggtaggagatgatagtcttttcccctggagatggaaaattcgtccaccgggttttattaatttgcaaattcttcctcagctagttaaaaaaatgaaattggctgatatcatgacaatattagatagggtagaggtagaaactatcaattctttttcgaaatcggaattattaaaagaaatctacggacttatatggattctacccattttggccctcctactgggaatcacaatagaagtactcgtaattgtgtggttagaaagagaaatatccgcatcgatacaacaacgtattggtcctgaatatgctggccccctgggactgcttcaagctatagcagatggaactaaactacttttaaaagaggatatcctcccatcccgaggagagattcctttatttagcattggtccctctatagcagtcatatccgttttattaagttttttagttatccctttgggatatcgttttgttttagctgatcttagtattggtgtttttttatggattgcgatttcaagtattgctcctattggtcttctcatggcaggatatagctcaaataataaatattctttttcaggcggtctacgagcggctgctcaatctattagttatgaaataccattaactttttgtgtactagcaatatctctacttgatatagttgaagcacagtcaaaatatggtttttttgggtggaatctttggcgtcagcctataggttttctagtttttctaatttcttctttagcagaatgtgaaagattaccctttgatttaccagaagcagaagaagaattagtagcaggttatcaaaccgaatattctggtattaaatatggtttattttatcttgtttcttacctaaatttattagtttcctccttatttgtaactgttctatacttaggcgggtggaatttctctattccctatatatccttttttggatttttccaaatgaataaaataattggaattttggaaatggtaataggtatctttattacattaactaaagcttatttatttctcttcatttctatcacaataagatggactttacccaggatgagaatggatcagttattaaatcttggatggaaatttcttttacctatttctctgggcaatctcttattaacaacttcttcccaactaaatatgttccctatgctaactgggttcattagttatggtcaacaaacaatacgcgccgcaagatatattggtcaaggtttaataattaccctatcccacacaaatcgtttacctataacgattcactacccttatgaaaaatcaattacatcggagcgtttccgggggcgaatacactttgaatttgataaatgcattgcttgtgaagtatgtgttcgcgtatgcccgatagatctaccccttgtggattggaaatttgaaaaggatattaaaagaaaacaattgcttaattatagtattgatttcggagtttgtatattttgtggtaactgtgttgaatactgtcccacaaattgtttatcaatgactgaagaatatgaactttctacttatgatcgtcatgaattgaattacaatcaaattgctttgagtcggttaccaatctccataatgggagattacacaattcaaacaattaggaattcgcctcaaagtaaaatagacgaagaaaaatcttggaattcaagaacgattaggattactagaaatttcttcttatccataatggatttacctggaccaatacatgagattcttgtgctatttgggggatttgttcttctactaggaggtctaggagtagtattacttaccaacccaatttattctgccttttcgctgggattagttcttgtttgtatatccttattctattttttattaaattcctactttgtagctgtcgcacaacttcttatttatgtgggagccataaatgtcttgatcatatttgctgtaatgtttgtaaacggctcagagtggtctaaagataagaattattggacgattggagatgggtttactttactcctttgtataactattcctttttcactaatgactactatcccagatacgtcgtggtatggaattctttggactacaagatcaaaccaaatagtagaacagggtctcataaataacgttcaacaaattgggattcatttagcaaccgatttttatcttccgtttgaactcatttccctaattcttctagtttctttaataggtgcaattactatggctcgacaataa

SEQ ID NO: 21765 - protein, 1094 aa, Sorghum bicolor
  misc_feature: Ceres ANNOT ID no. 8752518
  misc_feature: Down-regulated in shoot tissues in response to methyl jasmonate treatment
  misc_feature: Down-regulated in shoot tissues in response to salicylic acid treatment
  misc_feature (4)..(385): SWISSPROT Homolog: EC 1.6.99.5 NADH dehydrogenase (quinone)
  misc_feature (421)..(719): SWISSPROT Homolog: EC 1.6.5.3 NADH dehydrogenase (ubiquinone)
  misc_feature (124)..(383): Pfam ID: Complex1_49kDa Pfam Description: Respiratory-chain NADH dehydrogenase, 49 Kd subunit
  misc_feature (405)..(730): Pfam ID: NADHdh Pfam Description: NADH dehydrogenase
  misc_feature (936)..(1092): Pfam ID: Oxidored_q3 Pfam Description: NADH-ubiquinone/plastoquinone oxidoreductase chain 6
  misc_feature (828)..(851): Pfam ID: Fer4 Pfam Description: 4Fe-4S binding domain
  misc_feature (788)..(811): Pfam ID: Fer4 Pfam Description: 4Fe-4S binding domain
MSLSLKRKDLMIVNMGPQHPSMHGVLRLIVTLDGEDVIDCEPILGYLHRGMEKIAENRSIIQYLPYVTRWDYLATMFTEAITVNAPEFLENIQIPQRASYIRVIMLELSRIASHLLWLGPFMADLGAQTPFFYIFRERELIYDLFEAATGMRMMHNYFRIGGVAADLPYGWMDKCLDFCDYFLQGVVEYQQLITRNPIFLERVEGVGFISGEEAVNWGLSGPMLRASGIQWDLRKIDPYESYNQFDWKVQWQKEGDSLARYLVRVGEMRESIKIIQQAVEKIPGGPYENLEARRFKKAKNPEWNDFEYRFLGKKPSPNFELSKQELYVRVEAPKGELGIYLVGDDSLFPWRWKIRPPGFINLQILPQLVKKMKLADIMTILDRVEVETINSFSKSELLKEIYGLIWILPILALLLGITIEVLVIVWLEREISASIQQRIGPEYAGPLGLLQAIADGTKLLLKEDILPSRGEIPLFSIGPSIAVISVLLSFLVIPLGYRFVLADLSIGVFLWIAISSIAPIGLLMAGYSSNNKYSFSGGLRAAAQSISYEIPLTFCVLAISLLDIVEAQSKYGFFGWNLWRQPIGFLVFLISSLAECERLPFDLPEAEEELVAGYQTEYSGIKYGLFYLVSYLNLLVSSLFVTVLYLGGWNFSIPYISFFGFFQMNKIIGILEMVIGIFITLTKAYLFLFISITIRWTLPRMRMDQLLNLGWKFLLPISLGNLLLTTSSQLNMFPMLTGFISYGQQTIRAARYIGQGLIITLSHTNRLPITIHYPYEKSITSERFRGRIHFEFDKCIACEVCVRVCPIDLPLVDWKFEKDIKRKQLLNYSIDFGVCIFCGNCVEYCPTNCLSMTEEYELSTYDRHELNYNQIALSRLPISIMGDYTIQTIRNSPQSKIDEEKSWNSRTIRITRNFFLSIMDLPGPIHEILVLFGGFVLLLGGLGVVLLTNPIYSAFSLGLVLVCISLFYFLLNSYFVAVAQLLIYVGAINVLIIFAVMFVNGSEWSKDKNYWTIGDGFTLLLCITIPFSLMTTIPDTSWYGILWTTRSNQIVEQGLINNVQQIGIHLATDFYLPFELISLILLVSLIGAITMARQ

SEQ ID NO: 21766 - DNA, 1077 bp, Sorghum bicolor
  misc_feature: Ceres ANNOT ID no. 8752540
  misc_feature: Up-regulated in root tissues in response to salicylic acid treatment
  misc_feature: Encodes the peptide sequence at SEQ ID NO 21767
atgtttctgcttcacgaatatgatattttttggacatttctaataatagcaagccttattcctattttggtattttggatttcaggacttttagccccggttagtgaaggaccagagaagctttctagttatgaatcgggtatagaacccatggggggggcttggttacaattccgaatacgctattacatgtttgcgctagtttttgttgtttttgatgtggaaacagtctttctctacccttgggcaatgagtttcgacgtattgggtgtatccgtttttatcgaagctttcatttttgttttatgcatggcgaaaaggagccttggaatggtcttaactgaatattcagaaaaaaaaaaaaaagaaggaaaagattccattgagacaattatgagtttgattgagtttccgttactcgaccaaacaagttctaattccgttatttcaactacaccaaacgatctttcgaattggtcaagactctcaagtttatggccccttctatatggtaccagttgttgtttcattgaatttgcctcattaataggctcgcgattcgactttgatcgttatggattggtaccaagatcaagtcctagacaagcggacctaattttaacagctggtacggtaacaatgaaaatggctccatctttagtgcgattatatgagcaaatgcctgaaccgaaatacgtcattgctatgggagcctgtactattacagggggcatgttcagtacagattcctatagtactgttcgaggagttgataagttaattcctgtggacgtctacctgccgggttgcccgcctaaaccagaggctgttatagatgccctaacaaaacttcgtaagaagatagcgcgagaaataattgaggatcgaactctatgtcaaagtcaaaagaaaaatagatcttttactacccgtcacaaactttatgttcggcgcagtactcacactggaacttacgaacaagaattgctctatcaatcaccatctactttagatatatcttctgaaacttttttcaaatccaaaagttcagtatcttcctacaaattagtgaattag

SEQ ID NO: 21767 - protein, 358 aa, Sorghum bicolor
  misc_feature: Ceres ANNOT ID no. 8752540
  misc_feature: Up-regulated in root tissues in response to salicylic acid treatment
  misc_feature (139)..(290): SWISSPROT Homolog: EC 1.6.99.5 NADH dehydrogenase (quinone)
  misc_feature (177)..(285): Pfam ID: Oxidored_q6 Pfam Description: NADH ubiquinone oxidoreductase, 20 Kd subunit
  misc_feature (19)..(111): Pfam ID: Oxidored_q4 Pfam Description: NADH-ubiquinone/plastoquinone oxidoreductase, chain 3
MFLLHEYDIFWTFLIIASLIPILVFWISGLLAPVSEGPEKLSSYESGIEPMGGAWLQFRIRYYMFALVFVVFDVETVFLYPWAMSFDVLGVSVFIEAFIFVLCMAKRSLGMVLTEYSEKKKKEGKDSIETIMSLIEFPLLDQTSSNSVISTTPNDLSNWSRLSSLWPLLYGTSCCFIEFASLIGSRFDFDRYGLVPRSSPRQADLILTAGTVTMKMAPSLVRLYEQMPEPKYVIAMGACTITGGMFSTDSYSTVRGVDKLIPVDVYLPGCPPKPEAVIDALTKLRKKIAREIIEDRTLCQSQKKNRSFTTRHKLYVRRSTHTGTYEQELLYQSPSTLDISSETFFKSKSSVSSYKLVN

SEQ ID NO: 21768 - DNA, 1452 bp, Sorghum bicolor
  misc_feature: Ceres ANNOT ID no. 8752533
  misc_feature: Down-regulated in shoot tissues in response to aminocyclopropane carboxylic treatment
  misc_feature: Down-regulated in shoot tissues in response to methyl jasmonate treatment
  misc_feature: Encodes the peptide sequence at SEQ ID NO 21769
atgagttgtagggagggacttatgtcaccacaaacagaaactaaagcaagtgttggatttaaagctggtgttaaggattataaattgacttactacaccccggagtacgaaaccaaggatactgatatcttggcagcattccgagtaactcctcagctcggggttccgcctgaagaagcaggagctgcagtagctgcggaatcttctactggtacatggacaactgtttggactgatggacttaccagtcttgatcgttacaaaggacgatgctatcacatcgagcccgttcctggggaggcagatcaatatatctgttatgtagcttatccattagacctatttgaagagggttctgttactaacatgtttacttccattgtgggtaacgtatttggtttcaaagccttacgcgctctacgtttggaggatctacgaattccccctgcttatgtaaaaactttccaaggtccgcctcacggtatccaagttgaaagggataagttgaacaagtacggtcgtcctttattgggatgtactattaaaccaaaattgggattatccgcaaaaaattacggtagagcgtgttatgagtgtctacgcggtggacttgattttaccaaagatgatgaaaacgtaaactcacaaccatttatgcgctggagagaccgttttgtcttttgtgccgaagcaatttataaagcacaagccgaaaccggtgaaatcaaggggcattacttgaatgcgactgcaggtacatgcgaagaaatgattaagagagctgtatttgcaaaggaattaggggttcctattgtaatgcatgactacttaacaggaggattcaccgcaaatactactttgtctcattattgccgcgacaacggcctacttcttcacattcaccgagcaatgcatgcagttattgatagacagaaaaatcatggtatgcatttccgtgtattagctaaagcattgcgtatgtcggggggagatcatatccactccggtacagtagtaggtaagttagaaggggaacgcgaaataactttaggttttgttgatttattgcgcgatgattttattgaaaaagatcgttctcgcggtatctttttcactcaggactgggtatccatgccaggtgttataccggtggcttcagggggtattcatgtttggcatatgccagctctgaccgaaatctttggagatgattccgtattacaatttggtggaggaactttaggacatccttggggaaatgcacctggtgcagcagctaatcgtgtggctttagaagcctgtgtacaagctcgtaacgaagggcgcgatcttgctcgtgaaggtaatgaaattatcaaagcagcttgtaaatggagtgctgaactagccgcagcttgtgaaatatggaaggagatcaaatttgatactttcaaagcgatggataccttatag

SEQ ID NO: 21769 - protein, 483 aa, Sorghum bicolor
  misc_feature: Ceres ANNOT ID no. 8752533
  misc_feature: Down-regulated in shoot tissues in response to aminocyclopropane carboxylic treatment
  misc_feature: Down-regulated in shoot tissues in response to methyl jasmonate treatment
  misc_feature (8)..(483): SWISSPROT Homolog: EC 4.1.1.39 Ribulose-bisphosphate carboxylase
  misc_feature (161)..(469): Pfam ID: RuBisCO_large Pfam Description: Ribulose bisphosphate carboxylase large chain, catalytic domain
  misc_feature (28)..(153): Pfam ID: RuBisCO_large_N Pfam Description: Ribulose bisphosphate carboxylase large chain, N-terminal domain
MSCREGLMSPQTETKASVGFKAGVKDYKLTYYTPEYETKDTDILAAFRVTPQLGVPPEEAGAAVAAESSTGTWTTVWTDGLTSLDRYKGRCYHIEPVPGEADQYICYVAYPLDLFEEGSVTNMFTSIVGNVFGFKALRALRLEDLRIPPAYVKTFQGPPHGIQVERDKLNKYGRPLLGCTIKPKLGLSAKNYGRACYECLRGGLDFTKDDENVNSQPFMRWRDRFVFCAEAIYKAQAETGEIKGHYLNATAGTCEEMIKRAVFAKELGVPIVMHDYLTGGFTANTTLSHYCRDNGLLLHIHRAMHAVIDRQKNHGMHFRVLAKALRMSGGDHIHSGTVVGKLEGEREITLGFVDLLRDDFIEKDRSRGIFFTQDWVSMPGVIPVASGGIHVWHMPALTEIFGDDSVLQFGGGTLGHPWGNAPGAAANRVALEACVQARNEGRDLAREGNEIIKAACKWSAELAAACEIWKEIKFDTFKAMDTL

SEQ ID NO: 21770 - DNA, 1068 bp, Sorghum bicolor
  misc_feature: Ceres ANNOT ID no. 8753587
  misc_feature: Up-regulated in root tissues in response to methyl jasmonate treatment
  misc_feature: Up-regulated in shoot tissues in response to methyl jasmonate treatment
  misc_feature: Up-regulated in shoot tissues in response to salicylic acid treatment
  misc_feature: Encodes the peptide sequence at SEQ ID NO 21771
atgtgcgtggaggagctggacgacgcagcagggaggctcggcttcggagaccaggagatcgacaggcgcgcaggtgccgcgatggagagagtttgtgagaacacggtgtctgttgagttcaagcagactaagctgaacaactttgttccgttcatccggtcaggggattggtctgatattggaagtcgcgattacatggaagatgcccatgtgtgcatctctgatctggcaaagaattttggctataactcggtggatgatgaagtaatttccttctatggggtgtttgatggccataatggcaaagatgctgcccattatgtccgtgataacttgccacgggtcatcgttgaagatgctgattttcctcttgagcttgaaaaggttgtcaagaggtcatttgtgcaaactgatagtaagtttgcagagaaattctctcatcagaagggactttcttctggaacgacagcacttacagcaatgatttttggaagatcccttctggtggccaatgccggtgactgcagagcggtgctctcacggcgtggcactgccatggaaatgtccaaggaccacaggccttgctgcatcaatgaaaggaagcgtgtcgagtcacttggtggctatgttgatgatggttatctaaatggtcagctggctgtcaccagagcacttggcgactggcatctcgagggcatgaaagagatgggtgagccaggagggcccttgagcgctgaaccagagctcaagatggtcacgctgacaaaggacgacgagttcttgatcatcggcagcgacggcatctgggacttcttctcgagccagaacgctgtggacttcgcgcggcggaagctccaagaccacaacgacctgaggctgtgctgcagggagattgtcgaagaggcgatacggcggggcgccagggacaacctgacggcagtgatggtctcgttccaccaggatgcccctccccagagcagatggaacaggactagggaaggcagcgtcgcacggagcatatccgccgaagggcttcacaacctcagagtgctcctggaaggccaatga

SEQ ID NO: 21771 - protein, 355 aa, Sorghum bicolor
  misc_feature: Ceres ANNOT ID no. 8753587
  misc_feature: Up-regulated in root tissues in response to methyl jasmonate treatment
  misc_feature: Up-regulated in shoot tissues in response to methyl jasmonate treatment
  misc_feature: Up-regulated in shoot tissues in response to salicylic acid treatment
  misc_feature (61)..(318): SWISSPROT Homolog: EC 3.1.3.16 Phosphoprotein phosphatase
  misc_feature (52)..(311): Pfam ID: PP2C Pfam Description: Protein phosphatase 2C
MCVEELDDAAGRLGFGDQEIDRRAGAAMERVCENTVSVEFKQTKLNNFVPFIRSGDWSDIGSRDYMEDAHVCISDLAKNFGYNSVDDEVISFYGVFDGHNGKDAAHYVRDNLPRVIVEDADFPLELEKVVKRSFVQTDSKFAEKFSHQKGLSSGTTALTAMIFGRSLLVANAGDCRAVLSRRGTAMEMSKDHRPCCINERKRVESLGGYVDDGYLNGQLAVTRALGDWHLEGMKEMGEPGGPLSAEPELKMVTLTKDDEFLIIGSDGIWDFFSSQNAVDFARRKLQDHNDLRLCCREIVEEAIRRGARDNLTAVMVSFHQDAPPQSRWNRTREGSVARSISAEGLHNLRVLLEGQ

SEQ ID NO: 21772 - DNA, 1236 bp, Sorghum bicolor
  misc_feature: Ceres ANNOT ID no. 8753994
  misc_feature: Down-regulated in shoot tissues in response to aminocyclopropane carboxylic treatment
  misc_feature: Encodes the peptide sequence at SEQ ID NO 21773
atgagccgatccttagtccttgcccgtccgcctctgttgtaccccgacgatctggatccgcctccggcttccatcctcgtcgacccgcgaggctacatcgacgaccgcaccaacgccaccaccgccgaaggcgtcacaggcagcggcaagcgcatcagggtaaccttctggatggttagcccgccgcgctgctcctgcttcacagtctacagcccggatctagaggagtccgcgttcggcggcatccccatgctcctcagcacggaggacgacctcgccttgcttcgcctcccgatctgccgtctgggtcgggacggtgtcgcttggaacaacgaccactttgtctatcacgccggcgacgagaataagcctccttcgctggatttgatccccagggctcccggcagagtcttctttgacgaaaacgttggcctcctgcgctgccgtgatggtggcgacatgtatttcatagctatactctgctgggcatactgccagggaaagtacaaactgcacctctacagctccaagacagatacatggagctgcaagattatgtatcttgcttcatcagagcagaagttgctctacacctacccaagcaaggtgatcactattggaggggagcttgggtccataggctgggttgacctctggcgaggcatcctcgtatgcgacgtcctcaaggacagctccgagcttcgctacatcccactgccacctccattggtgcccaggaaactcaagggtcctccattgtatgttcgggacatcattgctgttgaaggctacatcaagtacttcgagatgtgttcacatattgtcggacctgaagcctggaaggcagtcacatgggaaaggaaggattcttgggatgagtggaagaaggacagcgtgatcgaagttcccaagtacccagcacataccaaccctgatcagcaggaggctgaaaccaaaaacctgccaatcttgaacggattctattcaggttatccagtcctgagccaccacgatattggtgttgtttacatattggacagacacggccttgaggacacaaacgtaactgtgcttgctgttgatatgagcaaacagactctaaagggtgtggctgattgttactctccgaggccgctgctttacagttccgtctactttggaagtgggatctccaaacatctgctttcccccaggttctgttcctgtgcgtgcttgttcagtagggcttctagttaa

SEQ ID NO: 21773 - protein, 411 aa, Sorghum bicolor
  misc_feature: Ceres ANNOT ID no. 8753994
  misc_feature: Down-regulated in shoot tissues in response to aminocyclopropane carboxylic treatment
MSRSLVLARPPLLYPDDLDPPPASILVDPRGYIDDRTNATTAEGVTGSGKRIRVTFWMVSPPRCSCFTVYSPDLEESAFGGIPMLLSTEDDLALLRLPICRLGRDGVAWNNDHFVYHAGDENKPPSLDLIPRAPGRVFFDENVGLLRCRDGGDMYFIAILCWAYCQGKYKLHLYSSKTDTWSCKIMYLASSEQKLLYTYPSKVITIGGELGSIGWVDLWRGILVCDVLKDSSELRYIPLPPPLVPRKLKGPPLYVRDIIAVEGYIKYFEMCSHIVGPEAWKAVTWERKDSWDEWKKDSVIEVPKYPAHTNPDQQEAETKNLPILNGFYSGYPVLSHHDIGVVYILDRHGLEDTNVTVLAVDMSKQTLKGVADCYSPRPLLYSSVYFGSGISKHLLSPRFCSCACLFSRASS

SEQ ID NO: 21774 - DNA, 1713 bp, Sorghum bicolor
  misc_feature: Ceres ANNOT ID no. 6431453
  misc_feature: Down-regulated in shoot tissues in response to salicylic acid treatment
  misc_feature: Encodes the peptide sequence at SEQ ID NO 21775
atgaacgcgtcgcagttcatggacaagcagatcctcggcctggccgcctccgcctccccctccggcggcggcggcggcggcgcggggggcggtgggggtgtggatctcagcgatctgatgatcccgatcccccaggaggacggcgaggaccgcctccgtcgccggcgtagcagcagcagcgtcaacggcacggcagacgacatgctacccagctacgacttccagcccatccgcaccggcggcggcgccgccgccgcccccgcgccccaggcctcgtgggggtcgctcgactccaaggaaccctccgccttcaccgccgcctcatacaacctcaagagtgctggtatattggagccacatgtgctgaagaaagttagtcatgaggaagacaggagtaacttccctacagttactatcgcagatattgatcgaaccatgaagaagtactctgataaccttttgcatgcactggaaggtgtaagctcaaggctttcacagatggagggtagaacgcaccaactcgaaaactctgttgatgagttgaagttaacaattggtaactataatggtagcactgatggaaaactcaggcaccttgagaacatgctcagggaggtccaagcaggtgtgcagattatgcgagacaagcaagaaattgtcgagacacagctccaccttgcgaagctccagacaaccaaagctgatgcccagttatcagaaaatagtgggtctggacaggctggctcacagcagcatacagtggctcctccacaagcagccattcagccacagcaagtcctaaccccttcgcaaccacctgcccttcctgcccttcctgctccaaatgcaccacctccacttccaacgctccaaagccaaccaccatcacagtttccaagtcatttacaacattcacaggtaccatctgtgccttctgttgcaccggttccctcagtcccgcctttaccaagggatgtttactatgctccatcttctcagccgactgaaaccatgcaccagcagtatcaagctccgccagctccacagcctcaggctcctcctgcatctcagcagtatcaagcttcgccattccctcaatatgcacagccacctcagcctgcaactgttaaccctccaacttcccatgtgccccctgcaccccagcaaccagaggaaactatgccttatgcaccgcctcagagttatccacctaatgcacgccctccttcaccttatatgcaaccgcctagtggacctgctcctccttactatggacagcaaaaccctagcatgtatgaacctcctgcaggccgggctaaccctgggccgccatcatcctacggttctggtgggtatggcccacagggtggaagtggtttctctgaatcatatggttacagtggatctccttcccaccgtggcaattctggaatgaagccgtcttcaccttttgctcaatcctctgggggaagtggcagctatggcagtggcaggctccccacggctcagatactaccgcaagcagtgccgatcagctcctccagcaccagtggttcttcaggtaatagagtgccacttgatgatgtagtggagaaggttgccacaatgggattctcaagagagcaggtgagagcaaccgtgcggaggctgactgaaaatgggcagaacgtggacctgaatgtggtgctcgacaagctgatgaacggcagataa

SEQ ID NO: 21775 - protein, 570 aa, Sorghum bicolor
  misc_feature: Ceres ANNOT ID no. 6431453
  misc_feature: Down-regulated in shoot tissues in response to salicylic acid treatment
MNASQFMDKQILGLAASASPSGGGGGGAGGGGGVDLSDLMIPIPQEDGEDRLRRRRSSSSVNGTADDMLPSYDFQPIRTGGGAAAAPAPQASWGSLDSKEPSAFTAASYNLKSAGILEPHVLKKVSHEEDRSNFPTVTIADIDRTMKKYSDNLLHALEGVSSRLSQMEGRTHQLENSVDELKLTIGNYNGSTDGKLRHLENMLREVQAGVQIMRDKQEIVETQLHLAKLQTTKADAQLSENSGSGQAGSQQHTVAPPQAAIQPQQVLTPSQPPALPALPAPNAPPPLPTLQSQPPSQFPSHLQHSQVPSVPSVAPVPSVPPLPRDVYYAPSSQPTETMHQQYQAPPAPQPQAPPASQQYQASPFPQYAQPPQPATVNPPTSHVPPAPQQPEETMPYAPPQSYPPNARPPSPYMQPPSGPAPPYYGQQNPSMYEPPAGRANPGPPSSYGSGGYGPQGGSGFSESYGYSGSPSHRGNSGMKPSSPFAQSSGGSGSYGSGRLPTAQILPQAVPISSSSTSGSSGNRVPLDDVVEKVATMGFSREQVRATVRRLTENGQNVDLNVVLDKLMNGR

SEQ ID NO: 21776 - DNA, 1326 bp, Sorghum bicolor
  misc_feature: Ceres ANNOT ID no. 8755074
  misc_feature: Down-regulated in shoot tissues in response to methyl jasmonate treatment
  misc_feature: Down-regulated in shoot tissues in response to salicylic acid treatment
  misc_feature: Encodes the peptide sequence at SEQ ID NO 21777
atggcttcttccctcgcgcccgcgtcgtgggtgctgctgctgcagacgggcggtgctggggcggcagcggcggggccttcctcctgccgcttgatgctcgccgtcgcggagccccgctgccgctgggcagcgtcgccgcgccgggcaagggtgctcgtggcgccccggtgcgcggcgctcgactggcccggcggcagcggcgaggaggaggccaagatcgaggacgagaggaagaagaagccggcgcgcggccgaccggtgtggaggcggatcctgttcgcctccaagaagacacgaagcatcatcatcctcaacgccctcacggtcatctatgcaagtgatattccggttctgaaagaggtcgaagccctgacagagcctgcggtcttcaacatggtgcggttcgttgttgcagccatccccttcgtgccattcgcggtccgtgcctttggggaccgccgtgtacgctatgcaggactggagctgggagtctgggttagcttaggttacctttctcaagcaattggattgctctcatctgatgctggccgagcatccttcatcacggccatcacggtcatagttgtgcctctaattgatggccttcttggtgcctcgatccccaaactcacttggttcggagccatcatgtcactatttggaatcggcctgctggaatgtggcggctctcctccctgcgttggtgatattttgaacttcttcagcgccgtgttttttgggatccatatgcttagaacagagcaaatatcaaggagtacggacaagaagaagtttctagctcttcttagcttcgaggtccttgtggtcgctttctcttctgttctctggtgtatgttcaaagacggctatgttgatactagtgaatccagctttgactcttggactttcggtatgctttgggatacagcagcttcatttccttggataccagcattgtacactggagttctttctacggtgttatgcatgtgggcagagctggtagcgatgggcgatgtttcagcaactgaaactgcaattgtttacggcttggagccagtttggggagctgcttttgcttggttcctccttggtgaaagatgggataacaccacatgtattggagctgcccttgtattatgtggcagtttgactgttcagctatttgggtcagctcctaagaagtacaagaaagttaaaaaacgcagcagcaatgctttagaaacgccagtgaaacaacaagactacttatcgttatctcctataccagttgattcggggaagttcataggaaggcaattagaaaggaggaacaaaacattatag

SEQ ID NO: 21777 - protein, 441 aa, Sorghum bicolor
  misc_feature: Ceres ANNOT ID no. 8755074
  misc_feature: Down-regulated in shoot tissues in response to methyl jasmonate treatment
  misc_feature: Down-regulated in shoot tissues in response to salicylic acid treatment
MASSLAPASWVLLLQTGGAGAAAAGPSSCRLMLAVAEPRCRWAASPRRARVLVAPRCAALDWPGGSGEEEAKIEDERKKKPARGRPVWRRILFASKKTRSIIILNALTVIYASDIPVLKEVEALTEPAVFNMVRFVVAAIPFVPFAVRAFGDRRVRYAGLELGVWVSLGYLSQAIGLLSSDAGRASFITAITVIVVPLIDGLLGASIPKLTWFGAIMSLFGIGLLECGGSPPCVGDILNFFSAVFFGIHMLRTEQISRSTDKKKFLALLSFEVLVVAFSSVLWCMFKDGYVDTSESSFDSWTFGMLWDTAASFPWIPALYTGVLSTVLCMWAELVAMGDVSATETAIVYGLEPVWGAAFAWFLLGERWDNTTCIGAALVLCGSLTVQLFGSAPKKYKKVKKRSSNALETPVKQQDYLSLSPIPVDSGKFIGRQLERRNKTL

SEQ ID NO: 21778 - DNA, 1785 bp, Sorghum bicolor
  misc_feature: Ceres ANNOT ID no. 8755080
  misc_feature: Useful for making plants with modulated biomass
  misc_feature: Useful for making plants with modulated nitrogen use efficiency
  misc_feature: Encodes the peptide sequence at SEQ ID NO 21779
atgggaagctcatccaactcaagtcctgcgttgagtgagactaagaacacaacaccgtcagtatacacagaagatggaactgttgacttcaggggaaaccgtgcagttagagccaccacagggggaaggaaaaccgccgccatactgcttgtgagctacgcgcttatgaatttcgcattctatggggtggccgtggacctggttgttttcatgcgaagggtgctccatcaagagaatgccacagctgccagcttcatcagtatgtggaccggcacggtctacatcttctctctgtttggtgcattcctcagcgactcctacatgggccgttaccgcacctgcgtcatgtttcagatcatctttctcatcgggctggtactgctatcgttttcctcattattcttgctggtggagccctctaggtgtggtgacaaccaacagcataggccatgccagccgccgtcgcagctcggcgttgtgatgttctatatctcaacattcacgactgcatttgggatcggagggtatcagccatcagttgccacgtttggcgcggaccagtttgatgactcagacactatatggagcgacgctccaagctctccttcttcagctacttctacctggcgctcaacatcggctccctcttctccgactccttcttggcgttctacgaggacaagggcatgtgggtcatgggcttcggggtctccgctgtcgctgttgccctcgggcttctgctctttctccttggcacgccgtactaccgccactgcaaacaatctggcaacccgctcacacgcatggcgcaggtgttcgtcgctgcattctgcaagcggcacttgcagccaccacctggcgaggtcctccatgaggttgagggtgaggattcagagactcagggcatccgcaaactccttcacagcgatcaactcaggtatgtgtcttgataaggcggcgatagttaccgaggaggactaccacgctggtaaagccaagaacccgtggaggttgtgcactgtgacgcaagtggaggaggtgaagtgcatcttgagcttaattcccatatggatgtgcaccatcatcttctcggttgagttcacacagatggcgtccacattcgtggagcaaggcacagccatggacaccaacctctttggcaacttctatatgcctgcagcaagcatgtctatgtttgacatcgccagcgtgatcctctctgtctttgcctacaacttcttctttgtgcccatggcgacatggttcacaaagaaccctgctgggatcactgagctccagcgcatggggactggtctggtcatcgcgctagttggcatgcttgctgcagcaattgttgaggtctaccgactgcgtcgtgttctggcaaaggaccaaccgagccccatgagtgtcctttggcaggctccacaatatatgctcattggggcttcagaagtcttcatgtacatagggcaactggatttcttcaatgagcagaccccggacagcatgaagtgttttgggagctctctatgcatggcttccatatcactcggaaactatgccagcatgctgatggtcagtgcagtcactagcatcaccaatcggcaaaacaagaatgggtggatcacaaaaaatcttaattatggccaccttgaacggttcttccttcttctcgctgtgctctcggtcatagactttattttctttgcattattttcgatgatgtacaagggtattcagtttcaggggagggagaaagacatctctcccaattataactag

SEQ ID NO: 21779 - protein, 594 aa, Sorghum bicolor
  misc_feature: Ceres ANNOT ID no. 8755080
  misc_feature: Useful for making plants with modulated biomass
  misc_feature: Useful for making plants with modulated nitrogen use efficiency
MGSSSNSSPALSETKNTTPSVYTEDGTVDFRGNRAVRATTGGRKTAAILLVSYALMNFAFYGVAVDLVVFMRRVLHQENATAASFISMWTGTVYIFSLFGAFLSDSYMGRYRTCVMFQIIFLIGLVLLSFSSLFLLVEPSRCGDNQQHRPCQPPSQLGVVMFYISTFTTAFGIGGYQPSVATFGADQFDDSDTIWSDAPSSPSSATSTWRSTSAPSSPTPSWRSTRTRACGSWASGSPLSLLPSGFCSFSLARRTTATANNLATRSHAWRRCSSLHSASGTCSHHLARSSMRLRVRIQRLRASANSFTAINSGMCLDKAAIVTEEDYHAGKAKNPWRLCTVTQVEEVKCILSLIPIWMCTIIFSVEFTQMASTFVEQGTAMDTNLFGNFYMPAASMSMFDIASVILSVFAYNFFFVPMATWFTKNPAGITELQRMGTGLVIALVGMLAAAIVEVYRLRRVLAKDQPSPMSVLWQAPQYMLIGASEVFMYIGQLDFFNEQTPDSMKCFGSSLCMASISLGNYASMLMVSAVTSITNRQNKNGWITKNLNYGHLERFFLLLAVLSVIDFIFFALFSMMYKGIQFQGREKDISPNYN

SEQ ID NO: 21780 - DNA, 1410 bp, Sorghum bicolor
  misc_feature: Ceres ANNOT ID no. 8755072
  misc_feature: Useful for making plants with modulated biomass
  misc_feature: Useful for making plants with modulated nitrogen use efficiency
  misc_feature: Encodes the peptide sequence at SEQ ID NO 21781
atggccgacccctccgccgccgccgccgctgcaaaccctagccctggcgccggcgaggaaggagccgcctgctctccgccgtcgccgtctcaaagggggcggggcaaggtggttatcgttatgggcgccacgggagccggcaagtcgcggctggccgtcgacctcgcggcccacttcgccggcgtcgaggtggtcagcgccgactccatgcagctctaccgcggcctcgacgtcctcaccaacaaggtccccctccacgagcagaacggtgttcctcatcatctccttagcgtgattgatccctccgttgagttcacttgccatgatttccgcgaccatgccgttccgattatacaggaaatattggatcgcggtggcctccctgtgattgtcggcggcacaaacttctacatccagagtcttgttagcccattcctctttgatgatatggcagaagaaatgcacgactgtactttgagagaacacatagatgatgatagaggccttaccaatgatgatgaagacagtgggtatgaacgcttgaaggatattgatcctgtggctgcgcaaaggatccatccaaacgaccatagaaaaatcaaacgctacctcgagttgtatgcaacgacaggttccctacccagtgatctttttcaaggagaggctgctaagaaatggggtcgacctagtaactccagattcgactgttgtttcctgtgggtagatgctgatcttcaagctctggatagttatgtcaacaaaagggtcgattgcatgatggatgctggcctgctgaatgaagtatgcaacatatatgatgcagatgctctttatacccaagggctgcggcaggccattggggttcgtgaatttgacgagtttttcagactatatttaccaagacaagaatctggtgaggattcttctgcaaacttgttagatatacatgacgatcagcttaagagcttgttggatgaagctgtttcccagctgaaggcaaacactcgcagattagttcgacgtcaaagacgaagactgcaccgactgggtaaagattttgggtggaatttgcatcactttgatgcaactgaagcattctgctgtgccactggggactcgtggcaaaagaaagttgttgaaccttgtgtggatgtcgtaaaaaggttcttgtccgatgattcaactgttttaccaagcacgagcgcctcagatggtgtggttgggagcgtaaggggcccgtcaagagagctgtggacacaatatgtgtgcgaggcctgtgacaaccgggtgcttcgaggggcgcacgagtgggagcagcacaagcaagggcgaggtcaccggaagcgagtgcagcgcctgaagcagaagagcctgaggccacggccattgctgtcgcaagactgcaactga

SEQ ID NO: 21781 - protein, 469 aa, Sorghum bicolor
  misc_feature: Ceres ANNOT ID no. 8755072
  misc_feature: Useful for making plants with modulated biomass
  misc_feature: Useful for making plants with modulated nitrogen use efficiency
MADPSAAAAAANPSPGAGEEGAACSPPSPSQRGRGKVVIVMGATGAGKSRLAVDLAAHFAGVEVVSADSMQLYRGLDVLTNKVPLHEQNGVPHHLLSVIDPSVEFTCHDFRDHAVPIIQEILDRGGLPVIVGGTNFYIQSLVSPFLFDDMAEEMHDCTLREHIDDDRGLTNDDEDSGYERLKDIDPVAAQRIHPNDHRKIKRYLELYATTGSLPSDLFQGEAAKKWGRPSNSRFDCCFLWVDADLQALDSYVNKRVDCMMDAGLLNEVCNIYDADALYTQGLRQAIGVREFDEFFRLYLPRQESGEDSSANLLDIHDDQLKSLLDEAVSQLKANTRRLVRRQRRRLHRLGKDFGWNLHHFDATEAFCCATGDSWQKKVVEPCVDVVKRFLSDDSTVLPSTSASDGVVGSVRGPSRELWTQYVCEACDNRVLRGAHEWEQHKQGRGHRKRVQRLKQKSLRPRPLLSQDCN

SEQ ID NO: 21782 - DNA, 8229 bp, Sorghum bicolor
  misc_feature: Ceres ANNOT ID no. 8744760
  misc_feature: Useful for making plants with increased aluminum tolerance
  misc_feature: Encodes the peptide sequence at SEQ ID NO 21783
atggcgacctacatcaacgagctccgcgcgctcatcgcgtccacctcgacctccacggagtccgacggcgccgagtcgggctccgcgcacctcgaggtcaagctccgcgaggtgctccccaacctcctccgcgactacgtcatcccctcccccaaagccgccgggaggctcagggaagtcagcgcgatcctgaagctggtcggcttcacggcgctcaagttccccggggtcttctacaacggccgcgccgccgacgtcctcagcgtcatcgcccgcatcatcacgttgagccatgatatcatattccaggcagtttggaatcttctctccattctccgtacaggtgaccgtgaagcctacagacaattctttctagatgctatggttgcggtagaagatgtgctatatgtggcatcattgcatgacagaagtcctagtggtgtgcctcctggaagatgtttagttaaatgcctcagtggatccttcttggatatattagacacacctgggccttatagtgagctcccagctagttgccgacctaagaatggacctggtgtgctggttgatctgacaggcaatgcaagatggcgcccatttgccacttcgttgattaaactagttaacaagtgtcttacagatgggaccttgtatgtcgatgggcttgttaacatgccatttgtttctgctgcttgttctatcctctgctatggggatggttctctgcataaggtttgttttgattttgcacgtattgttgccacagtagtgactcctgagattcttcctctagaaaacatcatttgttcaatcacttgcattttgagccaagaaattagcgaactctctgatatcagagatgcagattatgacttctcaatgggagcgtgtcttcgtgcactgcattcttcatgtcctgactatattgttgaatctacagctgttgatattgttaatattctcgaaaaagcagtaaagaccagcaaaagtgcagaacttcaggttgcactgtgcactgcatacaagagaatagttgaagtttgttctgtacaagtatggaaaccagaaatccttctgaagttgctctgcttgccaaaacgttgcagaaaactgattctatgcattcgagcggttatcagcaaatttggtcaaaccttttttgctctggatgatggtaacagtcaaagcagtcctcaggcaagatctggaaaaattgagttgccaaaagttggccagaaaagaatatcacggcatgaggaaagcagttctgccaaacgtcagaagatgactgaatcaggattttctgctaccactggatttgaaaaggaagattatggctatgcttttctacagtctttaaattcactgattaattgcctgtcaccagacaatcatgagacttatccattagaccctgaggctgctatagaagtgattagtctgctgtgtatttcattatgtgtttatccgaagacaagtctgtttaccagagtttctaagcaagtcctttcctggatttcttggattcataaacaggtagctcttcatactgtaatgcttctccaattcaatcttcctgggcacactaaacttcttgaagatgactcacagttgattggtgatggtacacattttgttcatccaacatatgctaacctcatcagcatgttgaaactgatgtgggatgttggtcatgctgtcactgaaactagttcaaactacaagatagaatatcttttgttgcaagtatttgctaagattggcaatagactgacttctggatgtgatcttgaattccttgatttggctatccgtaatggaactgctgagattaaaaatgaggcaattatatcactacccataattgtgttatattctggtcctaggatgcttggagcaatgtttaagaaactggagtcagtggatgctttaggactcgagaacacagggaaaagtattgccttttcacttggttttctatcttgcttaaatggaaccaccgatcacactgacaatgtgggggaccattgcaagctattcttggacaagcactatgaacaacctgtgtcaacattagatcttctcttgagaggtttctgttgtcctcaatgtgatatcatgaatagaactgtccacaatgaagagcaagtttctatagtggacattgcaccattacaggttgagaatgtggacttcaatatcaacatgtccaaggcccacactctctttttcaaatttctctacacagggacttctcaggaatctatagtttctgtggttgaagttttgccacggttattgaggcattctagcaggcatcttctacttgatatgagaactcggtggaatcagtgttttgaatttcttctgtgtcatgaaatgaaagctgtcagggaagcattttctggtgtagtctactgcttcttggaaaacagtgttatggatattttgttttctggtggactgggaatgaatggagggtctaaagaactgttcatggacaagataaaatgtgctttcaccaaagttgaagattctcagattcttttgacacttctggaatcaattggtactattgtgaaagttagtgatattcatggagaagttttcttctcctcatttgtgttacttattggccagcttgataatcataattccatcataaggatgactgcattgagattaattcacagatgctgtgcatactgtttcaaaggaggactggatctcttcctcttgaagtactcacatgctagagataatttatatgactatctgtcatctagacttgtgactcatccagtgataattaaggaattcgctgaggacgttgtaggtattaagaccgtagagctgattaagagaatggttccatcagttataccaaagctcattgtatcgcacccaaacaataaccatgctatttttactctgcgtgaactggcaagccatctaaacactgagtgggtaccactgattgtaaatatgttgcctaaagttctctgctttgctcttttttatgaagatgggcagcatttaccatcagttctgcaattttataagaatgagacgggaactgatagcaaagagatatttgcagctgctttgcctacactgcttgatgaaattgtatgttttcctggggagtctgatcagattgagaatgatataaggacagcaaaaatctcaccaacaattcagaatattgctagaattctgacaggcagtgaaactcttcctgagtttttgaggaatgaatttgttcgccttctcaatagcattgacaagaagatgcttcactctgatgatatgaagcttcaaaagcaagctctccagcgaataaggaaactgattgagatgatgggcccttatttgagtacacatacgccaaagattatggttctgttgagtttcgccattgataaggaaggtctccagatgggtggtcttgatgtcttacattttttcataaagcaattggctgaagtatcaccaagtagtatcaaatatgttctgtcccaagttgttgctgctttcattccatctctggaaaggtgcagaggatgtccttccgcgaacctaggtaaaattgttgaaatcctagaagagcttgttgtgaaaaacaatagcttgctaaagcaacatatacgtgaactaccactgttgcctagcataccgtctttatcggaagtaaacaaggtaatacaggaagctagagggctaatgacactgcaagatcatctgaaggatgctgtcaatggtcttaatcacgaaagcttaaatgtgaggtacatggtagcttgtgagctgagtaaattattcaaggtcagaagggaggatatgactactcttatcattggtgaagatattgctgatttggatgtaataagctctttagttatggctttacttaagggatgtgcagagcaatcaaggactgttgttggccagagactgaaactagtttgtgcagactgtcttggcgcacttggtgctgttgatcctgctaagttgaaggtaagttcttgtgagcgctttaagatagaatgttcagatgatgatctgatatttgagttgatccacaagcatcttgcaagggcattcagagctgctgctgacactacagtgcaagattctgctgcctttgctatccaggagctactaaaattggcaggttgccagtcttcatctagtgaagaatcaaattgttgtgagatgagctacaggggccagaagttgtgggaccgtttctcaaattatgtcaaggaaatcattgccccatgcttaacatcgaggtttcatcttcctaacccaactgattctgctttagccggcccaatattccgcccaacaatgtcttttagaaggtggatatacaactggattagaaagttgtcatcacatgcaactggatcccgttctagtatttttagtgcatgtcgtttaattcttctgcacgacatgccaactgcaatatatctcttaccatactcggtcttaaatgttgtctgttatggtactccagaggctcgtcagagcattactgaggaaattctgtgtgttctcaatgctgctgcttctgaaaatagtggggctgctgttcatgaaattgcagtggggcagagtgaggtctgtattcaagccatcttcactttacttgataatcttgggcaatgggttgatgacctcaaacaggaaattgctttatcccagtctagttatgccacggctgggaagcatggaggtaaactgaaagatggaacatattctgatcatgaacaggatcaaatgctggtgcagtgtagcaatgttgctgagttgctggctgctatacctaaagtcactctagcaagggcctctcttagatgtcaagctcatgctcgtgctctaatgtactttgaatcccatgtcctggagaattctggttcctccaatccagctgcggagtgtagtggcaccttttcagacaatgacatatcttttcttatggaaatatatggaggattggatgagcctgatggcctcctaggtttagcaaatctgaggaagtcatcgagcctacaggatcagcttatcattaatgagaaagctggaaactgggctgaagtcctaaccttatgtgaacaggccttgcaaatggaacctacctctgttcatagacaatccgatgttcttaattgtttgctaaacatgtgccaccttcaaggcatgatcgcccatgtggacggtttggtttgcagtataccccagtataagaaaacttggtgcatgcatggagtgcaagcagcgtggcgattagggagatgggatctcatggattcatacctgactgggacagacaagggtctggtgttcagcagttctgagaataatgcttcttttgacatggatcttgctaagatattcaaggccatgatgattaaagatcagtttctggttgctgaaaaaattgcccagtccaagcaagcattgcttgtacctctggctgcggcaggcatggactcatatatgcgtgcatatccttatgttgtcaagctccatatgttgcgtgagttggaagacttcaattccctgttgggagatgagtcatttattgataagtcattttgtgcaaacgatccaaactttcagaagttaacaaaggattgggagaaccgtctgagatgcacacagccatcactatggacaagagaacctttacttgctcttcgaagggtggtttttagtcagagtcatatgaatgttcaggttgggaactgctggcttcagtatgctaagctctgccgtttggctggtcacaatgagacagcccaccttgcaatactagaagcagatgcctcaggtgcccccaatgctcacatggagaaggcaaagtatctctggaatatacggaagtttgatagcgctatagctgaacttcagcaaacgcttatcaacatgccagcggaagttttgggaaacgccgttgtttcatctctttgtagcctctctcttgctttgccaaatgcacctatctctgcaacacaagcatcgaaagagaatccagatgtgtctaaaaccctgcttctctatactagatggattcacaatacagggcaaaaacagagtgcggatatcaaatctctctattctagagtaacagaattgcggcccaagtgggaaaaaggttttttctgcatggcaaagttttttgatgatttgcttgttgatgctaggaaaaggcaagaagataagtttgcttgtaaagttggaccagtcccttctagctctgcaagcagggcaattgaagaaaaagagaagccttggtgtgaatttcttccaggagtgctactatgttatggaaaagcacttcacaggggacataagaatctttttcaagcactgcctcgaatgcttactctttggtttgaatttggaagcatatatgtccgaaatgaatcttcctccaatcaacgaatgaaagagattaatgcaaatgttttaggcctcatacgtgggtgtttgaaggatctaccaacatatcagtggcttactgtgctgtctcagttgatctcccgcatctgtcaccaaaatgctgatgttgtcaaaatggtcaaatgcatcatcacatcgattttacgggaataccctcaacaagctctttggatgatggctgcagtgtctaattccactgttctggcaagacgagatgctgctgcagaaatattgcagtcagcaaagaaaggatgtcggcgtgcgagtaatgcactcttcagtcaatttactaatcttataggccatcttattaggctctgctctcatccagggcaaccaagggcaaaaacaataaacatctcaactgagttcagtgccttgaaaagaatgatgccactaggaattatcttacctgtccagcaagctttaactgtgactctgccatcatatgattcaaatatgtcggatcaatctggttttcaccccttctcagtctctcaacatcccactatagctggaatagctgatgaagcagaaattctcaactcccttcagaaaccaaagaaggttgttttccttggaagtgatggagttgaacgtccatttctttgcaaacctaaggatgatcttaggaaagactcacgcatgatggagttcaatgcaatgatcaaccgtctcctctccaaggtccctgagagccgcaggagaaagctctatatcagaacctttgcagttgtaccacttaccgaagattgtggaatggtagaatgggtgcccaatactcgtggtcttcggcatattcttcaggacatctacataactcttgggaagtttgatagggcgaaaacaaattcacaaatcaagaagatatatgacacatgccatgggaaaatgcctgacgatgtgatgctgaagaccagaatccttccaatgtttcccccagttttccacaaatggttcttgacaacattctctgaaccagctgcatggtttcgtgctagagtggcatatgcacataccacggcagtgtggtcgatggttgggcacattgtggggctgggcgacaggcatggtgaaaacatcctcttcgattcgacaaccggggactgtgtgcacgtggattttagctgcctgtttgataggggcttgctactggacaagcctgaggtggtgccgtttaggcttacacagaacatgatcgatggcttgggcatcactgggtatgaaggcgtatttttaaaggtgtgtgaaatcactctatctgttctcaggacccacaaggagaccctcatgactgtccttgagaccttcatccatgatccactcgtcgagtggaccaaacttaacaagtctagtggaggtgaagtccagaacccacacgcacagagggccatcaccaacatcaaagcaaggctccagggagttctggtgggtgtcaaagccagcccttccctgccgctatctgtggaaggccaagcgcggcggctgatcgctgaagcggtctccctcaacaacctcggcaaaataaactttgggcagaaagtggcgacccttcagtttatagccccccaaccatacctgccctacacccctattgctgctgctgtacctagcataccaatgcttctttcatctactagtactacttcaactacaacatatctctggcctcttggggtagcacttatagcagtaaaaaatcgtagtgttggtccattggcactggaattgaaacgaatggtggtgctttattaa

SEQ ID NO: 21783 - protein, 2742 aa, Sorghum bicolor
  misc_feature: Ceres ANNOT ID no. 8744760
  misc_feature: Useful for making plants with increased aluminum tolerance
MATYINELRALIASTSTSTESDGAESGSAHLEVKLREVLPNLLRDYVIPSPKAAGRLREVSAILKLVGFTALKFPGVFYNGRAADVLSVIARIITLSHDIIFQAVWNLLSILRTGDREAYRQFFLDAMVAVEDVLYVASLHDRSPSGVPPGRCLVKCLSGSFLDILDTPGPYSELPASCRPKNGPGVLVDLTGNARWRPFATSLIKLVNKCLTDGTLYVDGLVNMPFVSAACSILCYGDGSLHKVCFDFARIVATVVTPEILPLENIICSITCILSQEISELSDIRDADYDFSMGACLRALHSSCPDYIVESTAVDIVNILEKAVKTSKSAELQVALCTAYKRIVEVCSVQVWKPEILLKLLCLPKRCRKLILCIRAVISKFGQTFFALDDGNSQSSPQARSGKIELPKVGQKRISRHEESSSAKRQKMTESGFSATTGFEKEDYGYAFLQSLNSLINCLSPDNHETYPLDPEAAIEVISLLCISLCVYPKTSLFTRVSKQVLSWISWIHKQVALHTVMLLQFNLPGHTKLLEDDSQLIGDGTHFVHPTYANLISMLKLMWDVGHAVTETSSNYKIEYLLLQVFAKIGNRLTSGCDLEFLDLAIRNGTAEIKNEAIISLPIIVLYSGPRMLGAMFKKLESVDALGLENTGKSIAFSLGFLSCLNGTTDHTDNVGDHCKLFLDKHYEQPVSTLDLLLRGFCCPQCDIMNRTVHNEEQVSIVDIAPLQVENVDFNINMSKAHTLFFKFLYTGTSQESIVSVVEVLPRLLRHSSRHLLLDMRTRWNQCFEFLLCHEMKAVREAFSGVVYCFLENSVMDILFSGGLGMNGGSKELFMDKIKCAFTKVEDSQILLTLLESIGTIVKVSDIHGEVFFSSFVLLIGQLDNHNSIIRMTALRLIHRCCAYCFKGGLDLFLLKYSHARDNLYDYLSSRLVTHPVIIKEFAEDVVGIKTVELIKRMVPSVIPKLIVSHPNNNHAIFTLRELASHLNTEWVPLIVNMLPKVLCFALFYEDGQHLPSVLQFYKNETGTDSKEIFAAALPTLLDEIVCFPGESDQIENDIRTAKISPTIQNIARILTGSETLPEFLRNEFVRLLNSIDKKMLHSDDMKLQKQALQRIRKLIEMMGPYLSTHTPKIMVLLSFAIDKEGLQMGGLDVLHFFIKQLAEVSPSSIKYVLSQVVAAFIPSLERCRGCPSANLGKIVEILEELVVKNNSLLKQHIRELPLLPSIPSLSEVNKVIQEARGLMTLQDHLKDAVNGLNHESLNVRYMVACELSKLFKVRREDMTTLIIGEDIADLDVISSLVMALLKGCAEQSRTVVGQRLKLVCADCLGALGAVDPAKLKVSSCERFKIECSDDDLIFELIHKHLARAFRAAADTTVQDSAAFAIQELLKLAGCQSSSSEESNCCEMSYRGQKLWDRFSNYVKEIIAPCLTSRFHLPNPTDSALAGPIFRPTMSFRRWIYNWIRKLSSHATGSRSSIFSACRLILLHDMPTAIYLLPYSVLNVVCYGTPEARQSITEEILCVLNAAASENSGAAVHEIAVGQSEVCIQAIFTLLDNLGQWVDDLKQEIALSQSSYATAGKHGGKLKDGTYSDHEQDQMLVQCSNVAELLAAIPKVTLARASLRCQAHARALMYFESHVLENSGSSNPAAECSGTFSDNDISFLMEIYGGLDEPDGLLGLANLRKSSSLQDQLIINEKAGNWAEVLTLCEQALQMEPTSVHRQSDVLNCLLNMCHLQGMIAHVDGLVCSIPQYKKTWCMHGVQAAWRLGRWDLMDSYLTGTDKGLVFSSSENNASFDMDLAKIFKAMMIKDQFLVAEKIAQSKQALLVPLAAAGMDSYMRAYPYVVKLHMLRELEDFNSLLGDESFIDKSFCANDPNFQKLTKDWENRLRCTQPSLWTREPLLALRRVVFSQSHMNVQVGNCWLQYAKLCRLAGHNETAHLAILEADASGAPNAHMEKAKYLWNIRKFDSAIAELQQTLINMPAEVLGNAVVSSLCSLSLALPNAPISATQASKENPDVSKTLLLYTRWIHNTGQKQSADIKSLYSRVTELRPKWEKGFFCMAKFFDDLLVDARKRQEDKFACKVGPVPSSSASRAIEEKEKPWCEFLPGVLLCYGKALHRGHKNLFQALPRMLTLWFEFGSIYVRNESSSNQRMKEINANVLGLIRGCLKDLPTYQWLTVLSQLISRICHQNADVVKMVKCIITSILREYPQQALWMMAAVSNSTVLARRDAAAEILQSAKKGCRRASNALFSQFTNLIGHLIRLCSHPGQPRAKTINISTEFSALKRMMPLGIILPVQQALTVTLPSYDSNMSDQSGFHPFSVSQHPTIAGIADEAEILNSLQKPKKVVFLGSDGVERPFLCKPKDDLRKDSRMMEFNAMINRLLSKVPESRRRKLYIRTFAVVPLTEDCGMVEWVPNTRGLRHILQDIYITLGKFDRAKTNSQIKKIYDTCHGKMPDDVMLKTRILPMFPPVFHKWFLTTFSEPAAWFRARVAYAHTTAVWSMVGHIVGLGDRHGENILFDSTTGDCVHVDFSCLFDRGLLLDKPEVVPFRLTQNMIDGLGITGYEGVFLKVCEITLSVLRTHKETLMTVLETFIHDPLVEWTKLNKSSGGEVQNPHAQRAITNIKARLQGVLVGVKASPSLPLSVEGQARRLIAEAVSLNNLGKINFGQKVATLQFIAPQPYLPYTPIAAAVPSIPMLLSSTSTTSTTTYLWPLGVALIAVKNRSVGPLALELKRMVVLY
